United States Patent 9,567,581 (SELECTIVE REACTIVATION OF GENES ON THE INACTIVE X CHROMOSOME) - sequence listing, part 4

SEQ ID NO: 534 - DNA, 60581 bp, mus musculus
gaagccctgaagccggcagctctttggcccaacctctcccagagaccggatccaggaaatacgaggcgggcttcagtgggagggacgccgcgagggaggaggaggaggcaagggggcggcggcagcggcggcggcggctcacaccggatctgccctcggcacggcgcgcagtcaagggggttcggccggggaagccgtgcccgcccggaccccccgtgggagcctgcggacggaccgagggccgggcggaggagcccggagcggccgcgggggctcggtgagtggtggcggggaggcccggcacctgcccgaggctaggacttcggaggtgccctggggtcgtcctagtgaccccgcgaccacgacgttgggcgtgggcgagactgcgggtgtcggcggggctcgtcccggcctctggctctcagccggcccgggtaagtacctggctgcgggaggtttgcgcagggcctgtcgtggcggctgcgcccgccaggacgccccgaacgccccgaggccgaggggagagggagtggctgcgggttgggggtggaggggcttgatcgctatcagccctcgcgggagaggcgaggatgcctttcctcctgggctcctggacatcctgcagaacgcacctctatggacaggtttgaagtccgggttaaggcgttcgagggattaggactcgcagaactaaggctgattcttttaaaggtgttgggacctgtgcgcaaggttagtagtggtagaaatgattgtcgtggaagtggtttgcaaataattgttggcaggtgttgaggaaagctaagatactgtcgtcttttaaagatgacactgaacagccgccctctgaggtccaacaacagattagagttggtcctagttggaggtttatagtttactaccgcgtatctgcttataaagtggattaagtaggataggaggagggaagatgtaggcaaggtgaaggagaaagtaagctgcacagtaaagaaccaaaagttcagattcaagacacgttgaagtataaaaaactgcctgttctgaagcataacatttagaatttggttgttgctggggaaattgcctgttagtggtgcaaggcagggctctttggttgtgggcttcagtaacctttgtcaatttttatcatttataatgtatttaggagtttgtaaacggaaaggaaggagcagtgtaaaagaacaacttgatgaacccggcttgctctgtactttgttagtgggtgggggtcgggggcttactttttgctttatgagtgatttataggactataaaagaacacacttagaaaggacgcatggttgagaagtttttggatttttttaaatggagatttaactataatattcaattacaaagtacactatcttctatggtaacttttctcaatgaacactggaagtcagcaagcacgtcttcaattctacatatacgtaatttgtaatcagtgggttatgtaatttttacaaacgtacagtccccctcccctttctcctagaacttgtttaatcaagacaaagttggctttagggaaggtagataataaatatatgattcctgacgttacatctgacaaggcataatgaatgtccagtcgccctgacttttcttctgttatgtgacatattctttaattgcaggcaaccctgtgcagtttgtgttggagcaaagtgagctgagtatctgcagtcactggacttggtaggcagtatgcattttaattgaatcctaagtgtttctcgatgttagagacaatgtctattgcacagataacagcataaaacttcagtattcttctgtagcttgcttacatagctgaggttatatagtgcgtaaactgcaaagctagaactcagattcttgtatatctaagtttagagcatgtgttctttctagatacgctgtatgtgtttatgtgctggcatcaatttattgaaagtggaaattttttattgtaaagaaaccattcaattctgttgaaggttttcgtgtgtcttaaaagataatctcaagtattttttttttattttggatgtgtccattttttagacggaggtatggtttgagctaatgtgtaaagattctaaatagttagcagtgacctatacctgaaattcatggttttggtaacttcaccttagtgtacccaagatacttcaaagaataaatgttttgtttactctgatcttgaattatatttataattgtactactaaagtaaatagcaagtgttcacaggggccttgggttgtgatagtgtccacaggtccttcttagacctcagaacagtacttgttaggcaattttgctgttcttctttacatttagtcccaaagttttagagttagattgcattttgcaaaatatacggccaatattagggcaagcagcagcatctcttatgggcctaggggtggacagattttagatcttccagagcagcgagtttccgagcctttagtgaagtcacagggacactttgcagaggtgttaggttgggaaaggcatggcttttggctcccactgctctctgctgttgggtctcttgacgtgctgttgagctcgtcctcgtcctagctcttatctctgttgaagagacaggccccacatctgggtagagttcagctggaagaaaagctagagcagtagggggtggggtggggaggaagatgacacctaagtggtgttcatcctccagcaggtcattcggccagagttaattatgtggttaattatctttggctggaaattctagaaatgttttgcagtttgggatctttttttttttttttttctaaagatgtaaattgttttagaagtcttcctggaatggccctgtctcacagacatggagaaaagatttctgagtttctcagtctgggtatgtgttctatggagtatggggctggtttaaataacaccttgtaatcttgacggacaatctttgggttgaaggagcaagtttttaattatagttgtactcccaagaaagagttaaatatactttacttgggaaggtaattactcctggtatttggcctattagagtggaaaatattgacaaatgagaaaacctacctagaagtaaacagaaagcctttctgacatattttatatcatcactatataaaaaagcacaccgggaaagtgtatgtatgtagaagcttattttcattcctttggcataaccctatattaatattataatcatgaatatttgtctaaaactgaaatagatgtaatgaaatacttggaactatccaactgaatcctaaatattgaacaacatttttataatttagttaattgaaagctctatttgcttactatcctatccaacagtccacaatctcacttttcttcttgcttaaagtctctcagcttgtattccttcctttcttgatgctatcctgtcatcacctggatctttcctttaattctcagttaaccctggggtcttttgcaagttgtatgaaaagtgaagaggcctacaaagcctttaagcccatcccctggtctgaattcttttgccctagcaagtcaagaggaatgcagttaagaccctataacccaccagattgtgtctttaaaaggagaatgagaataacagattgagggaggcagtgtccagactcttgctatggtttcctgtctcccttctcctgaagagtcaagaagctaagtttgtagaagccagtgtgctgcagaagtgggcgttgttccctccttctcttcaccacccaccttactctcagacggtccactccttcctttaagcagtcatcctcaatttctgtccttctcctaactaggtttagccttcatcctctttgatctctcccctacccccagctctgacttttgtcctttttcatgccctttctcctgctctgctttgatcagaatttaagtaagctcagactgttttcttagtgagggaagatttccttctacttgcagaacttaatagggcagtgatagttggtgtgctactgagttgcaatgctaaatgtgttttcccatagaaccattgctcacagaacttggtgttttgtatacttctgttaccttctggatgtttaggctttcatggattggtttagaaatgcagcacatttattattgtttcctgggaagcctatgccaatatatgattttaaaaatactgcaagtggaaatttctggtttctttggagactcagttgtgtcatatgatgttttcatggaaattctacctttcctttccactacctctggtgggtggtaggctagaagggaggctaaaacatttaagtaccattattaaaaataggttttgaaaaatataagcctatacagctgtacatatgaattcaaagtgctctcagctgtatgcataagacttgtacaagttcaagacagaacaaagcccagtgtaaagatgggagttgggcacaaaaagtattggcagttgttttagctttttagagaggcagagttcgttttctctaacaattaatggaccctgataagttaaccacactccagtggaaggcagaatttaatagggcagtgatatccaggagtatttgggaagcacaaatgggttttgataggattttcttttaaaggacatgaagttgggaagggtagggaatctgggaagagatggtagagggaaagtgaatatgatcaaaacatattattttaaaaatctcagaacactagttaaatattaaaagtgccttgtgttccagaaattgttggaggttgcttgctttttgtgagaatagtagatagcccgtctgtgactatccaacgtcagtgtagttatgctgatgggatggctcttctaggaaataagctgataaaaggtttttttaaagtgtctagtctttgaaaatgtttattttatacatatgggtgttttgccagcatgtatatctgtgcaccacctgcccaagttgaccagaagacattagatctcctgggaccgaagttacagaaagttatcagatgccatgtggaactgggaattggactttggtcccctgaaagagtagcctatgctcttaaccactgatttggtcttttaggatgtcagtgaaagttttctgaattagggtacacattttgaaataaaaagcatctttgttccatctcaagttaatgtttgtcattaaagcatatcttatggtggtgttaaaacaaccaagttccagtttgtcatggaaatgctatcttgcttgcactatttcttgttgatgttttgaaacttttcaaaggccctggccatcttggtgttatttactcatttttacttactgataaatgaggatggtgtttgttacctgaaagttttaatataaaggtttattaggctgctgtgatatatgctgtaaatggttgtggtaatgagatgattcagtgagagatttcaaagtgagaaaagcaaagccaaacttactgtgcacttgtttgccataagtgtattgaaccttagcttgctggaaggaaataatccagtaaaagtcaagatgaggctgcaagggttgctccaggccgttcttgtgtgaaaactgaatttcaccttacaccctctgttcattttaagtttaccaaattctctaaattatatacagaatgtgatggctgaaaaacatctctgtgggcaaaattctcaaacaactagatcttttgacacacactagctctgtgttttggggcaaattgcttaatctctgacctgtttcctcagttttgaaatgaggataatgtggtatttacctcacgaggattaaatgggccagaggatatattatatttaaagcatggctagcaatagtcaatgcacaaaagaattgtttttgttactaacattgtcattgttgttaatacttgatcttcctttctattgtgataggagtagctataaaagatgcctttacttacttgatagtaacccttgaagctaaagcttatgaagggggcccaggctagatgtataactgctagatctactcacaactagtcatagttcaggaaacccatagaatattaagatttttttcctatagccccaactctattatgtctagtataaagactgcctatatgagcaaaataggattgagtaactgtagtttctttattaaaaattaatgatattggcatctgtaaagctagagtctgtagaaagggagcctcaatttctataaggtctataaatacattttttaaaaaacttgaagtgcactccactttcccacaggaaaaaaaaaaacttacatggtgttctgcttctcaggccagttcagcatatctgaaattgaatattgatagtactgttaaaaactaactttctctatgacaatgtatcagcaaaaacatgcatgcagaacatcaggtactaaaagattatgaatgtaactttgtagaaaacacagtgggctcctccctctgtgcatgaagagccttgaggaagagctttcttttctggtggaggatgagaatagggtaatgatgagagccatttttttttctggcttgtatttcaaaagactatactgcctaataaagtgactatgactaccaactgtgtatccagagtgcctgccttcacatctctgttccactattgaaatggtactctccttacaaggtttgtggaaggattacgtgtattggtaatggatgaaatacataaaaccgtatcttgctggtttgtaagaaatgttgtatattcatctttgttaagctttactattttagaacgtctagaataccctgctctacttagttgtctactgcctttctctggtgtaccttcaataggattcttctttcccacgtaagagtagttttcttgtcttctttccacagaggagtgggtttagatttctcatttttatttccattcagattgaggtgagtttttatttgtttgggccttttgggtttgatggtataatgttagaaaagtagctagcatttaaagactccttcctgggggcttgctgttagagctccaccttcctgccatctcactgccctgcccgtggctggtttataaagggccagatcacctcagatgtacctcagcacccatctacagcacagtagcactgcatatatccgtttccttccttatctagtagccagagatctcacagcaatatttttaactgttttaggatacacagttaaagggatggatctccctattgcaaacaaacaaaaaattctctttgagtcccaggccagcctagactacagggagcttctatttaacaaacaaacaaaaataacagtatggaccagagagatggctcagtagggaaagcctttgctgtgccagtgtgagggaggacctgacttccaatttcaaacccacataaagctgggtatcaaactagcaagataaactcagtgggtaaaagctcttgctatgcaagcccgaccatctgagtttgatactctggacccatgtaaaggtggaaggaaaaaccaaactatacaaagtgggttttgatacttccaagcatgctgtggcatgcacatacactccccatagtaaacaaaccaataaataaatgctttacaatcttttaaaagtctggtttatagtctcccctcccctccattaggtgattgaggaaacttgcttgtgctcagttgaggtatacatttctcaggttttagtagcttttacaaaaccatttatttatttatttatttattccttcattcatttattgctttggaacaactttagacttaaatttacagaaataaattacccacatactcttctcccaatcctgtcatacttgtaaaaactaagactgtattacccaagttgcaaagtttaatttttattatttcccccccactacaaccctttttctgttccaagatggcatgttgcatttagtcatgaaataggctacttttttttaacatgtatttgtgtgtgtgtgtgtgtgtgtgtgtgtgtatgacacataatggcatttgtgtggggatcagaggacatgtggaactccatactctccttcgatatatgagtctccaggtttgaatacagatcattaggtgtggtagaagtgctcttttttttttttgctttttgtttttttttttaacttcactggaccatttcactgggaccatttttaattttttgcatttatatcattggtatctccattttattagaaaaatattgccataaaagcattctgtgatttattcttcagtttcatgcaggttctgaaaggccaggtgtttcctctatggttggcaaaccagagatttatcttagcactgaactttatgctctgagataaaaggtaagagtcgtgtgagagtgaggagagccttgttggatttgtagttgcgactaagcacttttataatttaaaactatctccacaagattacatgggcaatttgtattgttggtatttgatcattttagcttcagagtgacacaacattcttttaaaattttaagtatgcttatttgttgacatagatataaattgggatgaactggaaatttaacttttaagggaattatgatttagtaagaaactagtataatcatttaaggtcagcaaggtaacacatttgattgattgtttatataagcttttagaaaaccctaggtttcaatcaatgattgatttagttttaaattaaacatttctttagggattccatatgtggagattccactattctgaattttcataaatgctttaaatttgccgtcaaaagtcatcatggtgtaaacagagttatctagtaggctgcacatcacagactttacaaagtcttatctttcctgccacagaaataactttcagctgtaagttatggatggcaaagaaaatagttttgggttggttgggtggaaatgtttcaaataaatatggtgcatattgagagacactcccagtaaaccctcttttatgtagaaatgaacttagaaaattgggaaggatggctataagtcagtaagtaattccaggtgttttatacttactcatatcttttcatgaccttggacaaatcatctaccttcataggagctttgtttctttatttgtaacattaagggatggttgtttctcttagtgctgagattataggaggaatgagaggtgtttccttgaaatatgagcatttaatcactttcttacttcggagacaggctcttacttactccgttcgtacctctggctgtcttgaacttaggtcggtccacttccccctgcttcccagtgctggcattgtagatgagtaacagcatgcccggctcaacacagtcctaacacatctttacaacttgattatgcaaatctcagggagaggctcaataaatatagctaaatgttataattcgaggtttgtgctttcataactttcgtgtacaattccttcaaaaagtgtcatatacaccttgtcccttgtcacttgctcatatgtagttattatgtgctggaaataagctcttgctggttacaagtacattctgccactgtgtgatatgttcttccatttttcacgagtctcttcagaaataaaagtttctcatttttaatatagttattttttctcacagatttcaatttaaaccattttcctaccccatgattttaaagattatccgctcacatctggaagctttgtggctttggtgatcacacgaatatccagtgattacctaaaattgattgttttctgtccttttctccatatggataggcagctgtccctgcacataagtttccatactagtgagaagaattaaatatgtatatgcaccaaggttttgtttctgtgttctctgttccctttgtatcaccttgttctgacagcacactgtgttgtttgttagagcttcattctacgtctccgtattcagtagaacaagttcttccaccttgtcctcaaaacatcttggctgttctcagcccttcacacattcatatgaattttagtatcatgttacatagacagacatgcatatgcatacagtctgtcaatgctttgattatgattgaggattctaaacatttggtggagaagtgacatctttgtttttaacttcgttaacattgaacattactctatttttttctctgtggtatttataatctctagaaacttttattcttatgtatttggtattttcatgttactgtatgtaagtgcttatagactttattttgtttacatttttatgctgaccttatatatgatcattgagttaaacttttattacccttagtacttatctttggaattatttactaggtagttagtcatcttatcagccaataaagaaaattttatttcttcctttcaaaatgttatatatagtttttgtgttactgcatggactaattctctaatactgactagaagtagtattcgtgggaaccggttttgttccatttgtcaaagaaaagtatttaccatttctgtactaattaagatatttgtgtttaattttttcctagctttttttttgagaataatgaagctttggtttattcttaggatctcaccaggtgttcttcctggcaaaataaccatatcattatgttcttcaaatcaaatgtattgattactagtcagtaaatcccaacccagcccggtcaacaaaacagttttcttttacattacgtgggaatttcagaactttgttcatgagtaagattgtcttgaattacacgttttggttttttttttttttttgtattcttgtcaaattttaagagttttatatgctgggccgtggtggtgcacacctttaatcccagcacttgggaggcagaggcaggcggatttctgagtgttcaaggccagcctggtctacagagtgagttccaggacagccagggctacacagagaaaccctgtctcgaaaaaccaaaaaaaaaaaaaagttttataatagggtttttggtgtatgtacatgctaacattcagtagagaagctatttagatacagggttttctttgtgggaaacttcagtcacaaaacctgggaacctgacttggtagaatgttttgagtaataaacattaagccctccattcaatcactagccgaatataaacgtgaatggtacttcatgcctggaatccctcacataggaagtggagtcaggaactgtctagaggtcagggtcattctgactatataatgagtgccaagtcactgagggctacatgtcacaatcctgtttgaaacaaaagaaagagtgaatgaatgaaaattagaaaatatattgttttagtatgtattcttcaggctcgtttctttccactgttttggcagattattttgataagcttttcaacttcatttaaaaatcatttaaaatattattatatgaggtaaacactcatacatctcttaaaaagcaagcatttttacaaattaaatacaatgccagtctgttttaaataccatgtgcatgcctggtacccatgcaggccagaagaggatgttgagtcccctggaactggagttacagatatgccaagtgaatgttggatatcgaaacagtgacccctgcaagaacaacaagtgctctttaaacactgagccagctctccagccctttgcattatatttagaacctcattgggcactcctacaatcctttctcctcctctgccataggtttccctaagttctgcctaatgttcctatcagttgctggatgaagccttcctggtgacagttatgctcctgtctaccagtatagcagaatatcattaggtatcatttcattgactttttttttctggttgtctttggttctatcctaggtgtctgggtcctggccctccagaccaggggtgggctccctctagtggcttgggtctcaagttggactagttatcagttggccactcacaggttttgttccattcttacctcagtacatcttgtaggcaggacagattgtaggtcaaaggttttatgtctgggtcagtgtcctagtccctccactggaaactttgtctggttacagataatggccagttcaggctctatatcccccattactaagagtattcgatagggacctagggtcacccttgtagattctagggagtttccgttgccctaggtatctacctcatcccagaaatgtgttccagttccagctatttctcccagtgctctccccctccactccccgcaacctaatccctcctgttcccatctctacccacctgcagtctacccacaaaatctgttccatttccctttcccccttcccagggagatacatgtgtccacccttgagcccttcttggcacttcacttctttgggtctgtagtttgtagcatgattatactatattttacagctaatatccacttataagtgagtacataccatgtttaactttctgagtctggcttatctcacttaggatgagttttttttttttttttctacttccatatatttgactgagattttcatttttggctttgtatataacattttccccctttatgacctttctggcccagggcttattttggtggggggagggaaattttaatgactgcatagatttccttagtggttataggactattcagatagtttacctgatcttgatttagctttggtaatgggtatctgtctagaaaaatcatccatttcatttcgattttccttttttatttgattttttatttttgtttttgtttttggagacagggtttctctgtatagccctggctgtcctggaactcagcctgcagaccaggctggcctcgaactcagaaatccgcctgcctccccccccccccccccccggctgggattaaaggcgtgcgccaccattttgtggagtacaggcttttgaagtaagacctaatgagtctttgaatttcctcagtacccattgtaatactgggttttagttgggtctcttgacaataccatatatgtgtggcttttttttttgaatctagcctgacaaacaccatctgtgtttgaaatattccatttaaatttaacgtaattgctggaatataagggattaagaaaattgttgctagcttttcctatagctctattttttctcttcctttgcttcttattagttttctttttattctaatatcacgtactcatttctattcctcctgaaattactatagcatttccaatgtatgtctaatgatacttttaccttgctaatatttggaacaaatacactttacacttcagttctgtttattatctatctcctggaatgtatgcagttggtgtcctgtaattctttatacatttgtaactgtgggtactaattgttttgtgacatcagtgttctttaaattttttttcacatgcttatgtacacttcatagctccttcttggctcagttttgtttagccttatgacttagtttggattgcctggctgtgttttctatttttatttatgaatgttttttattttcattcttaaagagtattatatgaatatatggggtatgagtgtgtgcatatgtgtgcgtgcatgcaatcttgacaacttttagttctttccttttactgtggacctcaggaatcaaactaaactcaggttgtcagtcttgtgctgcaaacacttttacccagttgagccatttcacttgggccctaaaatttcatgtttttaaaaattttattcttgggtactatatatacaaccactgaaattcattatttgtatttttaatttgatacatgggtaccgtgtttccagtccctaagatttcattcttgagcgacatttttccgagtgggattgtaatctgctgcttattgtctgtttttatggtttcccaccccctttttttcaagagtgaagccttcagcctaccatttgtttctttgaaagcagcctcttcctcgtaaggatgctcttaaaatttctttccattgtgggttttcaaccagtaatttattgaaatttttaagtatgaggtttgacatctttcatcatttttggaatcttttcaatcatacacataatgctgcttcatttttttccttattccttggatttcaatgacctgtggactattagaacatccaacgctatgctagtcatattgcctaccccttctctttgttctgaaacccttccccaagtctttgagtttacatttgtgataatatccatcacccattaaatggtctttcattaattaatttaaattcttgcagttttagtaacagttgcttttcatttaaaaatctataatcatttggtgcatgtcattatttgtgacaaccaagctccatccacagtcgatgcagtcgatacccccaagattatattccataacaacgccatagacttgttaccttgcacattatgatgtctgcacagtgatttatttcttaaaatctctccttgttaggtgtaacataatggctatactttgctactttttatggttctcaggtttggtgctgagatattaaacatagcaagcataattcaaaacttgtaacctgataaagctctaataactgtagcccctatgaatctattttggatgattttgttattgccgtggtgatgctgatgatagtggttgtggttgttatggtttgctcatatcctctggtagttttctttcattttattctggacattgtatttgaaaagcaattttagaaatcatttgagggctggagagatggctcagtggttaagaacactgactgctcttccaaaggtcctgagttcaaatcccaacaaccacatggtggctcacaaccattcataatgagatttgacaccctcttctggtgtgtctgaagacagctgcagtgtacttacataaaatagtgaatgaatctttggggctgagcaagcgggactggagtgagcagaggtcctgagttcaattcccagcaaccacatggtgcctcacaaccatctgtacagctatagtgtgctcatatacataaaaataaataaataaaccttttttaaaaaagaatttaaaaaaagaaatcatttgaaaccaaaggtgattcatttcagaaatatgtgtgtgtgtgtgtgtatacgtgtgtgtatacgtacacacacacacacacacacacacacacacacacacacatatacagacatgcatactggtgaggttgcagggagaatttgcttttgccagtccaggtattgcttaataaaatttcaggtagggcttttgttgcttcttttggtggtagtggtagtattaggaattgaacctaaggactatacatgctaggcaagcattttaatgctcagtcagttagatgactcaagaccacattatattcagtgattgattactgagttacatttatttctaaaatgctggttctaagctgaaggtgggaaaagagtactcacaacccttgtggatgtggcctgtcaggtaaactttaaatttcctactttcctagatctcaaagtactttcctgatagatctttgaccctttaagaaaaagactttttaaaatgtcctgtcaaactctgttacttgtctgtggtgggagggttgatttaaattactcagcatcctatagataaaaaggcttttgatatatatgagtcttcattgacagaatttccttatgaatgtcagttgactcttttcttggagacttaggctattttatagttgtatataagctttgttttagatagttgtacatacatgtgtaattatgtaatttttactcaaagtttaccatattctgtgtatatataaatgtgagtaagttctttcctgaccattcagcaagagttttgagtccttttaactctagcaattcctagtccttggcaatagataagtttattgtattaatgttgtagctaaatgcagtgtctgaaatgattatctttggaatgtgaaattcttctggattgctgttgaaattggagtgcgtaatagcaactaatttttattacttttatggagactagtatcctagtttcccattgcccatgacttgttagtgtacctatatgtaggaattatagacatctgttggtaaaaacaaaacacaggagtcttagatttgctactatttcagcacttaagagagtgaataagtatgacacatccagtgaataaatatatcataactctttttcttttatgtatattaattcctgcagtagcctttgaagtgagtatctagttacatgtgattttaatcaaataacttgtctgtggcccaatgcctggaaaatgaatattttttatcagtacacattttatttcaagtcttatggtctagagatgcacaccgacttttcagttttatctctttatgcttttccccatgtaaaccctcatactaagaccccatgactcatgtcctaaggttagagatagttaagagatgagcctttgctatcctattgttactgaccttccactaccctatttctagagcattattttcctggctctgagatttactgagctgtgtgccctgttagaaagcttgctgggttattcttccctcccgtccctgtcccagcacacattactcctttcccttgtctagttctaaagaagttgtttctctgcttcccattatatttttcacctttacagttaaactcagacttccctcctttctgtcttcaagaatgtcttctgtaaaccttccttgtttgcttctttagccaatcttgatggaatcatagccaaaatcctgtttgttctatccttctgaatgttaacagccaaaagctgagctgtttcaggcctgtcctagccataatcagcacttgtgtatgtgtggacttgcactgggaagtatccctcacatctcattttcactctgtgtgctgtggtccccttggaaaactagcagattacccctgcaaacattggtgcttttattcagttgtaatatatccaactgcatgacagtcagttctaagtcctgcacttctaagatatgaatatgctgtctcctctaattttgtattaatgtgttttttcatgaatttttttttcatttataactgtttaaggattcttttggggagaatgcaaattaagtagtggtctcccatgttttactcacaaaaattacttacacttttaaaagtgttgaaggaactcttgacttgtaccaaatccctttgaatatactatactggtttgttcccctttttttcttttaattatccatactttttgtggtctgctttggggttattttccttcaataaacttacttttctgaatccatttctcccttgtataaccttcattctgagcatacaaagtgtgcatacttcactagctcaagacaataagggtatggagtttatgctgtgtgcttcatcacttactgcaactctgtttgagaattccatgcagaaatacacttagtttcatcattcccacccctccctctgccctttcaactcctccatcaatttcttgacctcttttacaattattgctgtgctttggggctgaccacctaggattgggggctcattcttaaatctcattctgcttccttcagcagccattgactgcctggagcagcagttcatcttggggtgcgtttgcagattttacacaggcaaccatattgttggaagtttgtaggtaccactccatccctgccctgtccaaaagacacttatcttgtagcagagtcatcctgggtccccaagctcttagagtttctttctctctctcttcttcagtattccctgagctgtaggtgtagatgtgctaaaggtatttcacttggggctgggtaccaatttttgccagattttggatcactaacatagcctctgcctactaaattcaaaaaagctttaatgagagctgttcttatctaggaaagaggataagtgtttagaaggcagttgaaaactagagaacctaagtagtagtaggttctcctctagggcctgggaactctgtgcttgacagtcccatacttgagtttcttcccattgagtaggtttgggatacagttagacagttgttgattactccgaagagacaaaggactcccttcatttctaataaatatataaaggtactagcttgttttttttttctgcttttagcttttttctatattctgaacgagaaaataatcctttttcttccaacattactcttttctttactgattgagtcaaggtctttctatgtggcccaggctggtctcgaacgtgattttatcccttctataacctcccacgtacttgaattgtaagtgtgaaccacaacacgcaattaaaatcattatctttcaggtattacttgaaatatgttacttttttcttgactatagtgattcttagttgatttcatttaactttatgaacatttccaaatgtatataaataaaaagttcagcacacttctaattgctgtagctgacaacatactgccgaatttgttttctccattttttttcttttttctacaaaaactgaaagcataaataagatgtcattgcactccaaagtgaatgtgcctcatactacattttcttatctaaatgcgatggcattatcatacaacctactaataccctagcagcaaaggcaacatttggttcatctgaaagtttccgcggttaagcctcttcacgatttgcttgagatctctatcagctctcttatcccatcctggtgaaaggttcgtctgttatttatccttcgtatttcaaatggactagaaattatctatctgcttaatttggttcagcttatatctttggatgtgtggcaagaacacttgctgtcatttcgtgttgcgtcatacctgagagcacataataaatcatttggtcacttctgtcattattaggtatttttttcctctgggggacatccttattctgcttcacaggtgctagttgcttaacccaaaatctcttgtcagctgtgtattgttaagaaacaatcctagtttagagatcgaaagagtctgctttcctgtttaacactttgtattgtttcactgaagtttatgataaagtaatcttcttccttctgaaagaagttaaaagtcatccccagaatggtagattagtgactttgtgggttacacaggagtatctagtctcctagctctgggtgagttagcctatttgttgagattgaatggcagaaaaaccaaaccagaaagaagactttatacctacttcctgctgctgccttgtagttagggtatggtgctcactggagctgtgggaatgcacaaagtcttgtaggttactggaaactaaatcaggctcactatggagtcatttaaattttaaagacccagggccttaaaagagccccagcacagttttgtaatcaaatgcattaaattttaatgactactttatcttgggaagctgcagggaccccctgatggtttactcttcttgctaggtttttctgaagccaaaagctcagcaaagcattgtgcctttgcaatttggacctgtgccttaggccctagaggtgactgatgggaacagcctatctcaggcagccaagggagcggttttcttctgtgttgattaaatgtaaacttaattcaatgaaatgtagtcaaatgaccatttacattttcatgacctttcatttcattgtacatggttatcatttattcatgatcccttttaagcctttcactgtttttaatcttacctctttggtcattcttttttctataggacagtggtgccagcattttcttcaagttattcaccctgaattatagtgtgtctaactttgcaatgtgtcttagctgaagtattagcaattgagacgttgacggtaagacatttctataactttgttgagagtgcactggtctttatagctcttaccatgtttcttttttacactgatccccataagtaatccttccccgttatgcatttaaaggataaataagctaggtgatgtgtgcctatagttccagctacttgagatactcagtatcctttgaatgtacaagatgagacagcacatcaaaactaagccaaaccaagcaacctgcagagcaaggataacaaaagaaaaagaagaccatgtgatttattttatttaaattcggcccttataccctaagcagctgttactgcctgtttaacagaaatttaagttctttggataattcatttagtgttagatactaatctggcccatggctcagatctctattggttggagctattagaatattgaagtcctaccccaaacattaactttatctaatttatctctccatatatacatatatatgtgtgtgtgtgtgtatgtgtctgtatatatatatgtatatatatatatatatatatacacacaaatatacatacatacattcatacacacacacacatatatattctggattctcacattcttgttctataacaaaattgaacaaacagtaatgccaatatccttaacaaacaagggtatcaatttttagctggatggtagccttaattctggcttcgaacctggtagatctgaatcaattgattatataatgctatcagctttgattattgcatatcttatctttttacctttaagaatttccctgcccttttaaatgcatttctcattataactgtatgtgtgtgtgtttgtgtgtgtgtgtgtgtatgaatgtattatctcttgcaaattaaacactgaagcctatttaatacatactgtcttttttagccagttttttttttctttttttttccatttattattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgagtgttttgttccctcttctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgatgccctccaggtccatccatttgtttagccagttttaaacccttcttcccttcagttatttttagtaaaccaggagataggattgggcttgggctcaggaactctctctcagcttcagtattatgatattgaggtagatggtcccttgacatcaggggttgtcctgtatactgtgggatgttcaggagcacgcctggcctctgcctgacagattccagtacactcctcgttatgacaactaaaggtagctctagatatcaaatgtctctataatgaaagtcttttagatacatgtgtgcacatgtaaatgtctgaatgccatggagtacatacagaggccagaaaacaagtttcaggaatcagttgtctcctgtgggtaccaggcttgtgtgagaagagcttcttttaactactgagacatctcagcagccttccaaatggcttttgcagggagaccagctggtatatatgatgtggtagagccttttagctttatgattatgttctttttatttaaaagagagcagggcctactctttgtaggtgcagcttcaatgccatttcttccatgaagttttctgcggctctccttttctttgtcttaccacaagcaacattttctcatttatatcttccggtgtgttgtttttaatttgagggtatgggctttctttattttcaatttcagtttttcttgaatgaacaactatttgggaatatcagattagaaactgttaaatgaatggttttaaatactctttttgttgacttttcaaatccatctactagaagaacccctcagaacttgaatttctggattaagaagaccaatataggtcatctaaatcatttgtcgatgtagtctaagatagaaacctctttatgtatatgtgaaatagctatataggaatacttggaggctatatttgaaagacacagaaattaatagcttaagctgtttgagttttcatatagacattttatcacgtttatattgtgtgcatgtgtgccaaagcatgcatgtggaaggtgagagtacaacttgcagaagtttgttttcttattttgccatgtgggtcctagggattgaacatgggttgccaggcttgatgccaagcacttttgattgctgagccaatctcacaggtccaaagacttttttcttaaatcaaatagaaagcttctaggttattaaaaaaagtaaacagggatagcagtaaatattttatttaagtaacctagaatatttaccacactttaagccaggtatcaactcctccaacaataagaaacacattttaattatatcttatatatatacacacatactagaaaccagtttttcacttagtatttttctgtatacattgaacttcgttatttttcagttatctttgttttatcttaaagaatagccattgcctagtacatttgtctaatacaggaattggtcacgaccctaggatttgaaaagcactagtaataaatatcgagattatctgcctctagagtatgtcactaataggttgtgttgtcattcttttgaaataatgtcatttaggaattgagccaacaaagacattaggataccttaaccagagcattttaaatttccaactactttgaattcctatatcttgacatttctactaagtatttataaattctactaagtatgtataaattattgtacccaaaagagcttttctttatttgtattcaagaattatattaataaaacttaggagagaataaaaacttaacagatatattatgtgaggttcagaaagtggtatcaaacactccatgcttttataggcatgtaaagggggagaaaactgtatttatagaagttcctggtagatgaggactggattttgtgttatatcagaggttattgcacgtggtagaaatagcaataagttggatgatgaatacttgtacctgatacttaaagatcatttttattcaagataaagtgagaggttttaaaattagatattaaagttctggcagtgtaaatgagatacagtactttagttctgtgtttatgaactgcagtgtattcaggagattaatcagaaacttgtgtgtatgatagctatgatagaccctgacactctaacatgaggatgttaaccttgggttactaggtttactgagagtgcagataatgtctaaactacagaaagtagtcaccatcaaaatacgtgaatacagttatgctcaatataaacccttctttgtagaacaaaaacatgcaatagcattttcaaaataaatattttacttacacaattaaaaactatttgtatatcataggcccaggtgtaatcctttcttgtctaaatagaatgagagctcaggatgttaagttacagccaggcgccacaaagcctcaaagtaagcatagactatggctttgtctttttaaactgcagcttcttctatggaacaacgtagaatttaattactgtagaaaaaaaattatctaaaaagataagtcagcttgtgatgatacttggcaaagagccacatgccctagtcaagtattatgtctgccagtcttctaagtcaccagaagtctcatagatgtcatacattttcagttgagaaaagagcaaaagggtatctttaaattttctcggattcctagacaactgaaaagaaggtcatttcagagctggagatgtgagtaaaaatctcctgttcccaggacacatagaccatattgagatacattttttcctccaattttaaatagacttgaattttttaaatttttcattggatattttatttatttacacttcaaatgttaccccttttcctggattcccctctgcaaccccctagcccatccccccttaccctgcttctatgaaggtgcttgcccactgcccgcccactcccactcaccgcattccctacactggggcattgagccttcacaggaggatcttcttcctcccgttgatgacagacaaggctatcctctgtagactttcatacttaagaacagatttagttcgcagaagaattgagaatatagtacagagtttccaataccttgtactcagcttctgctcttattaatagcatatattagcatggtgtttttgttataacatgtacctgtagtttgcactttattcacttttccttgggttttaaccaggtctggtttttttccttgtgttttaagcttccatacaggaaaatatgtaacttttggttgttatgtctcctttttcagagtcttctttttccttttgaggccatgacaattttgaggtgaacatggcgatcgggttctttgtagagcattcctcagatgtgttgctcgtagctgggctggggttatggatggttttagaggaaggctataaacaaagtaccgtttgatgctcttttcaaatatccagagtgctgtcaatatggcttatcattgctcatattgaccttgattcacctgggagaggaagtgtttgccatgtttctcttctataaggccaaccttttgtcttcatcttgttctgtatttttgggagatgtatctccccctccccaattattttagcatttccttttaccagtgtgggcttatttagtttatactctggttcataatctaacactactttattttgatgtcctggttctttcagttttctcctgtgttactttgatatgaccctatcattatgggtcgtcttttttttgaatacttctttactttctggcactacaagatgcttcaagctgagcaggtgagttgactcagtggttaagagcatggacctctcttccagaggtcctgagttcaattcccagcaaccacatggtggcttacaaccatctgtaatgggatctgatgcccttttctgctatgtctgaagatagctacagtgtactaatatacataaaacaaataaataaatcttttttttttttaaaaagatgcctcaagcccatcatgtataatccttgacctagttctagaatcatccattcctctatagggctgtgattcattctgttagagaatactactagaaacttagcttgtttctagatgttctagatgtggtcattccatctagatacatgactttccaccttcgtagtactgagaccctttaaagcagttctttgggttttattgaccccctccaaccataaaattattttgttactgcttcataactgtaactttgctattgttatgaatcataacgtatatatctgtgttttctaatagatttgaaagggctgttggacacccaaaggagtgcaagcaaccctctggttgagaactcctgttctagattctcctggctaggattttgtggatatattttaccatacacacacactgaagcttatgttccaatatttcagcatataggttatagataacaaatacataatctctttgaaatgttttagaattaaatttaacatggatatgcttttatttgtttctagggttatatttaacttgaaatgtttttcttgatcatttaaatggaaatgctatttgggttttatttcttttgagaatataataaaatatgggctatatgccagaaatctgtgactatttgaaattagtttttactataatgaaaatcctataggatgcttatttcagaaattatcagaggatccttttaggagaaacaagtgatcattttctttatctgtttttacatatgtgtgcaaaaagtcctgaaattggaaatatgtctttgaaagatctgctttttaaaaattcctccaatagtgtacacttcctgtttccatttagtatgaaaagttcagtctagtgcaagtattcctgtttaaacaaaatttattttaaatttccctttaagagttaaggcatcatcagaatcttgccagctagcagaacaggaaaccactggctaagagcatagacttctatttacatcctttgtgacttgttaacactatgcatttgcctttgtgcctcaattttcaaaagaccttaaaagtcctctcacaacaaagcatattttcctttaaacctaggaaatgcttgcctcaccagtcaatatcgtcagccagggtattctccagtggtcttttactgctactgagatttgttcatgggataggccactgtgctgaatagctctcctatcccaagacagtcttgatataatgaattactgatcctcagattataatataccattagacatgctaaactgattctgtctttataacacatttcagttaccacaactccagaaggtatgcaaataaatgaaccaaagacagaactcttttatttgtggcttctagtgggtagaattggagtggattaaagtggcttcaggcagttatttcctatagttgccagatagtctaactttgaaaagtttaatgttgaccttcttgtatgagttatcctattttaaaatgtaatttacccttaaaaatcattgtcaagaccaaatcaaggatatctataagctagatttggcctctcagaccattggtttgcaacctctagtgtaattattttaggtagtgaactaacgttttagcagaggtagaacactgagccataatggtataatcttgtatctttgctgagcttacaaaagcctgtagaaaccaaacacttaggtatcaatgccattttctagactgtagggaattgtggttcgacagagccttcggggcgctttttcagaacagaagtcactgtaggtgtgggcaaggccagtcctcctgattagggagatggctatgcaaccagagaacctttctatgatgccactgctaggcatagtttctgtcctcctaatcttccatcaaaaattaggagtcccagtcacatgtagcatatatcaataattccagcacttgggatgtttcgacagagagaccattgttagtcatagtccagtttattagtcatagtctagtttaggctaaaatgagaacccctgtctttaaaataaacagggctagagaaatggctcagtggatgaagcacttgcctcagcatgtggtgactgatgtttggatatctagaaccaacgacataaaagctgcttgtaatctcagcactgaggagactagacagaatttccgaggcaagctagatagctagactacctggaatgggtaagttatgggttcggcaagaaatcatgttaatcaaaaaggaagcacaatcaaggaagacgtgtgacatcagctccaagcctccatacatgtgtacatacacatagcacactcatttaggagtttacaaaacccaacaagaaataaaggctcaacaaccttagaaagtcttctggtccatgtgatcctatctgttggattaactttttagtgaacaaaatggaaattattttaaacattatatagtattcaagaaagtattatatttgagtgttttatgccactatgaaacactaaacagtaccattttggtacttatgtaagggaatgcctaaggcagaatagcaagcattattaagagtacatgagcttgctgaccagagtcatatctgtgagtatagcagaaccttgttagttgtttaattgctgtgtttctttagcagaacagtagtacttggttttccctaatcccatgttctgtctagtgtcaggtccttggttgtattgtactgtcaggcatgcgttccatctcatggccttgaatttaatcacgtagtggttggtgactcccttgtcttttgtgctgttactgtgccagcatattatgcagacagctaaccattgtagagcaaagggttcatagctgttttgatgtttacctgtctgcttgggtaacatgcagagtaccttctagtaccatgaacactagtcagtaggagtgaaggctctagataggtaccagctcaacttctctgtcgtattcagtgagttatataactgttgtcgtcagcaatagggctttactgttggtttgtggagagcaaccaataatagccttggcaattgcctgcgttattttggggttggggcgtctgtgaggccctggaggcagaaagagtgtaaaagtcagtggggatggaaaacaccaaggaaacaagccttctagatacaggaagactggtgcacataggaactcacagagactgtggcagcatacaaagtttcaagctaatggggtccacagccctgaaagaggaagtggatgcagtctccccccatccttagccagaagttatctttacctgacaaccactcacaaaagaaaagtaagttttctccagcagagtctcaccaattatagaaaccacatttaaatacagacaggatctgtccagcagtagatggccaacacaactgagtgatgtgcttggcatgcttttggttttgttggttgttattgctgttgttttgggtggtggcacacacctttaagcttagcagaggcaaagataggtaaatctctgtgggttaaaggccagcctggtctacagagcacatttttttttctaataatgctttttctgggtatatttcctttaaccttgcaggcctcttacttccatattacggtttctggttttgtgttcttattgctatatgtgcaagtgtgtgtacatctgtatgtttctcgtcccttttctttggctctttttttcttgcttttttttttcaagttacctattcgtgttctaatgagaatattaaaggattatagattttgctggatggggagggggaaaggaattgggggatgggaaactttgatcagaatagagtgtatgaaaaatctgtttttaatagaatagtgaataaaatataagcactggaaaaaaaaaaagacatgaagaatcccagtacaaaagggcatcttctctagcgctgcagttcatataacctgtaaaatcaactaattactttgttcaagaattctttctttgcttccagcgttctacctccccacatgcccagaactccctgtttggatgagtaaccaatgaaagttcactctcatttttgtcccagccatagagagacagaaagtcatctctgagtatgtacactggaattgtaaaagatatctaccagggacagtgtgtaaaacagactttgtagaatgcagattttagatttgagttaggattttaccctaagtatattctctgaattcattttgttatttgcaaagtggaggtaattatagttacccttgagggcatagttgtttagtaaatgagatctaataatagtgataaattgaatggaaagtttgtgctgacagagcactctaactctgaacatgcatggagcctgtgctgtggcacttgaaaccaattctcgtcttctttctcataataagaaaactgtgcggactttgcattgtgagaacgtctaagtagggtcaggaaattatttaaaagtggtctttttgagctattatgaaatcttaaacaattggatgcttaagaagttcttcattaaaatttcagttaaatattcatgacttgttttggatatggcagtccctcaatggttagaaagttgttcctatttctgtaaatacaaatttgattaaactcattaaatttgttccattcctcttaatttcacttataatctcctaaacacctagtctctgctaggctttgtacctagtcaatagtaaacattgaaaagttttacaggttgaatctctttaaccccaaatgcttaggaccagaaaattttctggattctagtttttcttcatttttgtattgtttgcacagaatttatgttctgctttaataatctcaattggaaaatctgaaacttgaaaagttttaatgcctgaaactgatgattttgttgctgctaaaaaagtttcagtatattcacacaatcacaacacacagtatgtatatatattttctgagagtaggttgcatgtcctttactgccaagaagttttacggtacaatttataaacctaagtatttttttgtgcaaccacagtagagttattggtgtaaaatgtttctcttttcaaccaataagcttaaggagatacttggaagatgatatagatatagatatagatcccacttttctctcaaattttccctgaaattagcattcattagtgatacatcaatcaatcctatgatggacgaaagtgttcccagctctaacattagcctgtatgtttaccatttggattctcctgtgagtatatgtgtgtgtatttagcttttcatcatctgtgtgaatttcaggtgcttcatttctataggcctataattcatttgtgtccctcctcccatctttcccttctaatcagagagactagagccccattccctggcatccccccactctggcacatcaagtctctgcaagtctaggcagttcttctccaactgaagccaaacaagacagccagagttagtggaatggattcacagacaggcaacggcttttgagatagctccccattctagttgttcaggacctacatgaagaccaagctacacatctgctacatacatgcatgggaggcctaggtccagcccgtgtatgctctttggttggtgtttcagtctcagccccaagggtccaggctagttgactcttggctttcctagggagatcctttccccttcagagccctcagtctatcccctaactcttccataagagtacccaagctccatccactgtttggttgtgagtctttgtataagcctgagtgagctcctctgtggagcctctcacaggacagccatgctagatttatgtctgcaagcataacagagtattgttaatagtgtcagggattggtgcttgaccatgagatgggtctctagttggaccattccctcagtctctgctccatctcccctctttccatttcttgtaggctgaataaattttggatcgaaagttgtgggtaggttggtgtctctgtagctccactggggttcctgcatggctacaagaggtggcctctttaggttccatatctccacttggtctcagctaatgtcaccctcattgattcttaggagccttccatatcccaggattctttgcatgtccttgagacgcttcccaccccccaccccctccaggctgtagatttccattcattctcatggccatctggccatctcccctgtctctccccacatctgatcctgaaacctccccatcccctctcccacccacttttctccctccatctgcctcctatgactattttgttcccccttctcagtgagattcaaactattttgtcctaatggcaatgtcctttgcctggtcctcggtgttctgttcaggaatttgtctcctgtattaaagaattcaaagctattctcactttctgttctattagatttagtgtatcggattttattttgaggtctttagtccacttggacttgagttttgcgcagggtgatagatacagatctatttgcattcttctgcatgcaaacatccagttagaccagcaccatttgaagatgctttctttgtttacattgtatggttttgcctttgtcaaaaatcaagtgttcatgaatatgtgagttcatgtcagggtctttgattaaattacattgatccacccctctgtttctgtaccaatactatgcagtgtttattactattgctctgtagtatagcttgagttgagggatggtgattcctcccaaagatctggattgttttagctatcctgggtttttgtttttccatatgaagttgagaattgctttgtcaaggtctataaaacattttgttggatttttctttttaatggaaattgtattgaatgtgtagattgcttttggtaaaagggccatttttactatgttaatcctgccaatccatgaacatgggagatctttccatcttctgagatcttcctcagtttctttcttcagcagcttgaagttcttgtcatataggtctttcacttgtttggttagagttacaccaagacattttatatagtatttgtggctattgggaatggtattgtttccataatttctttctcaaagaaccagctcttgggtttgttaattctatgtattgttttctttgtttctaattgattgtttttaggcctgattttgattatttcctgccttttacccctcttcagtttgcttactttttttgtaaattgctggtatgagtactttctaatttctttatggggcatttagtgctttgacctttcctcttagtactactttcattgtgtcatataatttggggtatgttgtgccttttattttcattgaattatagacagtttctttctttcttccctgacacacagatcattcattgagtagagaattgttcagtttccttgagtgtgtaggctttctggtgtttctgttcttgttgaagtctggctttaatctctggtagtctgataagatacaaggccaaggtgttatttaaattttcttgtatttgttgaagcttgctttgtgacagactatcttgtcagtattggagaaggctccctgaggtgcagaggaagggatattcttttgtgttttggtgggaatattcttctttggttttttgagacagggtttctctgtatagccctggctgtcctggaactcactttgtagatcagtctggcctcgaactcagaaatccgcctgcctctgcctcctgagtgctgggattaaaggcatgcgccaccataccctgtttggtgggaatattatgtagatatctgttaggtccatcaattcagaatatctcttaatttcattatttctccattcagtttttgtctggatgacctatcagttggtaagagtgggatgttgaagacacctagtattaatgtgtgggatttgatgtatgctttaagctttagcaatgtttttctttcccttataaatatgggtgcatttgtgtttggggcatagattgtcataattgagatattatcttaatagtttttttgatgagtatgaactgtctttccctttctcttttgattgatgttggttgaaagtctattttcttacatattaaaatgagtattgcagcttgctttttgggcccatttgcttgggaaacttttttccagccctttactctgaggtagtgtctgtctttcttgcttatgtgtgtttcttctatgtagtggaatgctggatcctgtttgcttatccagcctgttaccctgtatctttgtattggggaattgaggccattgatgttgagaggtattaaagaccagtgattttaacttcctgccatttttatgttgttgttgtttgtatgtatgtgcgtgcatgtgtgtgtgtgtgtgtgtgtgtgtgtgtgtgtgtgtgtgtatgtgtgtgtgtgcttgtttccttgttttcgctggtatggatttacttatgtattttcttgaatgtagttatcttccttaggttgatgttttccttctagtactttctcttgggctgaatttaagaatagatattgtttaactttgatgttgtcttgaaatacctaattttctccacctatggtgactgagagttcttctgggtatcgtagtctaggttggcatatgtgcttatctagaggttgcaaggtacacccttctagataggagatcctttgttgagaagtcaggtgaaattctgattaggtaggcctttatatgttaactggcctttttcccttattttctttaatattgtttattagttctatagattttgtgttttgattattatgtggtgagaggatttactttttctggttcaatctaactggtgttctataagcttgttaaatgtgtataagtgtttccttagttttgagaagttttcttttattttgttgaaaatattttttgggccttggaggtgggagtcttcaccttcttttattcctgttattcttagggtacgtcttttcataatgtcccagatttccaatatgttttgtatcaggaactttttagatttaacattttctttgactgatgtctttaatcatatcttctacacttgagattcttgcttccatctcctgtattctgttggcagtgcttgcatctgttgtccctgtcctcttccctaggttttctatctccagggttacctcagtttgtgtggtttgttttgttttttttttttattgcttctattttcattttcaggtctttgaacagttttattatttccttcgcctgcttaattatattttcctgtattattttgatcagtttatttgttttctctttaattaaaggcttttacttgtttgattgtattttcctgtatttcttaaagggatttattcatttcttcttaaaggactctatcatctttataagattggttttaaggtcattttcttgtagctttggttgtgttgagatatccagggtttgctgtagtagggtagctgtactctgaaggtatcatattgccttttgttgattgtaggctcaactggatggctttggtccctggatgttctgttgtagtaggtattggaaggggcctaagctcgatgatcctggtgtggcagacctctgatgtgtatgcttgggctgtgaggttcctgatcagcagttctgatgatggtggcctgacacgtgtcaggagaatggggattcagtggagatggcaagctgctcaggggagctagggtgtcccagaggactcagtaggccgggaaagtggatgtggatggaatccaacgtgtatttttgcagatcatcaggtctgatgaagatgggtggagaggtggtgggatgctgtgttattatctttttaaaaatactaatattgttggctattttacatcaaaagaaataaactgaatgtatctgttttctaacattggttccaggtataattatttcattttcttgattttaataattgatggtgtcttaagtaaaatatggaattagacttaactaaacttttatttattttagaagaaaatgacagagtgtttggaagattattacttttggaagtcctgctaatatccatttcctaagagatagttgaccaacattgactctggcatggcgcaaaacagtccacagcttgatattcaggttctccatgatcttcgacaacgttttcctgaaattccagagggtgtggtatcccagtgcatgttacaggtacgtttcctgaaagtgatgttagagttggcatgttagagtacttgttagagtactacatgtgctagtgcatgttttataggatttctcagacttagtggtggtgttgatattgtggggcaggtaactctgactgtaagctctttctcatctttcctgagccctacccactgtataacagtagggtttttacagttttgacgatggaaaatgtctttctgaattgctaaatattccacaaaaggtacaatctcacccacttaaaatcctcctaaattgggaagaataatcacatgtagaaagaaaaattccccagcaagaagaagtagtggggaaaggtgtttgctgccaagtctgatggtatgagtttgagctctgaaaaccacatgataaaaaaagaacctatccccacaaattcctctgacctccacatgcacactccactctccaaggaggaaatcatttttaaacaggttgccaataatccttgaatccttagagttcaacttttctttgatttgctcctaggttgtatgtattctgaggaagctctctacctcagaactatgcccctattccccagagatgcattttaaatcccaaatgtaaccttaaattctgtagaaaaactccttactccctcttttcagtttttagttcataagtccttactaggtataaatttgagacaactttcttttgttcagaaacattccctttgtcttgttctcaacactgaaatcttttatttcttagttttggactgtatttttactcaggagacaacagataaaacaaccattactgatgagtcagttaccttggcatggtatctctgctttagattgtgacatatccctgtttggttgacatggggagcaagcagtacatgatacacagtctgtattcatgttcacagtcccttactacagtgtgagaagctgaagatgcagcagaactctgtagacagggatggttaattacaagtagagaccagacaacccaagcaaggatttccattgtttacaaattctttactaaatgtaggcctttgggcccaaggttattgtgctatatgtggttgctaacatctgcgcactcctaatctcagctctttaggtccacttatgtttatgggttaagaaaaagctacttcctaggacaggaaaacgaagccagagttgaatcttctagttggaaccgttttctagaattgactttctttacttgtcttaggaccccttttagctccaacatggttgtaacttaaatttggcctttccttatttgtgctatcgtggcctttaactaagggaataaaatgtaaaattcagctcagtgaacactgtcctaaatcttttcctcctcctccttttttttctctttttttttttacttcaatcttttacattaacagaatcttagtgtggacattgatacctactggctccaggaagtacctacattaaccttctatgtgatggtacatgcctgtgatcaggaggctcatgcaggaggagtgctgcaaattgtggttagcttgggctatatatcaagactttgttttaactcctaccatccaaaaagcatttgtatatacagtgatgtacatgagcctagtagtttgcatctgaaacacaggccttaaatcctctggactatcttcccttaatttacatcatttagagaggtatgaaacattgttcctttagttttttttaagaagtgtttatgtctttaaaaagattatgtgtgcatatgcagaggccacaaaaggacattatttgcccgagtctatcacttttcactttattcctttaagtcagggtctctctttaaatctggaactgagctgatagtcagcatgcctcagcaattctcctgtctgcttcttctggcccaggcgttacaagcacagcatagccacacacagcttgctatgcgggtactaggatctcaactcgggttctcatactctcactgagccatatagttcccttcttaaatatttttacctgttactaagccagtcgcccagggatgtaatccccactttttgggagaatgaaacaaaagagttgcaagttagaggacagccaggggaacttaatgagactggttcaaaaatgaagaagatggtgggggctataacttagtggtagaatatgtataaaggtctaggttcagtgtctagttctgcatagaaaattatgacccttgtatccaactaaacaacttggaactctgattactctttgacatttttattctttttttatcaagacatttagcaagtcaagtatgacatttgagtctcctctgtagtgttgtttctataatagttctataacaatactatttccatagtttgtatttgtggtttaaatttgtctgtatagaatttactcatatatttttactttaggcatgcctgtgaatatgttgacagactaactttctattgtttgtattagggtcctttttgtaagattactattaggcttacagatttgttatgtaaagaataaggtttcagggttattcacaaaaataccaaatactaaagtatgttctcccctaattttatacatttattgaagttttgaaatagtttatttttatatatatttttctttccagtatctgttactgccccattctagttatcagtctacctgaattctttggctgcagatttgcttcatttttattttttaaattacttttattttatgtttatgagtatttttgtacatgtgtgtcttataccatgtacatacctggtgcctacggaggccagaggagagccttcagtccttgggactggacttggatagctgtgagctaccatgtaagtgcttggaattgaacctgggtcctctggaagagcagccagtgttttttcctgctgagccatcttcccaggcattccagacttggttttaataggtagcttctcgcccttgctcagcatgattcaagaagagaaaataaattttgcattattaatttatcctaaacttcaattagtacttttttctatagtacttggcacgtactttatttaaggcaaataaagttacctatgtttttcatgaagcaaattctttaaattactagatttaattttgcaaatgtttgcttgactatggggtttttttttttattagcttcctaaatttccagtttagtaatgtctttgataacacatcctttcctttgaagttactgtgtagaaggacactggaacttgagagtaggaactagaattggttacatggttagcttgttcagtgcctcttatgaagtatgccacttagcactcttctttctcagcatctggaaatgggaatgggattgtagatgaactctgaatttgtctcaacactaaacatcacttcattgcgtgtcctgtggtaggcttaatatcttacttgggtcactgcagaagtaaagtatttcccttcatttttagtaaaatgaacttatgtataataacatatgtttcagttacagagaaattcatgtttgttaagaattcgttaatcatttcaaaagtggtgataatatgtgttttactctaatagatgagagttctgtattttagtggaaccttacaatgtttgaaaattttttaaaactaagaatttgattattgtccattgaaacttcagttgcagttactatctgcataactaaaaagctatttcaaatatattaaatcactgttcagctggtacaaacttggcatagtgaatttcattaaggcagtctgaatatggttgcttgtaaattctcattaactctggcaaaatcatgaaggcatgagtcaaactatagaattttgcttgttgctcatttttctttgtttaaatctttgctaatgatatacactaatgttatatgatgataaatttggatgaaagaaaggaaaagagtaacattgtttaaaatcttcaggaatattacttttttcattttgtgattttggtactttttgaaactaaaggatggttattttcattttcatagggttaaacagtaatgatggatgttaccgcaagtgtgaatccaagagtagcacaacattttaaggtgttgagctgcagcaagtgtagaatgagtcctggatttggaatgagaaaacttggggttgagtcacaatgttcattacatttctgtagcagtagtggtagagctagtaatgcgagctaaatgtttatactttggattgtttaacatcccttttgtaggacagatgccaatggtgggctttatggttaaaataccactcttgacttattctgtgacagtatttatgtaactgacttccattcttaagctttgttaattttcccaatgttgtttgtaccatttctcccatagaataacaacaatctagaagcctgttgtcgagccctttcccaggagagcagcaaatacttgtatatggaataccatagtccagaagacaatagaatgaatagaaatcgccttttgcatattaatttgggtattcattctcctagtagctaccacccaggagatggagctcaccttaatggtggtcggacactggtacatagctcaagtgatggacatattgatcctcagcatacagcaggcaaacagctgatatgtttagttcaggaaccacactcagctccagctgttgtggctgctactcccaactataatccgttttttatgaatgagcagaacagaagtgcagctaccccgccttcacagccacctcagcagccatcttccatgcaaacaggaatgaatccatctgctatgcaaggtccttcaccaccaccaccacctccgtcctacatgcacatacctcggtatagtacaaatccaattactgttacagtgtcccaaaaccttccttctggacagactgtgccaagagctttacagattcttccacaaattccaagcaatctctatggatctcctgggtctatttttattagacagacatctcagagttcatcaggaagacagactcctcagaatgctccatggcagtcctcaccacaaggcccagtgcctcattacagccagcgtcctttacctgtttatccacatcaacagaactatcaaccttctcagtattctcccaaacaacagcagattcctcagtcagtttaccattcaccacctccttctcagtgtccttccccctttagctctccacagcatcaagtacaaccaccccagctgggtcacccaagctctcatgtgtttatgccacccagtccttcaactactccaccccacctatatcaacaaggacctcctagttatcagaaaccaggaagtcattcggtagcctatctcccttacacagcatctagcttacccaaaggttccatgaagaagatagaaattacagttgaaccttctcaaagacctgggacagcaataactagaagtccgtcacctatcagtaatcaaccatctccaaggaaccagcattcactgtacacagccaccacaccaccttcaagttccccttcaagagggatctctagtcaaccaaaacctccatttagtgttaatcctgtgtatattacgtatacacagccaactggaccttcatgtgctccatcaccatctcctcgggtgataccaaatccaactacagtttttaaaattactgtaggccgagcaacaactgaaaaccttttaaatttagtggaccaagaagaacgctctgcagcaccagaacctattcagcccatttcagtgataccaggctctgggggagaaaagggaaaccacaagtatcaaaggagctctagttctggatcagatgactatgcctatacccaaggtaaactttacactgatggaattttatatttatagtcgtgtgataaatgattgaaaatagaattgaacatatttactttcaattaaatgctttatatagtaagtgatgactggtaatgttaccaagagtaaaattattgtttcagagtcatctgttcactcttttaaaatataaagctgcaaatatgatcattgaaatcttgtaacctaataagactttattcacagatatcattcattggcaaaaaatatagacaagtataataagtattgtgaaaaggatacatgtactttggactggtttgtcaaagaatttgagtctttataatgttatatataagtgatattataggaagtagaattaatgaaataatttgtattgtctaggtaaatcaaagtttacaaagtctattcaaattttttcaaattgtaccagaatatatgagagtttaggatactttcaatatttgagaagggaactgactataattgtgattcagaatgcttaatgttaagccttcatttcttaattttgtgtgtgtgggtgtgtttatgaatatgaatgcaaatgtaagcctgctgtgacacatgtggagtcagaggtaccattctcaggagccagttctctcctatcaaattgtggaatttggagctgcaactcgggcctgcatgctgctgagccatctctgatccttaagcatttaacaagtacagataagcaggctctcaggaaaactaagtggtgcacaacaagagctatgaacagatgatgccattttggctaaattaaagcagaaatggttgtggcccagcattactaagaccttaaggtaaatgctgatgcccaggtcagatgagtcttatgttcattaacagtgcatgtagaattctcctataatttgtttggtggtgttttctgcaatgactttatctgtcatgctgtagccttgctgttacatcagcgagcaagaatggagaggttagcaaagcaattgaaacttgaaaaagaggagctagagcggttgaaagctgaagttaacagtatggagcatgacctgatgcagagacggcttagaagagtcagctgcaccactgcaattcccacggtaagtcagctgttgcaatatatactgataggaagatatggacattctctgttaaagccatttgattttctttcaagttctagtcctggatgaatttttaaaacagtagtgaatgcaagagatttgcccccaacagttcttgtcagagtaactaaattttttttatttacatttgcacttgcacgggattatagctattttcaaagactgacagttagaatatagtgtttattgcaagaatatatgataacaaaaggtttcataaattattcttctaagcatagactgtacttttttctaattgtttaaagtgagtttaaataagttaattactaattttgagaaagtattggtagaatttctgaaggcatggtagtttcattgtgtgtaattgtagaaattaagatgttcagcgtggacccttaatgatcttaaaagaaattactgtggtaaagagtttttatatttttagcctattggttaatgtagttgattctaataatgtcaaataactttgaaaatcattaagtctatctcctttgagatgtcaccttttctgtgatataatcaatcttttcactattcagtgttcatgtattcagtgtttatgaatatgatactgtgttaggtgcttagtacttatctgccagtgaaaagatgtagacttcaatggcagttgctttatttgctcacatgtaatgaaggaaattttccagtaactgctttatgaatgtagtcagtacatatgtcctcttttttacatcatcctggaatgactgccaaagcttcaagtgtgtagatcctgtctgttttcaagggtcttcattgtctttccctctctaaagctggggtgacctggctcttgaacatatatgcaaagcttcttgtcctcacggttactgcagctactttcttggagacttcatcctacattatagaaagaaaggaaaaaggaaggattttttgaagggaaaagaatataaggtaattaaggcttgaattccaggcagtcttttaagacacagtaagtaaagctttcgtacttaggcctgaaatttctaatgagtttatagaggttaatgagcatagagtgccgtgtagaccttgaacactgtgtcaaggtgcgtgagttttatcctgctcttacagggaacaaatagaaccatttgagaagaagactgttgaggaagaggcatattcaagaaattaacgactttttctgctattgcctatgttcctcagtttaggcattgttacaaaggagactttaattacataaagcactgagaacattacaaagtaaaatcaaacagttatgttaatggaattaagtatcctttctgattttctctatttaaaatcttgactgattcctctcagttaggaagttagcaaagggtagttaggcaacttgtaatcatttaggtgtcagtaaggtgtttgtttgtttgtttgtttggtaaggctttgttttgaaacacctggtccattataggtcctgctaaataaaccttagttttaattagaagtaaaaaactctctggtgtggcattaattagtgcttcaaatacaagcacccacagtttatataagagtttttattacggagtcattgttttcttttaaaaagaaaggtaaaccttcctgggactgtagtttatgatttataatttaaaaattaaaaatgaaatagaaaaaatagtttactaaaccaagtgtgatcatccctcacctagagaaattagagtttctttcaatgcctatctttagactgcaatcaaggacagtagggcatggctgagggggtggctactgtggccatgaaggttaagtcagcaagtggctttgcaagcccaaatttggttattgctttcactgcttgtgtcagtcgcatagcctcggatatgtaacatctggacttattttctcatctctaaaatatatatgctagaatatccatggtaagggattttctttagaattacataaggcttgttaagcaatttatacaatatccaacaaatagcaagaatctttataaactagcttggtaacaaaaatgctgaaagtttttgcttgaaatagataacacaaatctgaagcattttataaaaccaattttgttttaagcaataaggtaacatatttacagctaatttggtaaaaacaaaaccaaaataacaaaataaaaccaattaatctagtcagaattttcaggttgttaattgagtctcatttgaaggaatacccatatgggatttggaattggattacctttgctatttactagctgtattgactgcttagttaacagaggtgctagagctgtggtataatattggccacataaggaagcaatgtttgtagtgtgccttgggtgtcattaagtacccagcaaatatacaagaataccaaagagctgacacttttcctaacatgcatgcattgctactttcagatttccaagaaacttcttaccaagttttacatcaaaataggagagaaatgcttgcttaatgagactagagtgtgcattgtatacttgcagaaattttgaggagccatgaaatgatatttttcaaatgatagcaaaagtattttgatagtgtcatttttctttagcttgctctttatcacattttatgaaatatttcctaatatgtcatctctcaaaaaggtataaatatgagaaagaaatgttaatcttttgttaataatattcatagaggaggcagagttttaaagtttaccttgaaagataaaaaagattttagtatggagagagccaccctcccccaagttagttagttatccggatccatcctgttctaattgaatttgggggctactgcactgctttatgtcctacatgtataattggggccaaagcaccaagaaccaacagtgctcttcaatattggtgtttataacactagtttttaaggttccaagttgacttaagggatttctactaccttttcaaaatagcatagaaactattatttgaaaatgtcagctataagtattctattggcctacatataagtctagattataaatcatcatgaataccaatcttctgtgtaaacatggtgtacttttgataaatcaccgactcaaaaacagctactcacctcccccttgcttgaatataacatgtgtcattagtatattcgtgcttggttacaaagtatcactatttgggcccactgtggctacaactttcaattgcaaaatatataggaaggataagtccttaggtactgaactcacaaagtaggggtcacttctgtgtttctaggaggatgaaatcatccatgttgatgctcaagcatgtgttttataccattttaatatcacttggcaagcattttacatattaacatcacatactttgtccataggaatgaagagagaagagcagttcgtactaaatgtttccagatggttcttgttgatccactagcattctgagggcctagagctttttattttctaagttaaaattcagtttgatatttttcttcaaaatatttgagactgaataatgatagttatctataaagtcctgagataaatgggcacaaaacgcatgtaaaattagcagtcttcaaatgctcttaaataagtaggacgtgtaccaataatatccagaaattgctttttacgtgttgaacttttggtcccttcttgtttgtggacattgccatttattctgttagaatctcccaacagcataagacatcctatctgcttttttagtgcccggttaacctggttagtcttcgacagaatacatgttttttaacagaagcaatctttctcaatctctttgtctctatctgcctgtgtgtatctatttgtctctgtctctctctgtatctctgtctttgtctctatccccccctctccttccctccctccctctcccttattccacccctctttctgttagtaggtaatttaacattctactttgtgtagttaaaattaccctagtaattaagcttatacctgggctatgtgggaaacacttcagtatccataccattagagtgtaggcacagaaattctaaagaaattaagaatggtatgggagaattggagagatggctcagtggttaagagcactgactgctcttccagaggtcctgagttcaaatcccagcaaccacatggtgcctcacaaccatctataatgggatctgatgccctcttctggtgtgtctgaagacagctacagtgtactcatatacataaaacaaataataatacttaaaaaaataatggtatggggattacaggctcatcagaaaaagatcttttcagttactgaaaagaccctaaggattggaatggcctggacagactaacgtagaagaaacaaaggagtgtattgatgcctgatatttctctgtgttaaagtgtttcttttgatctagaaaaataagtctataaattgatataaatttgtataagttctgcttctaccacctaggagctttatacccgtaggaaatttaacctctctgatgttttctcatcaggaaatttgtgcaatactccctaccttaaagctccttttagcagaaggagtgagagaattctggtaaacctggtacccaaagctaagtaagcactaacttgtaccaggttagacaagattaaaatcatgaacaatgctaatttcaaaggttggttgttgcactttaccacaaaaacataagtaaggtattttctgtgccctgttattgcagtgaacatagatagatttatgatagaacagagttcactctgtacccggctaccacacgtggttttgttattatgtggccacatcgatgtcttcagtgtacttttgacttcaaaagcatacacagacatgttatataatccatcttatagacaaggctggattagttatcccccatcagatcaattaacatgaaagacagtacttaaatgttgggcttgataatgactttcccacaattgctattttgggtgctttcttactagcctgaggaaatgacaagattgagaagcacgaacagacaactccagataaatgttgactgtacactgaaagaagttgacctccttcaatctagaggtatagacttgattatttggtaaaccataagtcatggtgtggtgttttaacctgcttagatggcaatacttttgggttcatagatttaaggacaggtttttgtataactgttgtaagaatggctttaaagagattcccacacttcatggatcaaagtgtcaaacaatgatgttacttcagcagtttcatcatttttcctcattgttttatattgttacattgcatttttgtcattgaatgtatttcataaattgatgagtattatttctaagacacagtttatattatatgatagtcttcgaaaatactgtgacagaaagggagtccggagtaggatatctgagttcttggttttaaaagaagttctctatgttacagtaaaagctctctttcaggtagccagctcatcaaatgacagaaggacttgctttcccgtatcctgcggctcccattgattacatgtgctgcatatgctagttagctatgcttctgcagttaaaattagtagttcacaactaaaaagaattcaggaggatgcttctcttttaaaaactgtctttggcttttatagagagtcaagcataaaatgatagaacccgtaattagatttgaatgaacacaagtagaaaggggaaagctttgtaagaaagtgtccttagtatatcacatgctgcattcagaagacaccaaaacgcaaaattataaatcaaggttcagcaaactagggccctactgcctgtttttagaaaaaaaaagttttagcggaaacagacatgcacatttatttacctagtgtctgtggcttctttgtgtttcaaggacagagttgaatacttgtaacagattgcattgcaagtctacaaaacctcagtatctgctctttgacagagagtttactgacacttggctttagcttatcatgaacatagtttgtatacggcaatatgaagtatccttgttcagcatcaaaatacaactattgaagatgcagtgtagtgatagaatgtttgcatagcatatataatccctgggcatttcagtcttcaacactttcataagaaaaatagaaaaacgctgctatatttatgttacataaaggtgatgtgtaattttacttaacaatcctttctttgagtccacctactcccaaactgtagtagtcttaattacggcagttaagagagcttctacagtactttaagagtagtatataataacagtgtcaaacaattgaactaaagataataacgatacagaaccatctgaacatgaaagttgagctatcaagccaggttctcattttcaaaagccgcattactctttttttttttttttttgtcatcgagacagggtttctctgtgtagccccggctgtcctggaactcactctgtagaccaggctggcctcgaactcagaaatccgcctgcctctgcctcttaagtgctgggattaaaggcgtgagccaccaccgcccagcaccacattactcttatactagctttatgctagtagtaaaagaatcactatgtataatatgcagggtatgtcaaccactgttactatatgattatatcaatttttaaaaaaactgatatagtttctggagcaaagtaaaaatcaataacatttgattagaataattagaacatgaactgtaacattagtgcctgacaaagaatatgtgcagcacttcatatgtcaagtagcattgtacctttcaggagctataagaattttttaaaaattctctttaaaatagcctattcaagtggatgaaactttgaataataggatcaattaaggttttttttaaggaaggagctgtgttttttggtatgaattgaacaaatgaggtattgttgtacttaagatttagaaatgcttaaggtgcccaaatattgcattcttttcctaaactgtttttggcagtaggggaggcactttcaagtagatgcaaataaaccattgcatgacttgatgaaaagcagcttaatatttgatttgcaggaaggaaatttttcattaggggaaacatcaatacttaaaaagaggaaacttggtagagtacagaatcctcagtatccaagctcaggtggatttgggtacagcgggcagagtcggcagtgaagatgagaatcagaactggcacctaatgcaatctgaccttgaaggagtcacagggtatatcactgatataaacatatctgccagagagtgagcagatccaaggaaagtttagtatcagcaattctccgggcttgtttactctaaaatttacataataccatcatggataagcccatagggttatgtaacatatacatttggcttcttccttagatggctttatgataaattatgaaaagaagtgtcacaatcttctttcatgttgttttttcattagaccaaacaggtcaaccattccttgtttctcatacactgaatcttgcttacggatgctagccctgcaattagaaatattcctttaggtaatatattatagacaaacagtgttctcctggtctgcttggatcttttctcacaaccataaagaaaagaggatagtttaatgacatttgaaaccatagaaaacatgttcttttcctacatttcatcaatgtattttcttcttaaaagatcaaataacaaaagaacaattcctaaatacctgtcgtttcctctttcctttgtaggaaactttgatccaaaagccatcaataatttttatgaccacatagaacctggcccagttgtaccaccgaagccatctaaaaaaggtgagtggaggtcatagcacgaatactgtagaagttgaatagatttctgaagaagtttctatttgaactattcactagagtatgttcctcataaagttatctatattaatatgacagtagtaaaatagtccccaaactttaattttttttactaaacattgaaagtgatgttaggattattgtaagacataatagtgattttttttatcataataaaaactatactcctgaaagaaaattgttctagaacaatgaggatcttgaaaaatcctcagtagactttgtacataagaattcttttgctgcttgataaacagggtgtaagctggagtgatggggacatgagtgttttgtcatcaagaacaaagcaagtcctaagttgttttcagtatcttacagtaagtgtagattggaaggtgtggattgatcactcattttcacccatatacttacaggccttattgttttatgttctcaatatacagctaatgtttaaagttcatattttaatcctttttcattaagcagttcaagacagtttggttatgaagacatattgaatagtagagagtgcataaattgtagttcatttatagatggcagcttaggagttggtctttttattgttttatactactgtggatgtttcatctgacctacatttgaaatagtatagtgatttctaaaaatgactcaaaatgagttttagtggataactgccaagtactaaatttggcactgtggcaatgttacatgtagtttcaagctgaaagcctctagattatatatcattgatcacttttagccttttaggttcataaaatacacatctttaaacttgattttgccttagtaccttctaaggtgatttttcttacagatagcctagcagatgagctacagttaaatgactcaagagctggcatagaataactgactaaattcataagaaatgaccaaaaatccgagcagtcgaccacatgtaaatcttgaaatttcttgaatagtggcatctccaaggagctagatacaaagccataagttcccctgttcaaggacaatgaactatctatcatcttggtactaggaatgaggctagggctttacatatactaagaagacccttagctgagtcgttctggcccctaattgttaggtacttggaaggaaatttgatgtttgtttttggtagtggaattctatatcaaagtagagaaaaatgaaacaaaattagtaaacttcaaggtagactgatgtacagagacgaaaaaaatgcaggataccatgaatagaaataaaagatgggttatccattataaatggtaataaaggcatgtgactaatagcttagtcaggtcagtaaactgtgtaacctagataaacacatttcttgaaaaataaaagtataaaaggccagattttttaaataggtgaaaggaaatgttaatagctgttcatattatattaaaactgagtacattgttaaaaaaaagttccatgaacatagtttcagaacaacattctgctagtcggcgagttcttctaaatattttaaaaagataggaaacaattttgaacataatttaaaaaaaataagaaaagggaagagtgtttcacatttgtttccctaaccttgcaaatgaatcctaactctccagcccctgttcactacattctccagccaagcagtgtgtttgctaatgttgatggacttatcaccctctgtatccaaagcctgattcatcttaggactctttgttgcattttatctgaagctagcagagcctgattccaaaaccttacccataaagatcctattaacccattcctacagaaggaaaagtgacaaatgcatgtaaagggctctgctcctcggccagctcactgcaaatgaaactcactaatgctgatggggggaatctttgaagtcataatgagtccagttttcagcaatttcttaaatagtcaccaaatgcataattgtacataaatgtatgatcctattattactcctgccccaaggaatttatacccaacatgcaaagtcttacctatccttatgaataagtttctactttaaaaatttaattgagccagggagtgacggtgtgtgcctttaatcccatcacttaggaggcagaggcaggcagatttctgagtttcaggccagccggggctacacagagaaaccctgtctcaaaaaaaaatttcattgagatgagcttaaagtataacttgcatattattggtgagagtgtaaaatggtactattatttgccaagttattttaagcctttaatcacagattagtaaaaagcttttgagtttgaaatcagatatattttctgttaagcactttattccattttgaagatggtctcataaactatgctacctactaggtttacagatatgcaaccccacacctagcatcatttttctaaaaacacttctaaaattagtgcaaattggcttgcaatactgtttgcttaaaaacaaaacagtaaactgcttgtatgctgcaaatctaagtagactctataatactatctgagtgatgagtgggctagagaattagaggacaaaggaagagaggcaacagaaacctttgggattggcatgtgcagttaataagcaacataagtcttgaggtaactcagcaaatcttcctgtatcctcattgcaagaacagtgaatgacctgggtgtcatgtgacctgaacagtggcctagctcactgtcttcagatctaatctgtgtaccacagagaggtgatctattcaaatcctgacctgtgtactttccaagatgttcgtgtgagtcagtgaaatgaaggcatgtacctttcaagtctaagacagagctccagcattttctttgcagcctaaggaaacagttactctggtctttcttattgtgctattagaattccagttaagcttaaccaccatccttagaaccctggggcagcgctttccaaaggtggactttactgagagatcagatacagtcaggactgattagaaaatgcaaggtcattcttttgctctttaaggtaaacaatatgtagtgtgctagtcattattatctaatacaagggttgctcactaataaactgtaaattcataacaaatacgaacagtattgtaacatgaagttgaaattcctgaaatgtgtggggagcccacgtttgtaactacatagtattcttttgagttgcttccatttttcaagaactaatgttttctatgaattctagtgtgttctctgcctcctaaatgctgggattacaacagtgtactactgtcgtcattaccgttatctctgttgtcttcttccttcctctttattcttccttcttatttcttcatcttctttctttcttcatcttctttttatttttaattgttggtcctttgagacaggttcccacataacccagacattcaacttgtgtgtgtgtgtatgtatgtatatatttagttgctgtcactgactttttactccaagtatatttttccgccacgactcactatttgagatgagtgtttggtgtagcttgtaaagaagcattcattatgtttatattaacctcagagacaaaggaaagctcctgtgaaggcaggaagggtaaattctctcagctgagtgagtagcaggaacggtccttgggagcgcagtcttcctgacagatgatgctgtcccctctcagtacttttgccttttcttctgcagactcctcagactcctgtgcaattgagagaaaagcccgaagaattagtgtgacttccaaagcgccagtagatatccatgacgcccaggcagcagctgcagatggtttgtacctgtgtccctggggtgtgttaacccatccaagttagcataactagagcctgccttcaggtttccctttgaagattacagttcatgtgcatatgctaagtgtttagtagatcctcagtgcttgctaaagattgttttaaaagatatttttcttaatttcttcatgctttatatgcacaccttgatttgcatatagccacatatagctcatgttcagcagctatatctgaacaccttattggaaaggccagctctctagaagtagaatgtagaaagcaagacaaagtacttttcaaatgagttgcaatttctggatttgataaagcttttcacacaagtgtctaagacttctttagcttggtctgctgccatccaattgaaagcaggtctctaaaatagtatatgttatactggattactattatagtatacataataatagctaaaccacccttattttgcaaatgaaaaggcaccatgataagaagaaacaagatacatggaagtaccttgtacattttttcttttatcattagaatatgtttgtaaaagtaactttttcatttaccattgaaaccctttctattcagtatttttaattgtgtgccttttgagcactttttgtcttttatattatattatacaagcaatattgattaaggtatttttgaagcttttcatttttatgaaaatataaactattatataactggaaacctaatttagccctttatacagtttttagtgtatgggctacaaaatagtgtttcctgcacaccctttgatctggatagaaatactcctttttgaataaatattttctacaaggtggtctgcaaactgcttttaagtgtgctataaaaaagattgttcatgcaaatcaaagtaaatattctaaaatagtactttgaaatgaattgaatagatttttatactcacaaagttgtttggtcatttacctcatagtgattcatgacttcaaattaagtcagcatgatatttaacagggaatagagtcatcaataagagtcatcagatagactgaattgacctaagaatgtaagaacagttttgatttgttaaccttaaaagtcaactgtcctaagggtaaaattgtgcattgtggagccagtctataaaaacaactctaaagcagtaatttatatctagtaagatggctaaaggtggcaaatgaaacaagtctagctctcctgtttgtggttacaggaacccccctagagaacacttgaaacccttttccccagtgagctttcttctgaatagggaatcttccaacaaagcagagttgccagatgaattctaggagtacagcccttttaagcctaagaccagagagaattaagacctaacaggaatacaagttttgagtttttatttccatgtgaaaggcttgctttcttaaactgctagtttgatgtacctggtaacacagacttgagtctatattttatatttcactcctttgtaaaattggattttgatattgccaggtataggcagttttcaaaaagtaatatatgcacaacttttttggcaagggggaataactttgagaacaaaagaaacatgtatatagaatgattcttagctttataactagctgtagagtcgtcttttttcactcttctgggaacacctttgttttgaattttacctgccattgatggagcattaatataaaacacacatgtcttcctggaagcagatgtcctatagaagagatatctatttactagtctatggcagagaggaaagtcagagagagttctctgaatatgctgtcacatacatctcaatgttttacccctatttggctggaatatagcttaattatctattctttatgggtaataaactagaaaggtcatctaattctggacctctcttcttagagcacaaaaatcaatgtgtttagaacaaagtggagcatgtatctagcttctgtgcagctatggttttccagtggtatggttactaattagcttattcaatgggtaagatagggagtccttcctttgttttgtggtagtttgtcatttcagttttggtcagtttgtgtgttgcttggagaaacagttgatctagcttcctttcttttaaatcccctctttcctcagaacatttaagtatctgcaaacagagtgctcggacacaaccccgagatgaggattatgaaggggctccgtggaattgtgacagctgtacctttctcaaccaccctgcactgaatcgctgtgagcagtgtgagatgccacggtacacttgaattcagaagagttgacaccaggttgagagtgaaactttgagcactcaccaaaagaaaaggaaactttgggattgtgttcatctgcccagccttttcatttcttgattgcacagggggaggtgggggaatggtgccctggctcaggaaaggaaaagtggggaggtctttcttttttcctttcttaactcattacagagtgagaggtagaaggggatacttgaattcactcctgtaagaatgtacacagagatgttaagggctcttctatggaatccaaattgttacagttactgctgagtggctcttcatttctaaaggtgaactttggattatggtaggacatgttacagtttatgcagacaaactgtgaattccagagcagacttacttggtcacagctctctggaaaccaaggctccctgtgcctcttcctgctgcttcctgtgaagagatggacaggaaaaagcacccaggatatgctttattttcttttgtgcaaaataatgagtttatttgtaattgctgcttttttcaggggtaatttcaaacacacattcatacgcagacaggatacttttaaaatgtgatttgtagtagtcaggaattaggcatattgtgccctttgtgaggaagtacaatcagaggtagtattatctcttttgcttgaacaatggttcatcaagctgcattgacactggtaactaagacctacttataccacataaattattgtatattttcttaggttattgattttgaaagtaatgaagtatggttttataaaatgccattctcataaaactgtgctttgccagtagcacactgaatgtatgccaaatgcaagtccattccaaaaccattggaaattctaagctcagttgtggttcttaagaaatgcttgcagtatacagggccccctacttctggtttgtaatgaatacatgatgtttacagcacagaaaatactttgtgccgtagtcctaatttagctgaaaaaaaatcaatatgagctatttatttgcacatttgttaactagccaatgagagggaaagcgaagttggccaacatcataaagttgcattaatgaaggagtgagacgagactactcaagaaataccattgggctggggatatatagctcagtggaagcacggtagcctggcattaacaaggtgctataggtggaaaagaaaaaaactactgtcaaaagaatgatgtatacagggagtttgaatttttttttttagttgaatagacagatcatactgaatttcaacagttcagggaatactaaagcactacttatgaaacaatgcaggtgtggatacactgaaaaagataacaaatcaggccacttgctgtgatgtataatgagaaaattaatgatagtatatttaagtaggttctttgccttaaatttccttcttggttcagaattgaattttggaatttttccccattccagtgaacatagacagcaataaaattgctaggtttctccatcctgaagaatttcacctgaggttataaccttaggaatactaggtctgtccccaactcctgtatacacaaccactttgtactgtcactgtattctcattaagcagaaatcgctgccagacctggaaaaagaagctgcactcaatagcatattgaaaccaaaggcatagctcattgtagttttctatcagtcataatcttctacatcgcatctagccttcatatgtggatacactgaaaaagataacaataatcatgtctcaagaagagcatgattatgtaactatctctcacacaactgcgacaaaactgtgaaaatcgtaatggtgggaaaacaggcgcaaacccatggacttggaaagggtgaaaggcttgtaaggtgggtttcctgtcgatccccagaagcagtctagcagtcctactgttcttaaaggtgcccttgcctttgtgtagtttttgtctcccttagagatggacaactccacttgctattatgagacaagttaggaggaacatatacactacttgacatatctgactaaaggtgtcccagtgttcgtaataagatgctgaaataccgacagcatgacacttgtcagttgaccatgaaagaagcatgtgtgaaaagtctgatgctttattaaaactattgcatgaaaactcaccaaggtcaataagctgttaacatacagtagatgcatggttcaggccttcgatgatgtatctagtcactcatggctttcatctgccaggaaaaaggaggccccagttcatttgcttgctatggaagttaggtatgagacatcaggggccattaagaaagctttggacgtggtaaggtttgaatgcccacatacattttattcagttcctaaaaacaatcaaaacaacttgacactgatgaacttgatacatttgactgtatcatatatagacccatatatagactgctccttatctatgaccactttgaataagaattcattgagccgtccaggtggttttgtttcttttttccagaatgttctcctgctcagattggcatccataagcaggtggcatatggtggatactactatggaagttgctggatactgatgtggaggtgtccatgccctttgggtcagttagtgtacgcttatgttcgtgtgagaggcttgctttcttaaactgctagtttgatgtactgataaggcagacctgactctacattttacatttctttttgtaaactgggtctttagaaagcatgttagccattgtgttaaaagaacattgttcccgtaaaatttagaggtcttaaagtttaaaatggaaagaaaggagccacaaacttctaaggattgtaaaatgtttggattgattctgatctagtttgggaaacagtggaggcaggggatattaaagaaacaaaagaaatgcattgtacaaatatgtagttttagtgcaggttaatgatggtggaggaaagtgttgctaatttgtttatttcccaggatggaatgggaagtgtgatatgcagtttaatttttaaggagctggtctcaattttagtactctctaattataaaagaaatcaatgtttcgttaaattttgtcattggtttgtcacaattatctaggggttcatatccaactctctgtggcaactcaattttatataatcttttaattgtttatgtatttctgacagtatgaagagaaagcatatgaggcatagaactgtcttttagaaatatggatgatgtatcctggaatgtgaaggtgtccctctaagatgaaaaatggaattattttactgttgtaccattgttagaccttgaatgaatccatgttgcagtgtgtgtctgtatatttgtagagaaagggaaatgacaattgaaaggttactttaaaattttcaaattgggcactgcctgtgttgcagcactactgtatctttgttgagcgacctaacagtatttccctgttgtgaaagttaattctgatgatgtttcacattcaccagctttttttctgtactatttgcatccccaaatacttagtacaagtagaattgtgcatggcttgggcattcaaagataagcgagcgatgagtcagtctgagtttctaaagccatgaaaacttgctttgagactgaatagttctgagttatttacaacagcaccaattgtccaagtttctttccctactgtaaaagaattgatcagtttcttcattaaagcagcaagaaattaattaaatttgtacataccatgtctcttagatttctgtgtatgttgtgaaggacattattttgagaagaaatgtacaaaggcatattacaaggctatgcatgcaccgtccaagcagtacatattcagaaagtcaaagattcctgcaaaataaattaataaactaaaaacaagctcta

SEQ ID NO: 535 - DNA, 586 bp, mus musculus
aggccctcctggaggcaaccgaggaggcttccagaaccgggaaggtagtggtggcagcggtggtggaggaggcaactactgaggaggtttcagccaccgcggaggtagtgactacaaccaaaaccgctggggtaacaccaaccaggataataacaactccaacaaccgaggcagctatcacccggctcctcagcaaccaccaccatctagctataggactgctcggaaccctctgggagccagcagctacaacaaaaacagcaacatccctggctccagcaccaataccagcagccctacagtgagcagctacagccctccacagcctagttaaaaccagccgccttacaaccaaggaggctacacccagggctacacagccccaccacctccacctcctgccccctatacaccaccactacccctacacactgcccagacctaccctcagcccagctataaccagtatcagcagtatgcccagccgtggagccagcactatcagaaccagagccagtggccgccatactacagaacaacgactatggaggctgctggggcagcagacagcagggcaccagcacac

SEQ ID NO: 536 - DNA, 586 bp, mus musculus; identical to SEQ ID NO: 535

SEQ ID NO: 537 - DNA, 2614 bp, mus musculus
atgccgaagggtcccaagcagcagctgcctgagtggatcagagacagcgaggacacaagccagtggacaaagtagtgaagaaaggcaaaaaggacaagaagacattctttgaggagctggcagtagaggacaaacaagctggggaagaggaaaaattgcaggagagggagcagcaacagcagcaacaaaagaaaaagggagacaccaggaaaggctgtcagaataaggatgtggactatgatagtgttgagagagtgctcatggagcaacttaagcatctgtctatgtcagccagtgatgagcaggatgaggtacctgcccccataccccgaggatggaagagggccaagggtgaaaatgcttttgaagccctgattcaggatgagagtgaggaggaagaggaagaagacaatcgtgttctcaagccgccaagccagagaagattcacatcaataaagtcatggctgaagagccacggctcaggagtaaaaggggaaatgaggagaaatcaaaagggaaagccgagagtaaacctgctgctgcagaaagtgaaggggaagatgcggaagacacagctaaagaaaaggagcctcctcagcaagtgaaggacaaagacaaaaaggaggcagagcagggttcacgggaagagaaagaagagaaaggagagttgaagcaaatgatccctatgccaacgttagcaaaaaggaaaaagaaaaagctaaagaaacagatggattatgatcgacacgtggagtcattaaaagcagctaatgctgcagaaaacgacttctctctgttccagccagaggtgttttccagccaggcaatgttaggcaggtggatttttgagtttgaggccagcctggtctacaaagtgagttctaggacaaccaggactatacagagaaaccctgtcccgaaaaaccaaaaaaaaaaaggggggggggggagaagaaaatgcatctgacatcaagttggaaaaattcagcatgtctgcccagggcaaggagctgttcgtcaatgctgacctgtacatactgaccggtcgctgctatgggctggtgggactccatggcaaaggcaaaaccacgcttctgaagcacactgccaactgttccctgagcatctccccctaacattgatgtgctgctgtgtgagcaggaggtgctggctgatgaaacaccagccttgcaagctgtcctttgcgcagacaccaagagactgaggttgctagaggaggagatggcttcagggacagttggagcaggaggattccactgctgctgagaaactagaaaaggtgtatgaggaactgagagctactggggcagcagctgtggaggccaaggcaaggtggatcctggctagcttgggcttcgaccctacgatgaagaatcagcccatacagacgtttgttctctgggggttggagaatgcgtgtctccccggccagggcactgttcatggaaccaacactgctgatgctggatgagcccactaaccacttggacctcaatgctgtcatctggctcaataactatcttcacggctggaggaagacgttgctgattgtctcccacgaccagggctttctggatgacgtttgcactgatatcatccacctggacacccagcggctccattactacaggggcaattaattacatgaccttcaagaagatgtaccggcagaagcagaaagaacggctaaagcagtacgagaagcaggaggagaagctgaaggctgggagcaagtctatcaagcacgtggaaaagcaaacaaaggaagtcctgccttgaaaacagtagaagtgctgacagaaaaaccaggatgaagagtttcaggagccccctgagctcctgaagcgtcccaaggagtacactgtgcttcaccttcccagacccccccccccatcctcaccccctccccgccactcagtccacctgtgctgggcctgcacggtgtgacatttggctacgaggggcagaagccactctttaagaatctagatttcagcatcaacaaggactcccaatttttcattgtgggtcctaatggtgttgggaagagcatactattcctcctcctgatgggcaatctgacaccaaccaatggggaaatgaggaagaaccattggctgaaaatcggcttctttaaccagcagtatgcagagcagctgtacatggaggagacgcccactgagcacctgcagaggagcttcaatctgccctaccaagatgcccggaagtgcttgggccgctttggcctggagagccacgcccacatcgtctagatctgcaaactctctggtaggcagaaagcccaagttgtgtttgtagagctggccggtcggtagtttgatgtcctcatcttggatgaaccaaccaataacttggacatagagtccatcgacgccctgggggaggccatcaacgactataagggggctgtgattgttgtcagccacgatgtgtgcctcatcacagaaaccaactgcctgttgtgggtggtggaggagcaggatgtcagacaaatcgacggtgactttgatgtctacaagcgagaggtattggaggccctgggtaaagtcatggtcaacgtcctagggattga

SEQ ID NO: 538 - DNA, 2614 bp, mus musculus; identical to SEQ ID NO: 537

SEQ ID NO: 539 - DNA, 1023 bp, mus musculus
atgcccagaggaaagaagagtaaggcccgtgctcgtgagaaacgccgccaggtccaggatgaggcccaggggctaacagatgctcaagccaaggcaggagagaaaggagagtcacctgcctgctctgatcatgagtctggaaatgctgttgcaagcacctctactgctggcttccaaaagggcagagtatctaccacctctgctggtaaaggcatggcctgcaaaaggtctggaaaaggtgcaaatggccaagaagagaaaaatggtagtttttgtagggccccactctcctccagtggcaaaagaatggatcttctatcaaggaaaacaggaatgctggtagagtacatgctctacaagtacaaaattaaggagcctgcaaggaggggagaaatgctccagcttgtgaacaaaaggttcaaggagcagttccctgagatcttcaaaaaagcctcctatcgattagatatggtttttggcattgagttgaaagaagtccagccccatggtcaaacctacgctcttgtcagtaagctagatttccaggatgatggaagtgagagcagtgagatgggtgttcctactaggggcattctgatccctctcctaagtgtgatctatttgaatggttactgtgccccagaggaagaggtctggcacttcctgagtaagttaggagtctatgatggggtcccacacctcatctttggggatgcaaggaaactcatcactgaagatctagtgcaggaaaactacctagaataccgccaggttcctgatagtgatcctccatgctatcagttcctgtggggtccaaaagcttatgctgaatacagcaaaagaagagtgatggactttttatgtaaaattggtgaaaccatgcccagtgcttactcatctcgttatgaacaggatttgattgaagaggaagagaaagcccaagccaaagctgcactcaaggctggcactaagggcaaagccaagggacactctaaggccaagacaggcaattctactggctag

SEQ ID NO: 540 - DNA, 77 bp, mus musculus
gagaaggagagccccctttgggtaccacaccaccctgagacacatactcccagcaagactaagcacatcctctccca

SEQ ID NO: 541 - DNA, 15683 bp, mus musculus
gcgcggccccgcgtgggtcctgcctgaggagatcacctcggccccttggagagcctcagagctgcggcagcgcaagagggggcggtttggagagggcgcggcctctgggaggggaacgtgtgacacgcattcctagctctgcctcgggccaccccggagcctcgcggcagctcgttgtcccacttggccactggctccgtgatccctccttgcgcctgcctcgtcttgtcacctcccgtctcaccctcctcgctccatcctccaccacctcatccacagccatctgagcgagcgcgcctctgagagcaggaggtactgctccgggcttcagggcgcgccctccaaaggtgcccagctcgacattcgggaccccgcgggcgacagcatggacaccaagcgctgcttcgccaaccgcttcgatgactaccagggcagcctgctggcgggccagtgcgaggaggcagtggcgcccttggtcacctccaccatcgaacgcattcttcaggagctgcccccgctggggggcggcgctgaggctcggggggcgacaggcgcgggcagcagctgccaggggggtctgtacagcggcgtggccggggtggcctacatgctctaccacgtctcccagagcccgctcttcgccgccgcccgggagcgctacctgcgcttcgccaagcgcctcatcgacgcgtgcctccgcgccgaggagtggggcgagacggacgcggacacccgtgctgcctttctgctcgggggcgcgggcgtgtatgcggtggccacgctggtctaccacgccctgggccgccccgactacgtgcagcccctcggcaagttccgggctctgtgcgccgtctgcgcgccggtctccttcctggactgtggctccgacgagctgttcgtgggtcgcgccggctacctgtgcgccgcgctcgtgctcaagcagaagctcgcccaggaggtaagacgcaatcccggccgccggagggcgctcgcccgctgcccgcgcccgcgcccgcggggtcctgcttgcctggactcctcgacgcctgcagcaccgccctgcactctttgttacttctttgttacttctttgtgcgctgtgcttgtcccccccccccccagcccgtgttttctctctctctctctctctctctctctctctctctctctctctctctctctctctccctctcccttccttcctccctccctccctccctccttctctccttctctccctcccccctctccctttctttttctctcttcccccccccccttttgttggattacctggcattgccttactcctgttttgtgttgttttgttttgttttttgcagtgaagtttgtggcatcactccagatccctcttcgccccatagctttttaggggttgaccttgtggcccttaaaagtgagtgtttaaaaacaaggggggagggtagttattttctttctgttgaacagtgctagcaagaatgcccttgaacattagagtctttaaaaagtaatgaaacttgtagggagtgatgtgcaggaaagttgcttttggactcctgggcctgtaaccaatagtaagctggctgtgtataggtctgatgtgtatactgtattatttactattacattcaccctgtgactcataatacatgtgtatctgatgcgagtgtggtcttttaaaataactaagtgtagacaaaaatatactcagtttgatcaaatgcgttttttaaacccatcttaatatcagtacttagcttgaccctttggtcacagcccttgtgacaggcagctttagatgaatagctttttcaggggctccttcaagacagtttaatctctctctctctctccacacacacacacacacacaatgtttttttttttttcagaattgcctttggatataggatgccaatattaggaaaatccgtggcgttgagggaattaaaatataaataaataaagctatgaagcatcatagtaactagaactgaaagagaagcactttcattcataatctactggaacaaatgcagtgttctagggaggaagtgacacatttaacttggcttgatatagtgaaaaagacatttgaagaaaaaaagaaaaaggcatatgaagcgccttaaatgtataattagctgagataaacagtgcacgaacagacttgatttttttttttaatttacagcaggtgaagttgattcaagtgaagaaaaattgctaaaggatgcattaagctggcagagcagcaaagggccatgtgacaaagttgtcttgaaatagttggctctgcttctgagtcattgttatctgctagctgtttcccaagggcccttcctgctgtatacaaccatttagaaggccactaagagatttacatatcatttgcattacatttgcatctgctgcccaaaccttgcagtcctatggtaggcaattaaaaacaaaacaaaacaaaaaacaacaaaaaaacccacattttccctcagttgctttccttaagcctgtttcttcttttacccatgcctttgagtcttttctccataatggaatggcagaatgaaaagtcaaccaaaagaccaggaggactctaacagaatctggtggtccaaaaccagtctagatgtagcccggcaccacaaaaacatttaagatcgttcttttgccttcctgtcgaactatatctttttgttctaatcaaattgagcttgtctggctgctcccaggagatggagcaagagcacacgctcctaagattttgaaagaatagcttttaatttgttagatcccttactactagtgctggcctaagcttcaataatccaagaaattcaggctttgaatgtgtagggcagggactggcacatcttcccctccctaactccttgccagcaaacagctttgatccatgaaccttgattaaattgaatttctaactcgtgtgtcatttttctataaataatctgtcattgtgtctcagcatcttttttatttcattcaatgtcatttacattcaccttcctctgtcatttcccatagttatcaccctagtttagatccttctcacattatttgacacatctgtgccacgtaataagtaatggaatgaatgaatcactctgagccagggtgggattttttttttccctcactaaagcactcatctgcctttttttaaagctagcttcttaaagacacttttcattatgtcacttccctgctcagcatccttcagtgattgccttccatccagtggcttcccattgtgtacttaaaactgtgacacttaacatgtccgagaaagcctgccaggatcaggcccacctgactctttcctcagtgttcagcagtcgcactggccttctgttgttttcgacattgtcttgtctccgggtttttgtactctctgttcttcctgcctggaacactttctccagatatttttatagctagctccatgaccttggctgggcctttacgtccttgctgaggcatttcctgccagcactatttagagttgccctccttcccttcttgattttactcagtctgtttatttatgtctttgctaattagactataaatcccatagcatgggcatatttgtaccttctgtagcatcaggattaacatagtgcccagcacgtgtatatacacaagctttcttctgtgctgttgcaaatgttgtctgtgaactacatggcttgcattgccaacttacctttaaaatggcatctggtttatcagtattttcccttatgctagtgtttctggtgctatgtttaaagaaagcatttcctacttttggctcctcagttatctgttgaatgaatgaattgaatgaattggatgaattataggttcttacacatttttcttcaaatcaaactgacccacgagatcagtacttttcaaaaatttattctgcatgggaagcacttgaagatcttgtcaacaaaatacaggaaaagtgtcataaatattatgaatatacagtaaagtatagggaaaaattctgattcagccttgagatacaatctgatagtcagcatatctaacaagtcccaaggtgagagtgatgtggttaattcatagatcacaatttggattataatatgattctgtgtgggtttggctatctctcctgtcatgtctatttattcatgctctaacagtttgttgtgtgaaagcttggtgtattgatttatgggactgtaatttagaatgttcattacaatttaatactgtgcttttgttataaagtcccacagaggaatctgtctcaggaggtataaacaaataattgtgttctttctcacaattgatagaatcaatgtagtctttgaaacatgtcttgtgactgatgcatttctcactttctgttggctaccagaaagcataaggaccaaatttggattaggtgcctgagaatacaatgctttatatatcttcatacatcagcacttacctctaggttgatgtaattggttccatccttggagtcctcttctacctttcaccttaaaatttccatttgtgttgattaaattgagaaacgtttaaaatgtgtcatatgcaaagagaaagaaacatagacacttattgaattattccacctacatgacatgttccagcgaattgatccctcctagaaacacttaagacaagagggtttgaagtgtataaggcacaataacctcatacagtgggtcactgaagttccaagaaaccatgccacaaacacttgcagtcagcctgttctgccttctactgattggtggagaataaggaaggaatggtaaggggattaaaggagatctaggataccaattaaaatcactttgtcacttgatgatcctggacacatcaaatgtataaacattggctttcacatttacagttggattaataagaaatcaaatcaagacaaagggactgtcttggaagttgctgtgatagactagataaaatgcttggcgcatagtagctgtttaataaaagtaatgttcgccctttctgctcctactaccaaataatccagtgtaattctgaatatcaggtagaaaaaccacattccctacaggacttgatcaaataagctgagccttacaaaacaatttttcattgaacttttctgcattttattcattcattcaatgactctcagttttttctgttgttacaccaagcaccgtgggtgagcaaaaccaataacctgatttgatagtaatgatctgaaggaagtagctaggaagaaagggaaaggagtggtcaggttagagaaggcagaagtgctctttgggaatggatgggagggaggctgctttgtgagggctctcaaaactggagcatgaaaatcaagtggctgtcctaagagcaaccattctggcagagggaccagacgggaccaaaccatccaggtttagaggtctcaaagaaatgaggaagttcaaaggcttgggaggctcccaaatggaaggaaattacactcagatcccttggggccaagtaagccaaagttaggagcttgtgttccttttgtgttgaaacaagggagtgtactgatcttattaccttttgaaaaaaaaatcaccgagtttttctatgttgaatagattgtcaatattaagaatggtatggagatagggatgtagttcctgatagtagtatatgtgataagcgtgtgagaagccctgaatttgatctgtagtgtgaatgtgtgctcgtgcacttgtacacatagtcacaacacacacacacacacacacacacacacacacgcacacgcacacgcacacgcacacacacacacacacacacacacctgcaagaagtgtttatgtgactcttttaaaatcctttttgcaccaagaactcctttgtcagtctggtgagctttcaagacttctcaggatatttacaaattaaaacttagagccacaaaaacaccaaccaaccaaccaaccaaccaaccaaagaaaagaaaaaacccaaagcattgtatttaattcaaagatcaaaacattaacaaaatgtaattaacacattaggatttttacaatgggtcttatgattatggtagttttgaaccaggagtcagtgatatctcaagaacttcagtatgatacacatagatctgtgacttctgtaggggacagttacaaggattactggtggttgtagtctgcatttgaaaaaatttaatttttttgagacagagtctctagaggcctaaatgacctggaacttgttatgtatatcaagctgaccgtgacttccagagatatgtctgcctctgtttcaagtgttgagattaaaggcatgtaccccaatcctggggtcaacatttggttgggggtttggttttgttttgtgggtggttcctttgaaactgagccttgctggcctttaactcactgtgtagcctaggctgccttgaaactcataacccatttcctgcctcagcctcccaagtgctggcaattacaggtgtaagccatcatacccagcttatatttgtagtaaaaggaaatgctcagtgaattagtgaacagatgtgattttatttttttcccagacaaagggactgttttggaagttgctgtgatagactagataaaatgcttggcgcgtagtagctgtttaataaatgtaatgttagccctttctgctcctactaccaaataatccagtgtaattctgcatatcaggtagaaaaaccacattccctacaggattggatcctcctgctgtgatttaaaaattgtaaagatctcaattggatcctcagcatattcattgtactggctagttttgtgtcaacttgacacagctggagttatcacagagaaaggagcttcagttgaggaaatgcctccatgagatccagtgagactcttatctcaaaaaggagaggaaaaaaaatcacatacttacaggaaacactaaattgatttatcaggtcatatttaaatatttatattggtgtatatagtaaaaatagaaattaagggaaaatgtggttggaataaggagagcattcatgaactcttaatgaaaaggtgtagagtcactccaggttgttttggtaaccacagagacttaagagaacccacacccttcctagatattttcacctttatagtcaagatgggctgtgcccattctaagcatcatgctcttgtataacttaagtagaggcttggggctgggggagggggagggcctgtctgtggttttcccagcacctatctttttaaatcatggagaatgttccatacagaaggctttcctttctgactcattgcccatcacttggtctccggccagttctagatttagggaagaaagagagggctaattgtctttcatttctaacctttaaagttggacagagtttctgacaagaaaggagagagaatgaaatggcttttgtcaggttaccaaatggtcggccctttggcttcccttggcatgatctgtctgtgacttctcacctttacccactcacgtttcctgttgttggtgttcccttctttgccaggtcacctctatgtgccatggcaaatgtagagtgttttcattttgctgttggttagctattaatcaaacataagctatgatattaacttaattaaaatgtgtgctagtaaatattgggaatgcattttatagcagaaactatttatgttctctccctccctctttccctccctccctccctccctccctcccaccctccctcctttctctctctctctctctctttctctttctttcaagctacatgtaaagggaggtttattacttttttaactgaaaatagattctagtctcatacaatccatctcaaccactttccccccctccattcctcccacttttccttctcccccagatccactccccctccatttcccttcagaaaggagcagacctctctgagagacaacaaccagacaggacaaaacacaatacaataaaacaagccaaaagctctcatattgagaacaggaaccagaggctggatagcccaggaacctagaaccaaacaggactggcaaaaaaaaaatatatatattttgctatcctcatagatcgctgccttgtccagttaccatgagagagacttcctgcctctggcatcagatgggagcaggcacagagaaccacagccagacattatgtggaaagagtctcaattggagatctccatcagggccctattttctttataattattattgttatactaatatggcaagctcaatgagatagtacaaaatgagctttctgagaactaagaattgttaaaaatttccttttttttttactaaagtgtatttcataagtgtgttttcttcacttgcacagataatatttttaagatttgttttatttccaagtgtgagagagcatgagtgtatgcatatgtgtgtgtgtgtaggtgccataggaggacacaggggttagataccccttgagctagagttataggcaattggaactgcttgatttgggtgctgaactcaggcctacagcaaaagcagtatgtacttcaagcatccccttattccacaaatgatcatattatatatgtcctctgtagctcgtgtcttttgtgtaatataactttacacatacttgttaatcttatagaaaataatgatttattcgtataatagtccagtacattgtgaaatgagcaactgaggctaaataacacatctagcaccttggatactcatgtttcattgtgagggcattttaaatccacctttaagcaattttcaaatgtaaaatacatcagtgtcaacagaatacatttgctgtgctggattaccaagcttcttctgggtagcttatttcccttttctccatcttccctttcctctggtaaccactagtgattatatgctaaatttctgagttttgatgttcttggaatgtgcgtgtatgtgtgtgtgtgtgtgtgtgtgtgtctgtgtctctgtgtgtgtttgtgtgtgcacgtgtgcattaataatattaacaaccttacaacatggacatcacaattatctcctcgcacaagccttccctccagagtgcttgtgcacatcacaggcatctgcgattgtagctggctttcttgtcttttgcctccctcctctctttcattttctttctttacttattcttattagttcactgaaaatttagtacaatgtatttcaatcatattcaactcgctcccttctcccagattttcctggatcctcccaactttgtgtgctctttctcttcaaaatcatctggtagcattcaactctattctgtccactgcgatccagtgtttccctttctgttctgaagacaatagtctcgtgtattggatgttagccttccactcccaatcgttctctttctcagttgctggactacaggcttaagacagcacagccacatttgactcaatcctctctatttctgtcatctattctccgagattgcacctccagtcagttctcacggttacagctacagtctgaatgaatatatttgagtgttacgccccgctctaagctttgtatatgtatcagcatattgattcatttacttctctcagtagcacttagcctattagacatccaacatcctggactccccaacattctagctagtatgtagctagtgctgcagcagcagatttgtggactccattgtgtgaagtgtggctttaccctttgaggtaatttatatcatccctttttccaggtgaatattatgtggctcagtgaggacaatactttctctagcttcctgaagaaaacacacagtgatctatagttaggattcttgcaattgcagctcaaaagtgattacttaacaactatgattatgtgctttgtaaatgactattaaatgaataattcaactatcattcagtattggggcaaatagtctagcagtgtatagtcaaaagttgaaaataaattaatggaatccaagcaatatgtaccctttcatcttgattcctctaaccttggaaataaatctagtatcagccattacctttcccacagtttcttctaatggtttaaacaagtcgtttgatccatgttattagccaggaatcaaaaggacatagctcagcaagtttttattgagggtattactccgtgagtcttttttaccactgcctttgcttttgaaaaagtagcacttttaaagtaccctgctgctatgaagatttcttgttaaatcgtccgaacagcagtcccagcagatacagaagcaatatctgctgctacttaaggtttggtcattggcaaagagggattactttccattacaggttaaaagcaaatattttggtcagtagcttggactcgcactcactatgtgtgtatggtgtatgtaatttagggctgcactcccacattgtgtcctcagaccacaaattaacctcatcagaggcctttcaagaacaagacccatcaacataagaatcaaatttctattgggatgtaaagtgaataaataaataaattactaaaataagaatcaaatttcatgttcccgacaataattcaaccattaatgttccaggaagaaatcgttacttactcccgccatgcaggatactgttttgcaaccaaataacacaaatacgtgtcagagcctttgcctgggaggaaattgatttacttatttgattatttcaagaagcacttcttggctcagagaagtggagggaatgaagtgtgtaatataaaatatgtgacccatcaaaacatgtgactccattcaacagaaaccaagggtgaaatcctcaagtctctatgtaaatgtcaatcagttcgagtcaatttcacttattaatgctagaaagaataaccctgattttcagattagtgcctgtattcacttcatcatctcattcattcacccactcactcactcatttattcatttgtttgttcagctactcaataaaggttttgtttgtatgtatgtccttttttaaatgctgagcactggatagtcatttattctgggcaccttgaccagccatgcatgagtctctgtattaaccacctgttcacttcaaaaagtagcttctccaacaaaggtgcagtacagcaccaaactgtggggataaacatacatttagaagacagtttgataccatatgggaacttatttttaaagtcacattttgagcccctcccccctaccttagacggagcttctttggcttggggttcacaactctgcatttttacaggatcctcaggtaatgtataagcccattaagattttatgaatatgcttttaaaagatcagtttttgcagaggatgaacatatcatacctgtaacagcttataattcaaagggggaaagtggatatggaaaaggattagcgacatgtaaataaggaacattcacagataaggctgcaagaataaaggagagagaagcagatattttgccccatagcaggctggaaagtctatgaaatgttgcctaggggcccttggaggattggaaaaggttatcagcccagagtgcatctgactaaaccagaaaagttgatggagagtaacgtaagagttgatccttctcccagaagcagcctagaggtaagctattgctagtgttgattcagatgtttaagaactaggttctgactcggtgtcttgtgttgtcctcttcttctcactgttcatgatcatgactgctgttggagctctaggaatcacatctttgtccaattacattcaaatgcaaaaatcagagagtgaacattcttgcttctgcttgcttttcaaagagatgactcatgtctagaagcctctgagcaaatcttcctggtgtctcattgtctagaaccaggacatttaattttgagatctggtctactctctatttctactaggtatgctaccccatatttagaagaggatttcactgttagtaggaagcatgttttcttaagtgtcagagttttaggataagtcctcagtggtatattctacaagattactttagtagatgtggcagctactgttaattgtcaacttgacagcatcttgagtcacctgggagatgggcctctctgtgagggtgatgttggactgtataagtcgagaggaggacctaggaaggagcatgcattttcctctgcttcttgactctggcttccatgtgactatctgtctcacactcctggactgggtcttccccactgtgatgggctgaacctttgaactgtgagctgactaaacggttcctcccttcagtttcttttgtcaggctattccatcaaagcaacagggaaagacactaatagtataagggaagtcggggagtgggacagacagggcagtcccaggtaggggaaaaacaccaacagaggcacggaatgttaagtgtagggataacatggttactctgtgaatttgaatgaggcttagggaacttaatttacaaacgaattctgagcaatttaaaaatacttggggctgggaattctatttagtacatgcaagtcctcctgtttactccctagaactgcaaaattagattaagctacaaataattcattagaaccttttattcttttggaatcttaggttgaagcttagtttacaaaggagttgcaagtatgctgtagtcagaagtagagcgggatgcctatggctgccccaataggctgtagcaaaggaagatagaaacaggggatgtggacagaaaaatggaaatgaaaattaaaagccaccattcgggggagatcaggacatttgcagacatgggctttaaatttaactgagccattttattttgacgttatacagtcctaattcaggaaccttagcagaaaactttgaaacctgctaattgaacaatatttcttagtgacacaatatgttcttgatcacagaagagcagtttgcaggcttccctttctcatatgcagttctgttgtcaggtaggaggaccattctccatggaaactgcttcggatcccattttacccccagcaatggaaagcagctgcacagaatccccatttagctgtgtgctcagacccttgcctctgtagtcccctcttttccttctgctatctccatctatcaacgagctccactcatctctcctctccagagaattcccccctcttggcccccagcatgacagcagttgctcactcctgactaaaatgattttccctcttaatgttctgcccaaatatattcttccttcaagactttggcagggagagttctgaagcatgtgcgtgaagaaagaaatcaagaaagtcccggaaaggccgatgaacagcctcatgtggcatggcttgcttctctctgacttggctgccatgcctgaggtgctcagtgctcttgacatgtcaagcagtgatatgaactgtgccatcataagacccaagtgacctctaggggaagctgaagaacagcagtctatagtgtaagaatgttcaaggtggggaaaagggagtttccaagtcttgtgtcttggacctcgaaggagagttggcagcacttggctcctagctgatgaaatctttcctaaatcaattaaatctagatattaacttctcattgggtttggggaaacagggaccaattcctctgttcatgtggttttacattctggggcaagttgctgaggagttccaaagacataaattaaatagaatctggattagcacagccattcaatacaaaattctcttgtagagccaagaattacagcacctctatggctttcttacttcccaaagctgcggagaacttaaaaatatggtcaacattatagtggtaaccatgagctcatggtctaggctgagagatcagccactttccttagtcagccatgagatcacggcctaggctgagggatcatctctattccttaatcctttcagtctagaaatgacagatgttttatactgagtaataacatattgtctccaggctctggagagatagtgcagcagttaagagcactagctgctctttcagaggacccagattcaattcccagcatccacaggcagctcacaatgagttccaggagatctgaagccctcttctgtcccctgtgggcactagatacaaaagttatatataagcttacaggaagacaagcatccatatacataaaaatagaataaaatttaatgagactgtttacaggaccagtttccagtttctccttaatacagccctgaaataacacagatctctacaaatcagtcttgcttctgacacattcatagcttccttgtctaatttatatccaagtaagaaacccttaatactgggctggagagatggctcagtggttaagagcactgacagctttttcagaggtcctgagttcaatacccagcaaccacatggtagctcacaaccatccaacttctggcatgtaggtgtacatgcaggtataacatttatatacataaaaccgctttaatataaaatttcatttttttccacattgtgtcaagctggttttggatctctgaagaactacctccatgtcttcctgccattattttgttccttgggaagcctatattgtttgaatggcccttcctctgttgtcctagttttcatgccttgacatcatgcagcatctctaattatcttttcaggcagcacagaacatgacacagcatctgccaagcgcacagaaactattgtttgactattgcatgcaaatttgagatgttttgttatttctgaaggacacggattctgcaggcattctgcgcctacacgtattatgttccagaaaactcctttgtgaaagaaatttttagttgaaggtcacctttatggtggcaataagtgttggtggatcaatggcaacccattacgaagactttcacatttactgaattagaacattaaaagcagcattaaatagaatattgacaacactttgccaccttaaattaataatgctctttcttcccaatttccttcaaattattatttgatttgttgtggcaattattaatgtattaaatggtaactgtggtctatgtctggccttacaaccaaatgtttttttttttattttgtggtgtaaaatagttgactctgactccaagtggttcaccttcatgagttctgtaccccaaggtcatgaagacttgttcaagcttgagattaaaaaaaaaaaaagattattctaattttgactcagcccagtttctgcttctttgtacctttgagttcctgtcacatgtctcccagaagtcccctgtacatgtttttatctctcccaagacaccatttataacaccctttctcctctttaccatctatttaatccctcattttcagcttcctttgttttttccaagagcccccaaagcacatcattaccaccccagcttggcattttctgggattctaagtcttatggagaagacaaggtttcaagtatgtatacaatgagaagaacttcagctgagaagcaactcaagtcctctattagagaatttgtgatgctttcatggttctttcaggttcagtatagactgtttccattttggattcatttgacattaattgttacacacacacacacagagagagagggagagggagagggagagggagagggggagggggagggggagggggaggga

SEQ ID NO: 542 - DNA, 680 bp, mus musculus; identical to SEQ ID NO: 23

SEQ ID NO: 543 - DNA, 314 bp, mus musculus; identical to SEQ ID NO: 24

SEQ ID NO: 544 - DNA, 477 bp, mus musculus
gcggccgtggccggctgcccgcggcttcccaagccccgcctgaaaaaggcgggatctgccgccgcacgtacgcggcgcgcgtgggatgtgaggggcgctaaggggtacgcggctgcacgcgcgcgctgctgattggctgccgccgccgcctaagcttccttaaagccccggtaacacgcacacaaacctcctgggtctcgggctggtaccagccagctccgttcctgcaggtcccgccccggatcaagtcttgagaagtgctccgagacttgaaggccattgggagcccacgcctgagctatttttaggggctctagacctccccaacccgaggcccctcttccggaaggccctcctcagatctgctgactcctcagctttaagttgttccatgtggtcctacgcttccaacaattaattacagaattaagtggaagctactggtcccacccccacctccccctacacacacaaaca

SEQ ID NO: 545 - DNA, 607 bp, mus musculus
aatgcgcctcgtcaattggcccggctacatcaggctgcagcggcaaggagccatcctctataagcggctcaaagtacttcctgccattaaccagttcaccatgaccctggacaggcaaacagctattcagctgcataagcttgctcacaagtacagatcggagaaaaagcaagagaagaagcaagggctactggcctgtgctgagaagaaagctgctggcaaaggcaacagcccaacaaagagaccacctgacctccgagcaggggtcaatacagtcaccacttggtggagaacaagaaggctcagttggtggtgactgcccatgacatagaccccattgagctggtggttttcctacctgcagtgtgccgaaagatgggggtgccctactgcatctttaagggaaaggccaggctggggcaccccgtctacaggaagacatgcaccactgttgccttcacacaggttaactcggaagacaagggtgctctggctaagctggtggaaactattaggaccaattataatgaccagatctgctgccactggggaggcaacatcctgggtcctaagtctgtggcttgcattgctgagctggaaaagaaaa

SEQ ID NO: 546 - DNA, 607 bp, mus musculus; identical to SEQ ID NO: 545

SEQ ID NO: 547 - DNA, 7197 bp, mus musculus
cacacattggagctgagccttgagcggccatatctgccgccgccgcagctgtgagtgcagcatctgcgcttagctgcctccgcgccgctaaggttcgcgtcgctcgcccgtggcccgtggctgttcctgccttactaccaccggtagaaccctctcctcctgacctgcctacctcgctccttctccgccgcaccccggctgctcacaccatggatctcggcagcagcagcgactcggctcccgactgctgggatcaggtggacatggaagccccgggttcggctccgagcggggatggaatcgcccccgcagccatggcagcggctgaggccgcggaagccgaggcccagcgcaagcatctcagcttggccttcagcagtcagctcaacatccacgccaaacctttcgtgcctagcgtaagcgcagcggagttcgtgccgtccttcctgcctggatcggcccagccgcccgcccccacagcctccagctgcgacgaaacctgcatcggtggcgccggggagcctgaaggtaaacggatggaatggggagcacctgtagaaccttccaaagatggccctttagtgtcgtgggagggttccagttcagttgttaccatggaactttcagaacctgttgtagaaaatggagaggtggagatggccctagaagaatcttgggagcttaaagaagtgagtgaagcaaagcctgaggcttctttgggagatgcagggcccccagaagaaagtgtcaaggaagtgatggaggagaaagaggaagtaaggaaatcaaaatctgtgtccataccatcaggtgcacctaagaaagaacacgtaaatgtggtcttcattgggcatgtggatgctggcaagtcaaccattggaggacaaataatgtttttgacaggaatggttgacagaaggacacttgagaaatacgaacgagaagctaaggagaagaatagagagacctggtacttgtcctgggccttagatacaaaccaggaagaacgagacaagggtaaaacagtggaagtgggccgtgcgtattttgaaacggaaaagaagcatttcacaatcctagatgcccctggccacaagagttttgtcccaaatatgattggcggtgcctctcaagccgatttagctgtgctggtgatctctgccaggaaaggggaatttgagactggatttgaaaaaggtggacagacaagagaacatgcaatgctggccaaaacagcaggggtaaaatacttaatagtgcttattaataagatggatgaccccacagtagattggagcagtgagcgatatgaagaatgtaaagaaaaactggtgccctttttgaaaaaagttggtttcagtccaaaaaaggacattcactttatgccctgctcaggactgactggagcaaatattaaagagcaatctgatttctgtccttggtacaccggattaccatttattccgtatttggatagtttgccaaacttcaacagatcaattgatgggccaattaggttgccaattgtggataagtacaaggatatgggcactgtggtcctgggtaagctggaatcaggatccatttttaaaggccagcagcttgtgatgatgccaaacaagcacagtgtggaagttctaggaatcgtttctgatgatgccgagactgattttgtagctccaggtgaaaacctcaaaatcagactgaaagggattgaagaggaagagattcttccaggcttcatactttgtgaacccagtaatctttgccattccggacgcacatttgatgttcagatagtgatcattgagcacaagtctatcatctgcccaggttataatgcggtgcttcacattcatacttgtattgaggaggttgaaataacagccttgatctccttagtagacaaaaagtcaggagaaaaaagcaagacacggccccgctttgtgaagcaagaccaagtgtgcattgcccggttaaggacagcaggaactatctgcctggagacatttaaagattttcctcagatgggtcgttttactttaagagatgagggtaaaacaatcgccattggaaaagttctgaagctggtcccagagaaggactaagcaatctcttttgatgcctctgcaccataatgtgtgaaagattgaccgcaacctactgcccattgacaaacttgtgcccatattttgcagagaaatttcacagcaaaaatccacgtgttgtcagctttctcatgttgagacttcagtcgtgtcactcctgaatgcatactccagtttcctccctctatagcactctgcttccttggacaaatcagtaatagctttgtaagtgatgtgtgtgtaattgcctacagtcctaaaaagaatatattttaaagttttcatttccgtttgggatatctagacatcctttgttctgtggggaacagtcagtgttggtgtgtgtatatgttgaagataactaacatgtaaataaaacgttgcgtttgaaacttcagcatttgaaatgtgtttgaataatgcttaaattgggatggagtactgtttcattagattattttctcaagtaattaactatacttattacctgggctgagaaaaaggtccattcatagttggaaatgagggatttgtcgaaaccacacaggtttgtactaaaggaaaactacgcgggtaggatgggatgcagtgggggtgggatggaacctatcttagtgcccttcccaggtatgttttctgtgtctaagtaatattagtaaaggagtttttctacttacccagttattatctgaaaatgattatcctatttgtcttccattaggtcccataactttcagctcagctaaatcacatatatacttaaggtttcagtcaaatagactcgtctctgcaatctgtcatttttagcatgctttgctgtttttcactgaaatttggggagcaagacactgtgggtacaattactgaaaaggtaaattgttgcactatgtgtcatttatgaaaaccaaggacttgacatgaggaatctgtttctcagggtttacggttcattcccatctattctccacaaattcttaaggaaaacaccagttgtcgattctaaggtagttagatttattgctggaaggatgactttatggcccttggaactatcaacagcgggagaattttctgtcttggtaagtgggtagtgatttagtgtaagcggttgcctggtagtgtgcagaaccagtttctcttaggcatagctctctacttggagcaagaaacttctttcctaatgactatgagcaagccggtagatgtagacactgcctgccacatacctgggcctgtgctcaggtcatggcagtgtcttttccatggtcttttcctttgcgtgctcatagaactcttgacttcatgtatcaggtcgttactgactgatcttgtcagagttccaacagtatggctcctatgtgcatcatccacatcagagcacccacttgagaaaaagattttaagtggttgtgcatcagctaccttaatccagaaggggcctcatactgtgatgggcacagtcatttaatcatgagtgtggatagcatgagtattgtttaatctttagtcataaagagttcctcctcttggtcgtgttaaactttgtatagcaagccggccagtctagaacttgataaaaattctaccttagcagtcacttattgaggatttccctgtagcccatgttggctccactgtgtaccctaggttggcttgaagcttgtgactgtcctccttcagtatcctgggagttaaaattcgagatggaagccactacactaagctcttggcagtcacttaacaaagttgttttaatgctgcattagtgtcatagtaatttaccaacatatgtgtgtattatgtacaagtatcacacgtacaacacacacacacacctatcagttggctaaaagaaaagccaggacagaactgtttccattcaatctgggcaattttcaaagactagtttctaaatggttgtgtgtgagagacacataaattccagagaaaaatgtcacaatctttaaaagttattttagaaattagttcgttgcaattcagtgaggatcatattatgcaggaagttggggacaccagagtctagcccttttaagatagtagatccgagcctggcattgtggcacactggcttgcaggctaagtaagtatttggaaagctcagtcaagaagatatgtgttcaaggccacccttggctacactgtgagcttgagaacagccatggttgcatagtgacagcctgtcacagagaaccaccagtagatctaaacatccagtaatatttctgtataacttctaggtattttatagttattaatatttaatatttttcagtatttcaaactaggaccatttaccactacagcactagtttgcctagtatggtgaactatttataaagctataacaaggggggtgccctttgacagagtttctgctgtctccaattaatgttaaattaacttttttttttttttttgagacagggtttctctgtgtagcagccctggctgtcctggaactcactttgtagaccaggctggccttgaactcagaaatttgcctgcctctacctctgcctcccaagtgctgggattaaaggcatgtgccactagtgccccccaccccccaaattaacttttaactctctgatggtttaaataagaaaatccctcatagactcatatatttgaacacttggttctcagttggtgatgtgggttgggggaggtttaggaggtgtggccttgctggaggtagcatgccacaaggggtgggctctgattgtttatagtctcatcccacctccaggtgctctctctgcttcctgctttcagttgaggatgtgagctctcagcttcctgctccagttgccatgcctgctgtttgctgccatgcttccctgccatgatgatcgcttatctctctggaactgtgagcctaaataaacccttcattctgtaagttgcttctggtcatggtgttttagcacagcaacagaaaagtaaccagtggttggaaaccagagagtaggctgttgctgtgtagaccatgaccatatttcttttttagaggaatatggaagaccgagactttggattagaaaagtggttggatgctttaagcagacagtcggagcatggaagattagttcggagagtaatgcagaatgcagttgtctggctcacaaggtttcagaagggaacaatattagcagttggactagagcccatttctgtgctattttggcaaagaaactgggtgtcttctgcccttttcctaagaattcacatatggctaaaattgaaaaactagagcgggaattctagccaggaaactgttgcatgtgtctagaccttgacccccttctgacatgtttttcttgagcattttcagatctctgattaaggcattggatctattttctgttgattctgctacagagagaaggcttcgtgtttcattctatatcatgtgagttgataccgtgttggttttttttttgccatctttttaagggtcagttggttataaatgcatatagttattcctctattacactgctctttgtttttatatgccaatatcatgctttataggtacttccattttgaatatgcaatagcatgatgcttacaaactttgttctttttttccctcaagatattctgggacatttgtatgtccatattaattttaggattttctttctagttctgtggacaatgccactagtattttgacaggaattgccttgaatctataaattattttgtatactatgggtattttaacaatatttttttctagtttgtgagaactgtggagtcatttctttggcacaggaaattacagtgctgcataatgctgtgtttgtggcatgattattgataatgcttttgcgagtctatgataaagaaaatgggaaaaaagaaattcaaaatgtacagattgcagagataaagattggctagaagagggactgtaattgttaaggaggttaacaccattaaggagaggcctgctctgcacttgaataagtggaggggtcccttcaggacaagactccacccagctaagcttcggacttgggaaagagagtctcagatggtttctgttcctggaatgcaacagcaaacataagctgctgctagtggggatcaggggagtgtggagccatcccaagtttgcagcccaatttgacagtgtcgttcatgtggtggtggcttcagagggatgaaaaatgaaagaatgaaggggctgtagagccatagcagatttcagagagccagtgaggctaagcagtgtgtgtgtctgcatgatagctctgtttgtttgtgaaaatgaacccccaagttgttagtgatgttagagctgttagacctctgcctacgagagctatataaatgaagcaaatccagtctaattagatttatgtttcaggtagcaaaactgaaaggacagagccatctaaatcatttgacatgggacatagagctacaagatttagtgttgtgcccttctgggttgtcttcctttgccccatttttcctttctatgctccatttcctccattttggaattttatgctttgccattgtatgttgcaaatgtgtaatttgctttttttttttttaatttacagggagctacaattaagagattgccttgagtctcataagagactttggatggtggacttttaagcagtgttggggccattaaagactggggacatttttaagcttgactggatgcagttcgaatgatgatctaaccatgagcctgtggaggccatgaagtggaatgtgatggcttgaataaagaatgactcctctaggctcatgcctttgaccactcgattcccaggtggtggtgctggtagggacgattaggaggcgtggccttcttggagaaagcacgccactgggagcaggctttgagggtttatagtcttacctcatgtccagtttgctttctctgcttcatacttgtagtagagtgtgtgagctatcagcttctgcatccagttgccctgcttgccttttgctgttgggcttctctgtcatcattcatgatggacttttatccctctggaaccattagccaaaataaactcatttttttctg

SEQ ID NO: 548 - DNA, 7197 bp, mus musculus; identical to SEQ ID NO: 547

SEQ ID NO: 549 - DNA, 1618 bp, mus musculus
gctccagcagcactctgttttctactgcagtggaaactgatgaaatcccagctaaaagaccaagatgattgcttcattcaccaagtgaagaacagtctctacaatgctgcgagttcatttggattcccgttccagctgaccacaaaatccatggtgtcttctgcttgtaatgggacacggaatgtggccccttctgcagaggtattttcaaactcttcatcttgtgaactgatgagttctgggtcgtgcagcagcatgctgaaactgggtaataaatctcctaacgaaataagtgactatccaaagatcagaatgacagtgacccgaggtcagccacagagagtcctgccctcctttggttttatgctgaaatcggaaggctataatagaaggccaagtggtcattgccatagcaaaagcaatccagagagttccttaacatggaaccctcaggagcaaggtgtaacagagatgatttccgaagagggtggcaagggtgtgaggtgtcctcactgcaccatggaggaggatgtccaaaaagatgaaagagaaaaatatcgaaagttattggagcgtcttaaagaaggtgctcatggaagcatgttccctcctgcagtttcacaccagacttctcagagaattcaaatggacactttaaagaccaaaggctgggtggaggtgcagaaccatggcgtcagaacaacccattttgttcccaaacagtatagagttgttgaaacaagagaacctgtctgttcaatgagaagtgaaaagctgatacagagaaggtggtggtgggactccgatttgaaaaggaatgcacaaaaggacaccaaatggagcctgatctgtcagaagtgtctgcctgacttcgcctgggaagtggaagcaatggcttactcagaaggaaaatatcagtgcttgagccaaaggaaaagaacttcccaagcaaagagaaggacagaagaacagaagatctctttgaacttacagaggacatggaaaaggaaatcagtaatgccctgggccacggcccaccagatgagattttgagcagcgctttcaagttgtgaatcacccgaggagatatccagaccttaaagaactatcactggctcgatgatgaggtcattcatttttatatgaatcttttagtggaaaggggtaaaaagcaaggctatccagcacttcacgcattcagtacattcttctatcttaagctaaagtctggaggttaccaagcagtgacaagatggaccaaagctgtgaatctcttcgaacaagaacttgttctggtacctattcatcggaaggtacattggtgcctagtagtgatggacctaagaaaaaagtgtcttaaatatctggatgctatgggacaaaaaggccatgggatctatgagattcttaccaaaagaaatacagatctcaacctcttagagtggactacagcatgaagccacatgagattcctcaacagttgaatgggagtggttgtggaaggtttacttgtaaatatgcagattatatttctagggacaaacctatcatattcgctcagcaccagatgcctctcttccggatggagacggtgtgggaaatcgttcaccagcagttg

SEQ ID NO: 550 - DNA, 1618 bp, mus musculus; identical to SEQ ID NO: 549

SEQ ID NO: 551 - DNA, 1416 bp, mus musculus
atgtcggacttctacaagtttgagcagcagctcaaggggaacaaagaagaacgggacaaggagaaccggcaccataagcgtagtcacagtcgctctcgaagccgagatagaaagcgcaggagctggagccgagagcggcgcaatccagaccagcgcagtgactctcaggataggaggcggcgacgacgaagccaacatttgaccagaggcgctaaagaggagcagggtggatggattcgttccccgtgccatgagaagaagaaggtgcgtaaatactgggacgtgccgccacctggctttgagcacgtcaccccaatgcagtacaaggccatgcaagctgctggtcagattctagccaccgcccttctcccgaccatgactcctggtggtctggctgtgaccccgatgccagtgcctgtggttgggagccagatgaccagacaggccagacgtctctacgtgggcaccatcccttttggcatcaccgaggagtctatgctggacttcttaaacacccagatgcatctgaggggcttgactcaggcccctggcaacccgatcttggctgtgcagataaatctagacaaaaattttgcttttttggagttccggtcagtggatgagacgacccaggccttggcctttgatggcatcatcttccagggccagtcattgaagattcgaaggcctcatgactaccaaccactgcctggcatgtcagggagcccctctgtttatgtgcctggagttgtatccaccatagtcccagactctgcccacaagctgttcatcgggggtttgcccaactacctaaatgatgaccaggtaaaagagctgctgacatccgttgggattctcagggccttcaacttggtcaaggatagtatcacagggctctccaagggctatgccttctgtgagtacatggacatcaacgtcaccgatcaggccattgcgtggctgaatgggatgcatctaggggacaagaagctgcttgtccagagggcaagtgtgggagccaagaatgtcgctctgagcatcatcaatcagacacctgtgacccttcaagtgcccggcctgacgagctctcaggtgcagatgggcggtcacccaactacggtcctgtgcctcatgaacatggtgctccccaaggagctgctggacgacgaggaatatgaagagattgtagacgacgtacgagacgagtgcaacaagtatggactggtcaaatcgattgaaattccccgccccatggatggtgttgaggtgcctggctgtggaaagatctttgtggagttcacttctgtgattgactgccagaaagctatgcagggtctaactggccgcaagttcgccaacagagtggtggtcaccaaatactgtgaccctgactcttaccacggtcggaacttctgg

SEQ ID NO: 552 - DNA, 1416 bp, mus musculus; identical to SEQ ID NO: 551

SEQ ID NO: 553 - DNA, 700 bp, mus musculus
tttccactgctgcttaccgggactgggaccgagagcttggaatgggacctcagggctctgtcggccctgtgtagctgcgtttttcaccttatgccttcaacggaggtcctgtattggcaattgctggagaagatttttccatcgttgcttcagacactcggttgagtgaagaattttcaattcatacccgagatagccccaaatgttataaactaacagacaaaacagtaattggctgcagtggttttcatggagattgtctcactttgacaaagattattgaaacaagattaaagatgaacaaggccatgagaacgggggcagttgccgcaatgctgtctaccatcccgtgctcacggcgcttcttcccttactatgtttacaacatcattggaggacttgatgaagaaggaaagggagctgtatacagctttgacccagtgggctcttaccagagagactctgtcaaggcaggagcttcagcaagtgccacgctacagcctctgctgcacaaccagactggtttcagacgtatgcaaagtgtggagcatgtcccccaggatcctggacagagctatgaggctggtgaaagatgtcttcatttctgcagccgagagggatgtgtatactggagatgccctcaggatctgcatcgtgaccaaagagggcatcagggaggaaactgttcccctgcggaaag

SEQ ID NO: 554 - DNA, 700 bp, mus musculus; identical to SEQ ID NO: 553

SEQ ID NO: 555 - DNA, 630 bp, mus musculus
atggcacccagccggaatggcatgatcatgaagccccacttccacaagcattggcagcagcgagtgtacacttggttcaaccagctaccatgcaagacctgcagactcaaggctcggcaggagaaagcacacagcattccccctcgtcccgcgtccggccccatcaggcccactgtgaggtcccctacagtaagataccacaccaaggtccgggctgtcaggggcttcagcctagaggaactcagggtggctgggatccacatgaaaatggtttgcaccatcagcatctctgtggacccaaggaggcaaaacaaatccactgaaccgctgcaggccaccgtgcagcgcctgaaggagtactgctccaagctcatactttcccccaggaagccttctgctccaaagaagggagacagttctgctgaagaacttaaactggccacccagctgacaggacctgtgatgcccatctggaatgtatacaaaaaggaaaaggccagcgtcgtcacagaagaagaaaactctaaggcttttgccagtcttcacttggcccatgccaatgcctggctctttggcatccgagcaaaaagcgcgaaggaagcttcggagcaagacgttgaagagaaaaag

SEQ ID NO: 556 - DNA, 630 bp, mus musculus; identical to SEQ ID NO: 555

SEQ ID NO: 557 - DNA, 5135 bp, mus musculus
catttcaaaaatgtcaaatttatattaccagaagtatgatcattatatgtgttgtcacgtgtagtcactgtaattacagtcattcatgctagggcaatggtatggagagaaatcagaaagacaacaacatgattttttatcatcaagaaattaaattttatcctttggaaattctacagtctatagataagaatattttagtatagtctttagttggaagaaatttaaaagaaacaaagtgacggtttaaaatacctttacggttatatatcttaataatgcttataaagtctgtgtttacctcaggtctttgcattccttgaagaataaaatgagaaatgtttaactcatgaaaatgcatttctaacatagtctttaaaatcttttcaaagtgctaagtcaataataatcttgatgcttggacacactaaaattctgaatacttctttaaattaaaagttaatgtgtacttttattacctttttactaaatgggttcaaacaatataaaaattataaaggtagtagtatataatgtatttcaaagtggcaaattatatattgccaaagtactataaaaaagtgttttcttcaagtgtcctcacaaaaaacagtattgaatttgagtatttcaaaataactcttttctagtagaaaacacggcaaacaaattgaaagaggtacttgtcatcagatcttataggataaagtgtttccattaacatctgcctcctgtaaacacacttgtaagctgaatccagaaaataccatcgtggtgcatacagactgtaataattattgtgactaaaaaaatagatcatgtgagagaaaagagtgaccaaaaagaagtgaaaaattagagaaaaaaagtagaggcatagcacacactggtgtgcatatatcaggaactacaggaatagggggggggagcagaaaaagcagaagggaacaaggatatccataggcacaacaaaaggattgctcattaacaaagtgattgtggaattcagaagagcagaatgggagaggtagaaatatttcctctttgatgtgaactacacatatagaaataattaatatttaccaaatgaaatcaatttacatcaggaaagttttagtatcagtttaagtttacaatttctcatcaagattatgatgatcaaatatattagatatgaattttctatataaaccataaaatgctacactcatgctaagattgacagtatttctatttcaaaatacatagcaaacctctcattccagagagggctacaaatgaggtcaccaggaaaaagaaatattaccttctggtccatttccaaattctatcagaatagtagagtcaggccaagagctggctttgatccagagcagacaccagttaagtggacgaataaaacagtgaacagtgttaaatgagaactctgtaaagaaaaattcctcaagaaattgtggaaggaataaattcccatctatgcataatacttatattattggctgaaaactatgatacatgtgtttcctatcttgtgtactctaggatttgaagaggggaaaaaaggaggcagagaagaaagaaagaaagaaagaaagaaagaaagaaagaaagaaagaaaaaaagaaagaaataaagaaagaaagaaacaactaaagaagattcagaaaagcccaagcatatattttcccttcagtaacaatctcaagcatcaatagatacaatatgcatgagaataatgtgcatttctatcagcactgtaaagctagcggagtaaggcttggcaagactaaatgactagtataaggccacttgttcaatggtaacgaggcaatattttagaatatgcttgtaatatatcaaatccctgatatttttcttttaaaaaaaacccttctacagaaagacaacataagaagactgagaaaacatcaaacaaccacataaaatacaacatttttgcactctactgatacaatggatactgtgaaagaaggtaagataaatggtaaaagttaaaacacgagttcctctatctctgatcatttaatgttcaaagggatcacattcctgttcattacatgagactcatatgtaaccactatgaaatactctaaaaaattacaccaaaggtgtacaaaaaaattgaaatgcagttgaaaaggaaagagaaataagctagacaaaaaaaagactacttttataaataatgaattaaggctcagctcggttaagagacttgctcacagtcagagaacttatcagtcccagactcaagatgagaactgaaatccctaaattggtaatccacagatgcgttcctttgcaaggcagcaagaaacaactgcaggcaagcaagcgctccttccagaacattctcacatttgagtgtgataaaaacaacaacatcaacaacaacaacaaagtgagccacagggcaggcagggaacaggcagagtcggttcataccaaaaacggggtgccagtcaccgtgataagatctgtgtctttctgagacccatggcttcctgttgggtgggagaatccgaactgggtttcttcctcgtgtccaaagaagtcagattcggggtgcacgttccactcggctttggctggggtcagtagctcggagacactgttttcacagagggtgctggagggggtcagagcttccgtgtccacagtcaacttattgctgggtgtcaaagcctgcggctccaggcttgagtttttcagggccaaggagccaaagagccccacgttcccggcggagacatcgtccatgtccaaggggctgtgctggtagccagccaccgaggttccgaagaagagagaggtatccagactctgggggaggtcactgggggcccccctcaaggcccgaggctcggccgcttgccccaaggaatggttgttgctgttattatccgcagggagacttcccgcgaggctcgagttcacagaggccacatcaatagtcaagatgccagagttgaccaaggccgtgtccagcaccgcggcggaaccgtggccaggcacatccgagaacagagacacgagctcggccccactgagatcgctctgccccgggctggtgagctcactgctgggcgtgagagagttggcagcttctagctgggccaggaggtcctggctgaggttgtgccttttggtcatgtgggtcttcatgctgtgcttggacgtgaagagcttgttacaggtggggaccgggcagcggctcttccacgcacccacgtcctgcaagtgcttcttggagtggatgtagaggctgctgcgagccgagaagcgggcacagcagccctccacggggcacacgaagggcttggtgcccaggtgggttatgctgtggcctttcaggtgctcggccctggtgaaggacttgccgcagccctcgacgggacaggtgaacctgcggtcgtcctcgtgcttccgcttgtgccttaagagcttggacatgctggtgaagttccagccgcagccgtcgaagtcacacaggaagggtctctccccggtgtggctgcgcaggtggatcttgagcctgcaggccttgtcgtactgcttgctgcagccagggaaggagcaggcgaagagttcctgttccctgaaatgggcgcggttgtgcgagaacagggcgctcaccgtgatgaaggtcttcttgcagcccgaaaacgcgcactggtagggcctctcgggctcgaagtggctgcgctggtgggtgctgagcttggcctgcgtggggaagctctcctcgcacacctcgcatttgaaggagttctcctgctcgtgccccttcatgtgcgccttgaggttgtagacggtggtgaagctcttgccgcagccctgcaccgggcagccgaatggccgcagcttgtcgtgcgactgcaggtgccgcttgagcttgtaggaggtggtgaaggtccagccgcagccgctgagcgggcacttgaagggccgctggccctggctgctgctgtgcgtcagcaggtgcaccttcagctggtgcttcttggcgaaggtctggccgcactgcgcctccgggcacaggtacagcaccacgcccgggcccgggcccgggcccgcgggcccgcgggggctctgcgcggcggcggcggccggggcctcggcctcctcctccgggggcgccgggcaggccgcgggttccgccggctccgccagcaggaggtccggcggcagctcggggcagtcgcccagctgcgccccggcggcggcggcggcggcggcggcggcagcggcgggcggaaacccggcggcggcggctgcggggcgatcagcgcccccggctgcggcggcggctgaggctgcgggaacggcgcgacccccggctcccaggcgggcagcgggggcgtggtcagggtgaggacgccgttctcgaagcgcagcagcaagtcctggttgtggatggtgatggtgcccgcgaaggccgccgccgccgccgccgccgccgccgccgctgggcccgggccggccgcgggaagcggggacgcggccgggaccgcagacagacagcggggacccggctcgggacggcccgctgggggcccggcgctctggcgccgctcgggcctcgggcctgccccggcctcctccctccgcacgggcgctccggcctgctccgtgcccacggtttctacatcgccacccaccgggtcaagcagcaacaggaagaagtcgtcgctgccgcctctgctgccgccgccgccgccgccgccgccgccgccgccgccgccgccaccgccgccgccgctgcctcctcctcctccgccagcgccgccgcctctgccgccgccgctgctccggtgatcgggcctcggcgccaaccggttcaggctcgggcccaggccccgggaggccctctgggcctctgcgctccgcggccccggcccgccatcttgggccccccggagcagtaggaggcggcgcgtgggggcctgacaagccagagaggccggggctcggtgcaccccgccgccacccgccgggcagccgccgccaccggcgccctgcggtgtcccgcgagccgggagcagcctcgggatttccatctcggcgtcggtgaggctcggctggaaccagagccgaggcggaggcgcgacccc

SEQ ID NO: 558 - DNA, 213081 bp, mus musculus
aactgcgccggggctgtgtgtgtaggcagcagcgccagaggaagaggagcacgaggatgcagctgcgaccgcggccccaagagggagcagccactgttctgtggtcgcggggccaaagcaattggaattaagcctggggggtcctgttgctgagaggaccggggcagacggtcctgccagaagcgcaggcctagtattccgggagagttcggtctgctgggcgaaggcctgccgcctttgcttcctcctggccctccaagtcgatggtggtgaagttggtggccgccaggggcacaagcgccaggctggttctcttgcacccggcgcttatctggccctgcttgaacagctgcgacgccgcctcctctcttccgcggatcccaccctcagcggcgggggagggggaaagttttcccctccgcaggggctgcatggtgcgaggcgacaacaagaccttaggagagtaggggtgagtagtggcaccgcagtctcctggtgctcaagctgttttctggtcttagggtctctggggccccagcaggccaatgaagctctgcactctcattcagaagcttctgacacccttcctgcatctgctcgcgggtaatttcttccagttagttttccttttgaaagccgtcactttgtgatctcaatcctggcttccagaaacatagtgtcagtgattaaggcctggggttgcttcttagatgctgatgattctaagtacagtcgtgcaccttcttagtctctggtctggaaacagattcttctagtgccctgttcacattttactccttgttctaactgtggctctgactcttgatcacgggagacagcctgacctgacctgaggcttgtcaagagcccatcctccgcattgctgatgcttcatgacgaaagaattgaccagatagcttgagtggtaccttactttgcagtattgtttatactcatgtgcagtaggcaagccatatgcctagcccctgattcttagcatgtaaagctaggcagatattagttatgttaaataatagtgataataagacaaaactagtgacatgtcctatttgacaaccaaagtaccaccaaacttgagaagtggacaaagtaaaatattgacaataggggaaacattttacaaagtattcttcatcaaaaatgactcacgtcttcatttaaaaatgtgttggtgaaacttagatactcttaataaaaataaagatagttgtgacttatttgttcttcttaaattagagtataaggtatagttgaaaatagtcaacttctctcaaaaacatttggcccaagacacccaaagtgagactttggataccatgattagataaggttctaaagttgcaaggcgtttttcacaattattttgaggtgtgagactgttactttaaaagcagatgtgaaaatttacagttcccagttgacccttttcaaacgtgaactcaatttgaattgatgtataattttaattgcaaggtactcctgtgggctgacaacaaaagatgggttcttttatttcactctcttccatcctgacagttttaagccatttcaggtctcttatctaaaaagaagtggagaaaaagaagcacattggtggaaaagctaaatttagttttcggttacctcttttaagctagagaactttaaaaagtatatagatgctgtgtgtgattaggtaactttggctagtgaatctgttaacacttccagtttcttgatagttttagggaaaatgtcttatatggattgcttttgtgtttgagatgttcctgtgtttaaagtataatactaggggaaaaaatagttttctacctcgatgtgagttatctgctatgcattggcagacaggcatgcttcaggagcctagatttcaaacttagaggtcgtttctgtttgcaaaaggtcttgatgaattttactcctaattatttgaaatactattacatctaaaggaaaagaatttgacaataatgaatatggtcaagtaagtaccacatagcctagcattcccacaaactgtcataaacatatgggaaaatgatattttgttttgcaagtgctgttaaggacttgatcattaaattctggaataaagtttgtttttgctgggttttatttattttattttcagagatttttaataagttttcattttttagattttcactcagtgaacatcactgtggtaggcaaggagaagagtagattagacacaggttccagggtctgttggtgttgcttgaagcagaatatctagaagcatgagacactggatctggttgctggtaaccagtaatagaaaaaatttaaaaagccaactgaaacagttcgaggacttcaattgggagagaagcatacagataggctatattaatcaaaacatagaaaagtacagaagaagagctaaggaaaaaaaaaataagagtacaggaaaattactgaagtctagggatttcctgagaaggcttcatagaaaagtgacactttttcttcaaattgtaggctttgttggaaggaggaaacatttatcataaatttattagattaactaaaggagaaaaggattatttatagcagttaactttcttgacatgagcaaacttttctatgctatattttaatttaataacaaattaaatactaattactttataatatacatgttatacaagttagttttaaaataatcatcctattttggcacacataagaatgttttctaaaaagatacaaataattaagttcccatactttataaatgtacatatttcactgaatagtaaatcacagctatagtcaaagtgttttatataaaactggtacaataaacacgaccttgtattattaatattccccaaaggttatttccagatacattctatgagcaaaatgaattttgattgattagttatataacttggtttattatatactactgtgtacaataaagggaagggctgcattattatagtcttgaaattaatactggtcaaagttctaatatattaatgtgtatgttaatatttagcaagtaacatatgtttaaacttcaatcagaaatctttgtaaaacttattttagtgcatttctaatttttttgctacattaaaaattggttaacatgttaacagtctctaggttttggtcagctattgtaaattaatattttcatgcagaaaaataacaaaccacatagcaattacaagatatcactgatttactcttaatttcttttgcaaattttattgcatttgtaaaaatgcaatatgaattcagcaaaactgtattttcattattaaaatactatttattttattttctgtcttttatttgtcagaccaccaccattactacatcctatcataatagaccacacatacttgaaaccaagggtaaagttccatctttaaatattaaacagccattttagacaacacatattttgtgatggaacctgaacatcatttatcaaatgtggtagggaaagttgtcattttgtattataaaacagataggccagatagcaattgctatagaaatgaagtaaaatggattatttcaagcttttaaaaccattttcttaaggagaccttctacaatggcagaccttgtttatcttcctggtcagtcatctggaagcaattcctcacaaaattggttaacttgctttctactttggaaagagaaccaccttttcctatacatgcttgcagtcttgctttaatgtttattgtagaactaagtccctttgatagtttaggaagaattttctcctcctcctcctcccccctctttctacctccttctccttcttatcatggtgttgatagttttaagtcttttccatgctggttttaattttctgcatttttagttgttgtatcttttggggaaggtgtttcaagacagagtctgcaaccctgactgtcctggaactcactctgtagaccatgttggcctggaacttagatcctcatgcttctgcctctcagatgctgggcttaaaggcttgcacctccaatggcaggctagttggagaatcttgtagagatttcttctctggaactttgcctctttgtagtagtttggttttgtcaacttggcacaatctagagtagtttttaaagagggaacctcaattgaaaaaatgtccccaccagatgagcttgtggagaggtctgtggtgtattttcctgattgaagattgatatgggagggcccagcccattgtgggtggtaccatccctatactggtagttctgagtgctatgagaaagcaggctgaacgagaatgggaagcaagccagtaggcagcattccttcatgacctctctgcatcagttcctgactccaagttctgcctatgtaccttccccaactttgcttcatgatagactacaagctattagatgaaagataaccttccttcaaaacttgtgtttggtcattgtattttgtcacagtactagaaattctaagacaccccgtctcatcattgttgtttcatttatcaacaactttctttttcccccctgtggaatcttcctgccactgccaggggcccaggtcactttccagttgtacttaagaattgtccatactcttcatcttctgactctgcatcctcttctacagcggctatgtgttgtgcacagaccctgacccattcttcaacctgaagagcaaggtagtgcaatttcaaagtccctaagggaaactgtcagttttaaagacattttcaaagttgccagtgttactttaatgtgactggcttcataatatacagttctacattctctagcaatgctggacagttgcaataatctgtagctgtcagccatctatgtgatcatgagagaaaaaaaaccagtactctccattgtactgtgttgctacattgtaatgttttagtaggttatatgcattcagttcagttgttattcatgagtttttaacttttgattgagttactgagatgtaaccacatcacaagttgagtatcatctgtatcatattttaaaaaagttgtatgtcccccaacataaactcacattttagaattacaaaaaatgtgcacatttactccaagaagcaaaatacacaaacttcaaatttgtgaggcctctgtacttttcatctgttatcttttgctgcccacagaagtcttacttgataaatatgttactgacaaacaataattcattgtttctaggctcagcatataattgctgtttcacaaattatcatttcattgttattgatggttggggtttgggtggagtgtttccagttccttggtctcttgttcaaagacttgaaatacactgattgcaaagtagcaggggatctattcaaagcaaaggcacgagtgacagcaggccacttgagtgagtgaaaggatactcaaaagttctgtggagggatccatcccataatcagctcccaaacgctgacaccattgcatacactagcaagattttgctgaaaggacccagatatagctgtctcttgtgagactatgccagggcctggcacacacagaagtggatgctcacagtcagctattggatgggtcacacggcccccaatggaggagctagagaaattacccaacgagctaaagggaactgcaaccctataggtggaacaacaatatgaactaaccagtaccctggagctcttgtctctagctgcatatgtatcaaaagatggcctagttgtccatcactgcaaagagaggcccattggacttgcaaactgtatatgccccagtacagggtaaccccagagccaaaacgggggagtgggtgggtagtggattgtgggggtgggtatggcggacttttgggatagcattgaaaatgtaaacgaggaaaatacctaataaaaataaaattaaataaaaaaaagttctgcggatggtttgacggttccttttatatgcagatttaaaatgatcctattctaaagtatgatctttattatgtcaggactggacattttctacttgagcatatctctaacattttgtgataggagcttattgaaatcatgacttttatccaaaaattctatttggatcaaattgtcctagaacataaacttctaaactaagcaaaagacgataaaagccatttcagtatgaaagaaaaaaaaaaggcaaagactggaattcattcttcaagtattttagcaactaatcaaacaagtactttcacatataaattgtaaattgaaatttataaggaactgttacacagagttctcaccatcttaatcttgtgtcttatattatgacttattagtgatctttcaactgttgtcatccaaaacataatgattcatattaatttcctagttacaagtgcatcactgaagttaattttgtcagttttattctgtgatagaattttataactttgtaaaatgccaaaaattttatttgaaatctaaaactgaatttcacagattgataatgagaaaaatagccattttaatagtaatctttgttaaaaaaatactatgtatgaacttttagtgtctctatatccttttataatccttttataaccctgaattattgaactaataattaaacttgcttaattactgtagatatttgtattcattcttacttctgagctaagcaaattttattaaaaatgcacacacatatacacaatatatacaatatagactatattatttatttagaatgggttcctaatagtctgaaaagctgtgtgcatgtaagataaactattttttataattaagtaacttaactgaaagttgtgtgtagaaacattataagctatgcatgattaaaaaatactatgtctaactcaagagactgaatccctacattggttatttatttatttgttttccaaggcacgatttctctgtgtaacagccctggctgtcttggaattctctttgtagaccaggttggccttgaactcagaaattcacctgcctctgcctccttgtcttagtgagggtttctattcctggacaaaacgtcatgaccaagaaacaagttggggaagaaaaggtttattcagtttacacttctacattgttgttcgtcaccaaaggaagtcgggactcaaactcaagcaggtcaggaagcaggagctgatgcagaggccatggagggatgttacaaccacctggctaattacatttttatttttaaaacaaaatcttttctttgttgaataaagaaaatagtagaagttcgaaacttctgtgataacgtatggcttctttcatccacatccattcaagagtttatttaaaaacttcatatcttcatatagttacacttcagagtttaaaaatttttataataaaaaggatactgttttctgttctatcattctgtctcctgtcactatcttatattgtcttcacaattttttttcccatcttatggtatttcttgacatctacctgaaactactttaatatgtattaaatatgtatgagttaatataccataatatataatacaaatattttacacacagggaagttttttttaaatattggtctccacatggcttttttagacatccttagtgttctttatctctttgcctctccttcttctgccctatattccaatatccctcctcactttaaccctcgctttataccactttctcaaactggaaactagttcacatataaactctaatataagatatttagccgagcagtggtgatgcacacctttaatcccagcacttgggaggcagaggcaggtggatttctgagttcgaggccagcctggtctacagagtgagttccagaactatacagaggctatacagagaaaccctgtctcgaaaaccaaaataaataaataaataaataaaaattttaaaaaaggatatttaatttgccaggcaatatataattacacacttgaattttgccaggcaatatataattacacacttgaattttgtgtttcttttgtgtttcactttgtttgagacaaagtcttgtgtagcccaagctattagataaggatgagcccttcagcctacactttccaagggcagaaacaaatatgtactatcacacctggcttcatgtattatatactaatatattaaatggttgctgctaaatttattagaccaatgtctgtgcttatagatatttaaggctaatattattagattatcttatttcagtttacatgattttaaagtattgtgttattttgccaccaatcagtctaaatatctgtgattccatagaaacataaaaattgaggcataaaaaataggtattagattttatacttcagtttctcttaatttacaataatttgggtgagaaaaagtctaaaatagttgaaaatttgagtttttgtgaactggtatgtcttatgacttccttatactaatcagaactggattaatctttagggatattatcttaataagtagatgagaatgatttgtagttaatacataagtggataatatgtgaagatttctaaaatacttaaagaaaacgttaagtaatttaaacatcttttctcctatcttgtttattgatttatttaataaatctttatgtaacaaattacagttaatttaatttcagtaatatggggaattatatattgtaacattagtgtgttccaaattgcaagtcaaaatttcattaatttgcacttaaattaaattaaattaattaattcaaattaaatcaagaatttgttaagatttgggtagatgtgcagtcacacattttttttactagattctctgtcctatgttaattatggattatgctgtacagaaaaaaaatagccatagccatattagaggttaggaaaatttgaagttccttgctggtatcaaaaacttgatattgaattcaagtaagtgataggaattaaagtagggacacctaggttcaatgtactttaaaatattttctaagtattctatcactaattaggatactatataccttgtactgtgaaaggaatgcaaatagtagttaataaaatttgagagcccttattagaaatgtttggagcctaagtgtttcagatttgggagtttatcagaaattagaatacttgcataaaagtttgagttgattatctctagtctgaaaattagaagtcttatgttatcatatatctaagatcaagcattattgtcatggtatgaaactattccaatgttgaagcatttcaggttttgagctttcaagttagtgttaatcagtagtgaaagaaaatttaaggcaatatttgttgaaaactgtttcagatatagaaagtgcagtagcaatacaactgaaatgtaaactcttacacatttgtaaatacatacattttcattgatacatcagaaggagaaaataaaatgttcattgcaacccatagtcttaatatacttatactttcaaacatctgaaaataacaaaactctggggctcttctcagttctaaagtaacaaattgaataaatcaatcatgtatggtggtgtatacttgtaatctttatactcagaaagttgaggcaagtagattccttggcattcaaggcaagcttgacctatataaattacatactagcccaggctacaaatacaaatacaaatacaaatacaaatacaaatacaaatataaatactagtggtgttttcttctacctgtgttatgatgcaataagacctaaaggtcaacatttctaatattcttggattaaatccttctgtcaaaggtaacttctactccagttccttttgacaagttaacacagaatacccaggtacacataataatggtagttgtgaattatcatttatcattgatacttttccaagaggggataaaagctagttctttatttttctgacttctatagtaatactttatttttttttactgtgtaactcagggcttttaatttacaggttttagatcttatggctaatagcagggaatacaacagctgggctaacttctgttagaatagaaatttagctcattttgttgttttcgttttgttttgtttattctttttgtttgtttgttttagtttttttctcgagacagggtttctctgtgtcgccctggctgtcctggaactcactctgtagaccaggctggccttgaactcagaaatccgcctgcctctgcctcctgagtgctgggatcaaaggtgtgcaccaccaccgcccggctaaaacatacatatgtgacccgtatggggattgaacccgcaacctaggtgttattagcaccacgctctaaccaactgagctaaacagccaggctcatttgttttttaataattgccattctttctttttctcttcagctttgcctgtgacatgaaactttgctgtatgtttacatgtggaagaaagagactgaaaactttttacagagctaacaatccaatgcacagtagaaaatcgatttaattctcaggagtcttcatgagcagaggggagtagagaattagaaaaaatatttagaagataattttaaattgaatatgggggctggagagatggttaaatgagctggttacccttccagagcacccaggttcaattcccagcacccacctggtagccctcaagggtttataactccagttccaaggggtctgatgccctcttctgacactgggcacacatgtagtacataggaaaaatataaacacccatatacataaaataaaatgaagggaattattaagaattgaatataagtataccttatctcagtatacctagagaattagttaactaaagaatatggaattgataatgaaatttctcattaaggaataatttaagcagatgatgaagatattgccagaatgctttatataaaatgttggagctttgtcgtgaatattttgtttatctctctcctgtaattaaggtgttttataaaatcaagtgtagttgtatgtttgtagtcccagatactcggtagcctgatcggggaaacactgcttgggtctacaagtttaaaatcagcctgggtgaaatagatagaactcatctaaaagaaaaaaaaaagctctatttttggtaattaataaagatgtatttaaaccaacttaaagtaatgatacatatgtatgtgtgtatgtattttttattaatatatgaaaaattctcaaagaaacaagaaaaggaagtatggcctaggcatatgtggaacttaaactaggaagaaaagtaatctttaaagaaacatgtttgagataatgtacatacaaataacagtttacgtactgaccaggttatatttatgaatatgcatataggtaatagcaaaaaaaaagaggccatgagtttgagggagagcaaaggagttgcatgggaggggttagagagaagaaagggaagggggaaattatgtctttatattatcatttcaaaaattaaaaagattatacacaaaagacacttgtctttctcagtctatcagactatcgatacaatggaccccaaagaaatgggaatttcctaaggaatatcatgctgagagacgaaaaagacttcggacaaaggggaaatttgtctcctggaaagagatttcatagagttctaaaaactgggtagaacaggatgaaactgaatcccagataatgatgggtcaacagtgggtagaccagaactgtttaaatatttatatccttggccccctaaataaactttaattccatgtcaggaccctgaagactgacttggagatcttctttgatttcttcatccctcttcccattgtggccatattgaataaatctccttcatctgctttccactattctttcccttttctttttctttttctttttttttttttttcggtttattgaggatgagtgctctgactgagttggcacataggtcgtgatcccctaagtttgatcacatgtgtataaaatttatgaacagtgaatattgtattgctgtgtttttaaagaaaaatcacagtaacttgaaaaatataaagaagcagccttattgatgataaatgcttgagtgtagcttctctgacatttctagatgatacttcacagccaacttcctgttctctgttcctctggttcttataaattttccaccttctcttttgctataatccctgaaccttaggccatgaatgatgtgtgggaaaagctggagggaggaaagggaaggaagaaacaatgcaattatatatttaatttcagaaaattaaaaaaatgtaaagaagtcttgtttaaacttcaaatagccttttactgtgttatcttgtgcaaacatgcaatatcatcaactaagatgttgatcttatctaaatttctaattttataagcaattgtttggaaaaatatgcatttttcacatgtgtcatttcctatactccagcaccacacagagatatttgattttactatcaccacagagctcttatttcagtcatttataagccccatcttcctcctctatgccattcttagacctctaacttctaatcttattctttctcagtaattatatattttttacattatggatattttgtaatattatttcactttggtaatttacttttctctgatatttattttatctgatatctctatctctatctttatatctatatactgtgctttttaaaaaaacaaacaaacaacattttagcctattgagagagcatgtgcttgaaatctcagcacttgagagacaagagaattcccagctttcccagtctatttggcaagactctgtctcaaaacccttgctatttcaatggtgtaacttttctatccatttactttctgtatagccatttttctttttataaagcaaatatcttgtacatagcatatatttagctctgttttattcttttttaagctcataggatcgctgaaccttatagtagttctattttttaacttaataaggaaataaaatacctttttgtggtatatagattattttatagttcatgcaatagtgactacaggcctaattattaatattgagtgtatgatgaaatccattattttgtactccaatctgaaaagtcttaatttgaatcaagtgtagaaaatgtgtcatgaggtatataaaagttggtagttactatggtaaaataaattagcatacccatcatatcaattatttactcatatcccctgtgaaagaacagctataaatgaagttattagcaaaaaaacccaccataaatataatacactcttattaagtatattttccacattgtaaaagataggaacaatagttactttctgtttgctgttctgtctttaaaaaaaaaacaatgatcatactaaaagcatgaaatgataacacttgaatttctctggtgactagtagatatatccattagccatttgttcttggaattgtcttaagtcatttgtctgtactatagtgggcttgtttttttattcatttgaaagagtttttattttgcatactattctcttagctgaaatataggtttaacaattttctcctagtctgtatgttacctctttttttttttttttgagacagagtttctctgtatagccctggctgtcctggaactcactttgtagaccaggctggcctcaaactcagaaatccgcctgcctctgcctcccaggtgctgggattaaaggcatgggccaccactcccggctgtatgttccctcttaactatgttgcttgatttgtgcctcccccctccctgcttgaaaacagggtctgtatatagccctggctgtcctgaaactcattctttagaacaggctggcctagaagttaaagagatcactgcctctgtttcccaagtgctgagattaaaggtgtgcaccacaccagacttgttgatagatttgctacatagaagctttttagttaaatagagttccatttgtttactttttacttttctttcttgggcttttggtgtcacagctaaaaaattattgccaagacaattgttgtaaagctttgctcctgtatttcatttataggagattttacagtatcaggtctcaaagttgggtctttaatccatttaatctatgttaatagatttagagttgggctggagagatgcctcagtggttaagagcattgaagtgctcttccagaggtcctgagttcaattcctaacaaccacatggtggctcacaaccatctgtaatgggatccaatgtcctcttctggtgtgtctgaagacagctacagtgtactcatcatatatataaaataattaaataaataaaatcttttacaaatagatttagaatttagttttatatatcgtgagagatgagtatacagttttttgcatatatatccatgtttttcagaacgatctgttgaagatactgtctctaatatgcagctttggcattgttatgagagaaaatttgactatatgagtatccttttattcctaggttcactattcttttccaaattactgtgtaagtctgcctttatatgtcagtttcatattgcttaattctttctatttgtgatataatctgagagcagagagtgtgaggtctctagttttgttatacttttttcagtattgtttctgcaattgggtattggtagatgagctattcaaattttagaattcttctttctttctttttttttgtagaaaatgtcaattttcaaatgaaaatttcaccaaatctttatattgctttgggtaatgtggaaattttaacattattaagtttttcagtctattagtacagtatgtcttttaatctatttctttattaatttatctcatctgtgctttcttgttttcattgtaaaaatctttcctcacttttgttgctgtttttacatattctaaaaatttgaagctattgaaaaacaattatattgactttcattttagattgtttatttccgctctataaaaacacagtttttgcatgtttactaagtaccctgctatttgctaaactcatttgttagtttttagactctcatgaggcttttcagaatttatacatataagatcactccacctgtgaacagatataattttactttcccctttctaatttacatgtcattaattctttttcttgcctgatgtctttggataacattttattgttatattaagtagacgtgataataatgagcactcttattttgactttattttaaatgaaaacctttcagttttcatcatggaatatgatcttagctatgagctcttcatatgtggcttttattatgttgatgtatttgctttctggttctactttgttgaatgctttttttaaggaaagcattgaattttggcaaatgagttttcagcaatattgagatgcttgtgtagcttttatcctatttttcttgatgtggcatatcatattaattattttcacatattcacctactgtagggacaaatctcacctcatcatgttataaccattgtaatatgaaggtcagcttggcttactagttttcgttgagaattgctgcatctgtgctcagtagcaatattgacctgttgtctttatttaagactctagctctgttggatggctttggactactactccagtctctttaccaatcataaatttgtatagacttttttattgtttacattgttctgtgttgttatgttgggaatttctagaaatttatccatgttttatgccaaccaatttgttgacattattaagtttcttataatcctgttatttgtatggcatcagtagtgatagatttttactacacacacacacacacacacacacacacacacacacactggctggttttgtgtgtcaacttgactcagctggagttatcatacagaaaggagcttcaagttgaggaagtgcctccatgagatccaactgtaaggcattttctcaattagtgatcaagggggaaaggccccttgtgggcggaaccatctctgggctggtagtcttgggttctataagagagcaggctgagcaagccaggggaagcaagccaataagaaacatccctccatgacctctgcatcagctcctgctttctgacctgcttgagttccagtcctgacttccttggtgatgaaccgcaccatggaagtgtaagctgaataaaccctttccttcccaacttgtttcttggtcatgatgttttatccaggaatagaaaccctgactaagacaataacacacacacacacacacacacacacacacacacacatatatatatatgtatgtatatatatacatatatatatatgctttttgaaattataattacatcattccaccttctaccctctagcctttcttatgtgaaacccatgctctctctcaaattcatggcaacattttaaaattgttgttacatatatatgtgtataatcctaaatatataaatatagcctgctcagtccatctatatgttgtttatatgtatatgctttcagatgtgaccatttggtactggataaccaattggtatgttcatggggtgaataactttcccattttcagcattacttagttacttgtagttcttagtctaaggttgatacctccagagccttgtccctttcatataagcatgtctattggtgtcatccttgttcaggtcatgtttaggaagccaagatcttgcttctgagtttcttataatacacagtcttgcagcaaacttcctattttgctgtctcttaaatctctctaaccccctcttttgcagtgatccatgagtgttaggtgtggaggttgtgttatagatgtatcagtttgtactgagctctacaactctgcattttgattggttgtggttttctgtaatgatctccacctgttgcaaagagaggggtccttgatggctgtcctggaactcactttgtagaccaggctggcctcgaacttagaaatctgcctgcctctgcctcccgagtgctgagattaaagacgtgcgccactacgccctgctagggatagggtttttattagatgatctttggctcttgcaaggatcattgtcagtccgatgggaagtttttcatttcaaattatatatatatatatatatatatatatatatatatatatatatatatatatacatacacacacacatacatatatacatacatatacatacacacatacatatatatatcacacatataactatgtatatatatatatataaacacacacatatatattaatatatatagtgttataggtttatttaggtagttactcttattttactcccttcttcagtatttatctccctcccattttccaacttctcccttaaagatcacttgtaccctggtattttgcattctgttgctccctgctctgcagtggaccctcttttttactcttttgctttctgcagttactccaggttgtatacacacatatctgaagacacggaaccaataactgcagaagagtgaacatttgacatgtttctttctaattctggattacctcactcagtatgctcttttgttattgtcgttccacctctttaccaggaaattttatgattttgtttttctttacagatgagtagtattctatactgtttgtggtctgcattgtcattatgtgttagtcaactgaacgacattgaaattctttccacttcttagctcttgtgactggagaacttgtgattagcgaacatggctgagcaaggatctgtagaagtaggatgtctgttcttttggctatgtgctgaagtggcatagctgggtcatatggtacatttattaactgtttgaggattctccatgctcatttccagagtgcctgcagcagtttgcaattccactgtcaggtaactgatggcttcctttctccagctccttttcagtatttcttgtcaatctttcaagaaaccagctctatgctttgttgatggtgtctaatctttttgtttccctcttgctactttcagttcttcttttatctagttcctagagggtttaaaattagcttgttaagaatattcttttgtttaaaaaataattagctatttatcactacaaacttcctgcttgattctcatttttctgaaacccctaattttggcatgatgtattttgctatccccaagatatttttattttttgtttgatttattctttgactttttgtttgttcaaaagcatcttgtgcagctctgtactcccatcactcaggaagccgggaggactattactgtgagcatgatgtttgcttgggctatggaattagaccctgtttaaaaaacaaaacaaaacaaaaatatattgtataatccacatattgtgaattttctaatttttcttcaggtactgatttctaatgttactgtgttgctgttggaagctagatgtgatggtgcatacccataaatttctgcaatctggagaatgacacaagaacttgaggctagcctgggctatgccgtgaatttgaagccagcatgggacacatagcaagattttgtctcaaaacaaagcaaaaacaaaataaacaaatgaacaacaataaaaaccctctattatacttggaaagataacttgatatgattttattctctttacattttcttcttctttgttaagacccttatgattcagtgagatttatctagaggctggtctaagtatatttgagaagaatgtgtactctgatgttgggtggaatattatatacatatttattaggttcaaatggtttatgctattactcaaggactctgtctgtgtttgttccttatgagaataaatatcttgctacaggggttatatgtgtacttcttttagtttcagttagttcaaagtgctaatcaaaccctctcttctctttttaatttaccattagtttatataatccctttgaagagtagttgtgaatttccctttctgatattatagtgcatgttccctttaattctttcatttgctttatatatttatactccattctcagatgcatatatatttataattattatttattccttcagaactgacctagtttttattagtctagaatgttcttttctcttctgacatttttgaccttaaagattattttatatgaagtgtgatcactcctattcatctttgatagccatttggtgggtatgtcttatttaatatattgttcaaccttattttgttatttggttattcattcagtctttgtatacattttgattaaggatcttaatccattttcatttaatgaaatttttgaaaaggtaggacatagtattactattttgttgttttcattctgtcttatagacagtctcttattattttctttcatatttcattcatttttggcagagatattttgatttctttttcattttctttggtgtacctttcatatatatacataaatgcataaatatattcatacataattttttggttagtatagagcttccataaaacatcttgtaattatagaagtatattttaagattacattaacttattttcagatttatacaaattctctatactttgatttctcataatttatatattattggtaatacaaattatgtattttatattatgtttgtaatggcatggttttaagatttattatatatatatatatgtgtgtatgtgtatatatatatatatacacatacatatatatatatatactgtatatatatatacagtatatgtacagtatatatatatatatactgtagctgtcttcagacacaccagaagagggcatcagatctcattacagatggttgtgagccaccatgtggttgttgggaattgaactcaggacctctggaagaacagtcagtgctcttaactgctgagtcatctctccagcctgacatattttatagttataattattttatacttttgtataaggcattctagaatgaaacatgaattaaaagtgattgaagcaccaccttttcaacattaaaatattccaatattgctttgtttttctgttgctttcagttatcactttgtttcaaatgaagacatcttttaacattgattttgtaatgtatgtctaactgtgataaccctcctctattttatgagaaataaaaggatatcttttttggagaccactttttctggatattatatccttggttaacaatttcttttctttagccctatgaagttttcatttcatcaacccaaaagttactcctgataataaaatgtgactcccttatatatgattaggtatttttctcatcctttaattttcttccccctcattttattgaaaatagattttttcccatctagtatatcctaattatatttcccctctctctaagttttgttttcccctcccccatcttctcctcccatctggatccagatccactccctttttgtatgtcattagacaagaacagacttttaagagataacagaaagcatttaaaaaaaaacagaatataataagaaatcaaaaaccctcacattgaatttggacaggataaaccaacaaaaggaaaagagacaagtgaacacaaatgaatcagagacacactcattcacacactcaggattcccataaaaacattgtcttaattagggttttactgctgtgaacagacaccaggaccaaggcaactccatgctagctccatcataatccttcgttgtctgctggacgttagattttctcgtctggctcccacccctatatgacccagtactacccatttcttgtataccggggtttcttcctttttccatccaaccccctccttctttcccagccccttttccctcccattccttctttgctccgtcagagattctcagggacacatagttttcatatcagattgattttattttgagagtcaaagaactgtgtagtatctacagtatctacacagttggccattgctcagatgccacacctcctttaggtggcatgctgagactggcattctcaatcacaagtcgaaacgccgtttaggtgctatattgttcttagatgccttttttttcagcatccttcccagcgttttcttgttcttcatggtaggcacctggaagttcaacagagtaaggtgacaagggtatataagtcttcgaaaagctggaatatgtgaagaggattgtaggagacgggctatgggttgagaagggagtaaatgccaggccaagcaacggttgggagagctgggggaggggaagtctccggagaaaagactgtgcttaccttgggccttctaatcttcttgctacatttggactggaactgatgaaggcaaatcttcactatctttggctcagcagtcgaggttgatggctcaacatcaggtgtgaggcaagtgtccactgtcttgggttcggaagtccaggttgatggcacagcatctggtatgaggcagttcatcactctcttgggtttagatgttgtggttgatggcacaacatcctgtatcagattgtgcctcttcttagttgctttcaccatcctgatgccttgtggtggtctggtccagagctctcaggggcaccgtcttatgaacccaccctgaacaatgggaggccacacccctgagtcttgattggtcagcaaggtccttctcagctaatagtggctgaggagctgctctgacatcacaaagcaccttgctgcctggtgggagcaggcactagggtggagatcactctggttgagggagatgctatgaaggcaatagtggctggatacagactgggaggtttttttcaaacatctccaagagagtcatgccacccttttttatattcccatcttcagttgtgatagaacatgtggcagtgggtttgcccctatgaactcttcctgaaactcctccacccctattcaatggttcattctagtaatgtctcctccttagttattaacacttagctagattttggcatattataccttccaaatttaattcaacattcttccaaaatcattgaagtatcattgtatatgtgaatcatcctgtagatgaaaacaaaaagaatatattcatgaaaatatcttcctactggtttaatatacggaaatccatcaacataatccattatataaacaaactcaaagacaaaaaccacatgatattctcgttagatgctgagaaagcatttgacaaaatgcaacacccattcatgataaaagtcttggaaagatgaggaattcaaggcccatacctaaacatgataaaagcaatctacagcaaaccagtagcgagcatcaaagtaaatggtgagaagcttgaagcaatcccactaaaatcagggactagacaaggctgtccactctctccctacctattcaacattgtacttgaagtcctagccagagcaattcgacaacaaaaggagatcaaggggatacaaattggaaaggaaaaagtcaaaatatcactttttgcagatgatatagtatatataagtgaccctaaaaattccaccagagaactcctaaacctgataaacagcttcggtgaagtagctggaatttagcattcaaaacggatatttttggttacgttgtgtgatagctagtttattttaaaattattttacttacatcccaaatgttgttccccctttcggtcccccgtcccagaattccttacccaattccccctccccttctcctctgagagggtgcccccctcctctgaggcctcaagtctttacaggattaggtgcgtcctctcccactgaggccagacaaggcagtcagtcctctgctacatatgtgccaggagcttcagatcagctggtgtgtgctctttggcttagtctctgggagctaccaggtgtctgggttatttgatactgatggtctttctatggggttgccatccccttcagctgcctaattcagtcctcaaactcttccattggggttcctgacttcagtctaatcattggctggctataagtatctgcatctgtctcagtcagctgttggtagagcctctcagaggacagccatgctagtttcctgcccacaagcacatcatagcaccagtaatagtgtcagacattggtgcctccccatgtgatggattccaagttgtgctggtcactggatggcatttctgttaatctcttctccatttttgtccttgcagttcttatagataggaacaattctgggtcagaaattttgactgtggattagtaaccctgtccctccacttgaggccctgtctatctactggaaggggactcttcccttctgttgtacattttggttaaggtcacctccactgagtcccaagagtctctcgcttctcaagtttctggtactttgtagagtgttcccccacctctcatccccagagtcagcatatttccattcattctcctggccctctgggcttctctcctgtaccctcccctccaatgcctggtccctcccccccctccctccctccctccctccctccctctgcctcttgtgattattttgttcctccttctaagcgagattgaagcatactcacttaggccttccttcttgtttaacttcttatgatctgtggggtgtatcatgggtattctgtactttctggctattacccacttatcagtgagtacatacttggatatacttttgagtctgggttacttcactcagggtgatactttctagttccattcatttgcctgagaaattcatactgttcttgtttttaattgcaaggtagtattccattgtgtaaatgaaccacattttctgtatccattctttatttgagggacatctgggttgcttctagtttctggctattgtgaataaggctgctatgaacctggtggagcatgtttccttggagtattgtggagaatcttttgggtatatgcccaggagaggtatagctgtgtcttcaggtagtactatgtccaattttctgaggaacttccaggttgatttccagagtggttgtatcagtttgcaatcccaccagtgatggaggagtgttgctaattttatgataacttgatacaaactaaagttacctgaggggaaggaacctcaattaagagaatgcctccataagatgggtctgtgggcaagtctgtagtgcattttcttaattattgattgatatgagaaggcccagcctattctgggtggtggtatccctgggctggtcattctgagttctataagaaagcaggctgagcaagccatgagaatcaagcagcacccctccatggcctctgcatcagcccctgcctctaggtttctgtcctgcttgagttcctgtcctgacttcctgcaatgtcaaactacaatgtgaaagcgtaagccaaataaaccctgtccaccccaaattgctttggtcatatagttatagcaatagtaaccctgactaagacacatggttttccattcatacacagggtttgggatgaactggctactctcaaagactgtatgtttgctttatttgttcttagactccggctagactattattgaaactgacactatcctttctcttttaatttagtatattttattttgtatttaatcttctagcaccagggtttatcagttcagtccattattatcaaggcaggaacatggcatcatccaggcaggcatggtgtaggaggagctgagagttctacctcttcatctgaaggctgccaggagaagacaggctcccatgaggttaaagagggtctatgtgatgcttgccagccataccattataaattgctttgaatcatataggatttaaggaatacatttttaaatttttgttttgtttttaaattgatgcctgtgtaagctcatgtgcatgtgtgtgcaggtccctaaagaatctcctggaactggagttacagaggattgtgagccacttatgtggatgctcagatccaaatcctgggtctcctgcaagagcagtgtgttgactgtgacaatttggtggcaggggggctttccctgccctaaactcactccttgtcagttatgtccctggagacctcttgctgccaggctcctagactactttggtggcagggacctcttcaaaccaggcctcacatcttgagtcacaggagctttcagggccctgcatgaggagcttcactggccaggccccactcccagacttctaaaactgccattatagccattcacagcctccatccccaggcaggaaattaagcaggccctaccctacagcaataacaccagtccctaagcttgcccccaaatcaggccatcctgtaatgccctgcccaattcccctctccaagaaaccctatatgtcttagggttttactgcagtgaacagacaccatgaccaaggcaactctttaatctgggctagcttacatgttcagaagttcagtccattattatcaaggcaggaacatggcatcatccaggcaggcatggtgcaggaggagctgagagttctacctcttcatctgaaggctgccaggagaagacaggctcccatgaggttaaagagggtcttaaggccatgcccacagtgacacacttcctccaacaaggccacacctccaaatagtggcattccttgggccaaacatactcaaatcaccacagtcagttgttggttgtatctagtggagtgggccttaagtcaaatcagatattggttggttacccccatagctttgtaccatcattgccctagcaaattttgctggcagaatagcattatagatctaaagttttatagctgggttggtatttatgtttctctttggtaaccttcagagtaccttctcacaccaaagacattagaatgtaggaatgaagattctatgtaggcactagctcaacctttccatgttaaataagttgtataggtgttgtcttcagcacttgatcagttttaagagagaattttcttggcagcagcctgggttgtttggggatttctgtgaaatctctttggccaacaactcaattggttgtaacctagtcccagtactagtagcttgagactggagggtcaatttgaactctgtctccctcattatttagagactacattgggatccctttccttttttttaagaagttgccacaccactcctcaaatgcttctcaattctagttttatttcactgcattcttccctcaaccctgtttccccctcacagcccacctggtcctcccattcctgtcttacctcaggtcatagaccactcataaaaatctattctacatccctctcctagggagatccatgtgttttctttagtcttttctactatacttagcctctctagatctatggattatagcttggttaacatttatttaatggcctatatccatatataaactaatgcataccatatttatttttctgggtctaggttacctcacctgggatgatttttttcccgagtaacatccatttgcaaattttcatgatgtggtgtgtgtgtgtgtgtgtagtatggtatgagtcatgtgtttttgttccatttcatacctccctgtttgagaaaatattctcccctataagtttttactgatgggattttttactggttggaagaaaactttcacaagttatccagaggttagagattttggaggctacttggggaactctcagacttttggattaggtatatggaagatttggtaattttttccccctgattttacaacgttttgctccctctggtgtctctttgtggtactgcacttttgaagctgctgtgtttttttttttgtttgtttttgttttgttttttttttacagtaaattttactttttatttatttaattttttaacttattcactttacatttacactcactgccccatcccggtcaccctctgctacaattctttctccattcccactccccatttcctctgagcaggtggaggtcaccctgggtatccccctctaccctgcaatcaagtctctgaagctaggcacatcctctcccactgaggccagacaaggcagcctaactagaagaacaaatcctatagacaggcaacagcttttgggacagcctctgctccagttgttcagaacccacatgaagatcaaactggatatctgctacatatgagtaaggaggcctaggttcaggcctacatccagcctgtgtacccctttggttggtggttcagtctctgagagccccaagggtccaggttagttaactctgttggtcttcctgcagagttcctattcccttcagggccctaaatccttcccccccaactcttccataagagtccccaagttctattcactgtttggctgtgtgtgtctgcatctgtctgagtcagctgctgggtggagtctctcagagaacagccatgctagactcctgtctgcaagcataacaaaatatcattaatagtgtcaggaattggtgcttgcccatgggatgggtctcaagttggtccagtcattgttggccgttccctcaatccctgctccatctcccagtctctagatttcttataaacaggatacatctggggtcaaaagttttgtgggtgggttagggtccctattgctctactagggttcctgtctggctataggaggtggcctcttcctattctgctgagagtcacagcagtggtcatctccattgactcttgggtgcctcccttatcccaagtctctgtcatgtcctgcagatgccccccactccacactcctatcagttgcagatttcaattcactcgtgtggccatctttcctgtccctccccataccttatcctgaaccctaccattcacctccccataccacctccaaacaaggttccttcctcctttgaatcttatgactattttattcccccttctatgtaagattcaagcatcctcacttgggccttccttcttgtttagcttctttgcttctgtggagtgtagcatggctatcccatattttatggctaatatccacttataagtgagtatataccatgcatgtccttttgggattgggttacctcacttgggttggtattctcaaatttcatccattggcctgcaaaattcgtggtgtctttgtttttaataataatattccattgtgtagatttaccacattttccttatgtattctttgagagtcatctaggtcatttccagtttctggctattacagaaaaaaactgctataattctcagactctggattgggtatgtgggctcctcatccaaagatttactcatttttccccctgatttttttttttacaaagttcgctttctctgtggtattgcacttttaaagctgctggttttatttacattttttcttattcattttacatcccactccctgccctatcctgggcaccccctcccacaatccttcatacgtgtgtgtgtatgtgtgtgtgtgtgtgtgtgtgtgtgtgtagagagagagagagagagagagaaagaaaagagagaattttgctgatatccgagctgtcagtggtcagtgtttcccacaagaaccatagactaatagcacaacaataacaacaacaacaacaacaaataatacctctaatactaggcatgagtaagctcctttttcacagtcgggcagggtagaccaattgactcctaaaacaatataaaccattgatactgcctttcgttgtttcttggtgtattactaaacacactgcatacttcagacacagggcttggatgatttgagctggttctaacctgaaaacttccttcttgtagtgtagctttcatggtaccagaaaatactatacaaattgccaatggagagaagaaattaatagttgtatcttactgcaatacctctgaatcacaacaatgaccagcatgccaagatagccacaacatgtggcatacatgatggtggtaaccagcagctgtctagttgacttcaaggctcattcatgaggagagaaatcatactttataatggaaatctatcttctcagggctaatgaagtcatggaccttagaaaagaatctactaccaccgctttgctagaccagcattccttagtatattattaatggtatccttatacccacatataagtacagccaccatccacatcaaagaagctttgaaaaccatcacagaagataactggtcacaatgaggatatcatgggcttgtggatagcccagccctattagatcacctacatccctgcttttgcatttatgattagggagcatcaatgaagaagggcaggaaaaaattctaagaaccagaatatctagaagagagctatgaaacagtcttttctagaaatgactgcttaaacagcagaataatggcaatatttatagacacactaatgtggaagaggcaaagtttcacagggttctacccttacacaaagaactatgggcaattaggaaccgctgagagatagaaaattagcttctcccagggatgaggccccttattgattatccaatataaagtggttagcccagaaactgtatggacacagaaaacaaaactggatttagatgttgtatttatatatatttgcatatatacatattaatgtaacaataataaaccaagaaatgaagactgtcattctgagagtaggggtcctgggaagtgttagagagaaaatacctgggagggtctgatgggaagaacaggaaggaggaaagtgatgtaattctactttaattaaaaatgtattgaaagaatgtgagtttactgatgaaacagaaagcatttctgtgggaagtagccttaaaaaataaaaaattgaatatttaccttactctgttcttccctttctcttaaaatagaagtcactaagttgtatcaaactgttctactacatttcaaatggagcagcaacgagtcatagaaacccattttattctcagttgcctttgagacatggtgagcattctgcttcttagagtgttctgagcgtgttcttcttagagtggtggtagttgagcctctaccttgggtagctctatttgtgttattttcaatggcccctccactggccccttttaatagcagtgcttctactcgggggagatgtaacttagttccacatacacagacccacccccacccctgtaagtccatatgttcaacatatgtttagacttttatttttttccctctccaggaagaagccaacagttgagtttgctcctgattatactctgctgagctggacagagagatcatggagagtaagtaccacagcctttcatcttgactttagtatggccggatccatgcttgcctgagatgaaggaatatattaggctggtttctggatttctcttggaagaaatcagtctatgtattattgttgaattttgcgtccctactgtagaaagtaaggtctcagatattcttttacaccagcttctcatgaacagactccatattattattttcttttcattctatttttttcttctagagatctagatctgtgacaatatagacaaatttttgatcatttgttattctccacagatgtccaagagtctgtgtttcctctgttttttgatcgttaagaccaaggaaattatatctaaattctgccttcaactctgataactctgctgctttatccgcactctactgttgagtgcagatagctgtttaaaagacacctgctattgtgttaggcatacaatttgcatttaggtttttaaattgaaactgaatcatttctttgctgatattttccaatatttttgaatttgtttcaagattatttttaattgcttgttgaagaattttatgtggctttttttcaaaaaacagattgttattttaattaaaatatatttatttaactttccctattcccctttcttttcagtaactctcatatcctctccctttaaatccttgacgtcatcttggtatttttgttcagttaattatattttctcattcaggttagggcttccataactcttgatacaaggagacattttttcatttcatctgagacattttggctactatttaaaactcttaatcttatttaagttattggtttttatcagggagtctttcttttagttaatagtataagccatgaaatacttcattctttatgtaaatgtttacatggcatgttttgattatatttgttccccttatccaactcctccaggatcctcccaacgttcctttctaccaaacttcatacttccctcaccctttctcaaaacaataacaaaacaaaaataaaccccaaaatgaattcaaaacaaacaaaaccccaataagacagaatagcaaagcaaaacaaaaagcacacacaaaaatcatggagtctgtcttgtgatggccaagtacttatgggactaaccctggggtatgttgttattcccatgacactccatggaagaaaattgattttccctttccagcaggaaatcaattgcaagtagttttttggttagtagtagaattgtctggcttgaatttgttcagttttattttattttattttctgtgtgatgtcactgattctgtgagttgtatcagaatgatgttgtttccttactgtcacccatcacttctgacacttaaaatatttctacttctttttccacatagattcctaagccttgaggaaaaggggtttgataaagacattcaatttaggactgagtcctccaaagtctctttctctttacatattgcccagctgtgggtctccgttaactaaaacctactgcaaaaagcttctctgatgctggtcgaatgaggaactagtctgtggtataacagtatgtcattaggattcattttcttgctatggctctttagtagaataatagtagtaggttttccccaaggcctgtgacctgtctagtctgaggttcttggccactttatcattgtaagatgtaggatctgtctcatggaatgggtcttaaatccaacgttaaaaagtagctggtcctcgcacaagctttgtgccactatttcagttataaatgtggcaggccttccgctcgattcgagactcgagccccgggctaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgacagcagagtcttgcccaacacccgcaagggtccacacgggactccccacgggaccctaagacctctggtgagtggatcacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggtccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgacagcagagtcttgcccaacacccgcaagggcccacacgggactccccacgggaccctaagacctctggtgagtggaacacagcgcctaccccaatccaatcgcgtggaacttgagactgcggtacatagggaagcaggctacccgggcttgatctggggcacaaaccccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtacctgccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagatttacaggagagcactgctaaagagttacaggctcttaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacgtataataggaattgatgagaatgaagattttcaacttaaagggccagctaatatcttcaacaaaataatagaagaaaacttcccaaacataaaaaaagagatgcccatgatcatacaagaagcatacagaactccaaatagactggaccagaaaagaaattcctcccgacacataataatcagaacaacaaatgcactaaataaagatagtatattaaaagcagtaagggagaaaggtcaagtaacatataaaggaaggcctatcagaattacaccagatttttcaccagagactatgaaagccagaagagcctggacagatgttatacagacactaagagaacacaaatgccagcccaggctactatacccggccaaactctcaattaccatagatggagaaaccaaagtattccacgacaaaaccaagttcacacaatatctttccacgaatccagcccttcaaaggataataacagaaaagaagcaatacaaggacggaaatcacgccctagaacaaccaagaaagtaatcattcaacaaaccaaaaagaagacagccacaagaacagaatgccaactctaacaacaaaaataataggaagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgaagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagatccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaataaaaaaaaaataaaaaaaaaataaatgtggcaggcaggtctctgttgtagattccaggatttgtagctaggtgaaatagatccttacttttctcccctggtaatatgcaaaatacctcccagaaccataaatgctagcaagtagggatgaaacttcaagttgggaactagcttgatttttttttccttgtttgatgacctaagttctgtgttcagcagtatagccttctgacagatgtctcgattttttttaaagatttatttatttattatatgtaagtacactgtagctgtcttcagacactccaatagagggagtcagatctcgttacggatggttgtgagccaccatgtggttgctgggatttgaactccggacttttggaagagcagtcgggtgctcttacccactgagccatctcaccagccccagatgtctcgatttttacattgagttttgaaatctcatatgtatctttccttcattatagatacatttcctagctatattctttgaactctgacacacaaatgatgcactataaattcattttcaccatgcaggccactgatactccataaaaagctaccatagctaccctactctactctggtcacctttcatgcctttgctttatgccaactgaattgtttgagagatttaatgagttaatttgatttagctagttttgtctatttgccaaggaaaaaatttccaggacagctgaagatgtgtagaatggataattatgaagatttacacacacacacacacacacacacacacacacacacacacacacacacgaaaggatataaaaggatgatggagtgaaaagtatgagatgaaactgtaattggtgaattttactagtgtttataagtagagttactaaaggtgacagaatgcatgaaaatgagatttgggggcctgcgagttggctcagtcagcaaaggcaccaccaagaacttagcaagcatgaaggcctgaatttgatctctgaaagcctcatggtaaaggggaggagagaggcaactcccccaagttatcctcggatctccacaacatggcatgcatgcacgtgcatacacatggcttaaaacaagtaagtgcaaactaataaatgtgcaaaatttccaaagtctttgactgtgaagcaaataacagtttaactatgggacagggtagctgacatcatgtgaaaggaaagatcatgagtcaagatgatcagagaactggaaggacagaaaacttctatttttggcagcataaagccagaaatgctttggaaacaataagcaaagtctttctgcttcctcttccacagagttccttgagccctgaaggaagggatttgatgaaaaccttccatttaggactgagtgtttcaaggtcgttccctctctgcacattgcccagtgtcttagtcagggtttctattcctgcacaaacatcatgaccaagaagccagtggggaggaaagggtttattcagcttactcttctacattgctgttcatcaccaaaggaagtcaggactggaactcaagcaggtcagggagcaggagctgatgcagaggccatggagggatgttactgacttgcctcccctggcttgctcagcctgctttcttatagaacccaagactaccagcccagagatggtcccacccacaagtggcctttccccctgatcactcattgagaaaatgccttacagctggatctcatggagtcatttcctcaaatgaagctcctttctctgtgataactccagctgtgtcaagttgacacacaaaactagccagtacacccagttatgggtctctgtgtttgtttccatctactgcaggaggcaacttctctgatgaaggctgagcgaaaaccagtctatgagtatagcagaatgtcattaggaatctttttattgttatgttcttttagcaagatagtagtatttggttttaccctgggtccatggcctagcgagtggcttcttgggcacataagcagtgtcaggcatgggttccatctcatggagcgggccttaagtgcaaacatatagttgttgattactctcagaagcttgtgtaactattgcatcagcatatcttgcaggcaggttaccattgtagatagaagggttgtagctgggttggtatttatctttctgctttgtagtgggcagagtgtcatgaacacatcagtaggggtgaaggctctaggtaggcatcagcttgtctttaacaatagaaccttaccattagtttgtgggaaacaatagccttggttttttttgggggggggggggcgagggatgtttccatggagcccatttggttaacaatataattagatacaaactatttccagcactggaagtttcatttggtagtaagagatctgtctaagttggagctttgtttaccccttttatttggtgattccatttaggtttctttcatatatgtacatattttaagaagctgaaatagagagttggagggaagagggaatacagggcacctaaagggagggacagctaaaactaagggctatttgagtggtccatatgtgatggttactttgtaaacttgctctaacttaaaatcacatggaaagagaatctcatagggggattgtttagattaggtttgcctgtgggcagatctgggagaactgtcttgattacataaattgatgtgggaagacttaatctagtgtggatggcactattccatatgtaaggaaccctgcactgtgtaagaatattgagaaaggctaacacaagtaggcatgtgtgtattctctcctctctgctcttgaatgtgatgtgactagctattttaagttcctgctaccttgactctttactataatagactatacattggaatttggggctaaagtacactgatcctcccaagtggttttggttgttgttttcttttttttttccattttttattaggtatttagctcatttacatttccaatgctataccaaaagtcccccatatccacccacccccactcccctgcccacccactccccctttttggccctggtgttcccctgtactggggcatataaagtttgcaagtccaatgggcttctctttccagtgatggccgactaggccatcttttgatatatatgcagctagagtcaagagctccggggtactggttagttcataatgttgttccacctatagggttgcagatccctttagctccttggctacttcctctagctcctccattgggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccaacctttcatctcagctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggataaatgcccaggagaggtattgctggatcctccggtagtactatgtccaattttctgaggaaccaccagactgatttccagagtggtagtacaagcctgcactcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgtttctctgccattcggtattcaacaggtgagaattctttgttcagttctgagccccattttttaatggggttatttgattttctgaagtccaccttcttgagttctttatatatgttggatattagtgccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttctttgatccacttagatttgaccttagtacaaggagataagtatggatcgattcacattcttctacacgataacaaccagttgtgccagcaccaattgttgaaaatgctgtctttcttccactggatggttttagctcccttgtcgaagatcaagtgtgggttcatttctgggtcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcattgaagaattgagttggaattttgatggggattgcattgaatctgtagattgcttttggcaagatagccatttttacaatgttgatcctgccaatccatgagcatgggagatctttccatcttctgagatcttccttaatttctttcttcagagatttgaagtttttatcatacagatctttcacttccttagagtcacgccaagatattttttattatttgtgactattgagaagggtgtttttttcctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgttgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaacacttttatcatgaatgggtgttggatcttgtcaaatgctttttctgcatctaaggagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcgtcgatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagagctctgcactaaacccatctggtcctgggctttttttggctgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgacaagctgctagtatttgctgtctcccgtttcttcttggaggcactcagagctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccattgtggtctgatagaatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttcctcgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctttgtctttttattggggaattgagtccattgatattaagagatattaaggaaaagtaattgttgcttccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttttatgatcatgggcatctctttttttatgtttgggaagttttcttctattattttgttgaagatattagctggccctttaagttgaaaatcttcatactcatcaattcctattatacgtaggtttggtcttctcattgtgtcctggattaccttgatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttatatctccagcgttgcctcactttgggttttctttattgtgtctacttccccttttagttctagtatggttttgttcatttccatcacctgtttggatgtgttttcctgtttttctttaatgatttctacctgtttggctgtgttttcctgcttttctttaagggcctgtaactctttcgcagtgctctcctgtaattctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttttgttagtaggattcttatgtttgcctttcgccatctggtaatctctgaagctagctgttttagttgtcactgttaagagcttgttcttcaggtgactctgttagcctctataagcagacctggagggtcgcactctccttagtttcagtgggcagagtattctctgcaggcaagctctcttcttgcagggcaggtacccagatatctggtgttcgaaccagactcctggcaaaagttgtgttccactcactagaggtcttaggatctcctgtggaatcctgtgtgggcccttgcgggtgtcaggtgactccactggcaaggtagcccggggctcgagtggagcggaaggggtttgtgccccagatcaagcctgggtagcctgcttccctatgtacagcagtctcaggttccgcgcgattggattggggaaggcgctgtgttccactcaccagaggtcttaggatcccgtggggagtcccgtgtgggcccttgcgggtgttgggcaagactctgttggcaaggtagcccggggctcgagtggagctgaaggggcttgtgccccagatcaggcccgggtagcctgcttccctatgtaccgcagtctcaggttccgcgcgattggattggggcaggcgctgtgttccactcaccagaggtcttaggatcccgtggggggtcccgtgtgggcccttgcgggtgttgggcaagactctgctggcaaggtagcccggcggttgttgttttcagaatactttttgatagcaaccaaaatgaaattaggccaggtgtgctccccctttctgtttttatttggactatgtgacatggcatcagatgcatgttagtagcacgcagtttcacaaagcaaattatatagaaatgcctttctaatgaagaaaagggtagttggcaagtattttggttagtgaagttgtacctaggcagttttgagtggtcatgtaaagtacgttctaacattagcatttaacagctatgcagatagccctgccgtgtcctcatatctatttggtttacctaaagagtgatatgtagtccttagctcttgatctagattttagaacatttaaaaagttacctgttcatccatcttccgctcaatttccattgaatatgaattcacactcagagcagattcataatgatgtagtgataacttcaaatggtttaatttgcagcacacattcttggtctggttttgaataatgatacagaatatataattcttctacttgataataatttagtaacttaaggatattctttttcacctcctgaatgataccatagtgtctgttaggtgcttcagagccggattgcctatgtttgaatttgacctgactatatactggaatctgtgattctgaatgggctacttaatttgttccttacttctggagaagaaaatgttgataattaacgcataatctcttcaggatagaattataagaaataaatgagctaatatatgtaatctatttagaacagtgtctagcacatctactgtcatgatcagtgaggcatgcagccctacaatgaaagctaaagcagcctgagtaattctttttagaaacctctattcagcctaaattcttgataaacactacagaaaagaaattcataagatattagttatatgtatatgatttcagaactgaccacttggtgttagataactaattgtagtacttttccctggggaaagctatttttctggttctcaacatttctgaattgcttgtagttcttggtctagtattggggcccagtatgactttcctcttcctatcatgtcaattgctattactcttatatatgtattgtttaggcagccttactgttgcagtattataggtgtggcttccttcatatagctaaaagatgcaatctcacatcaggcatccaaacgttaagggctgaacagattgtatttatatgtgtaggaatatgttcacatatattcttagtgtatatgtgcatatgttacaacaattaaagaaaaagaccagaggccatgtgtattagtcagggttctctagagtcacagaacctatggatagtctctatatagtaaaggaatttattgatgactcacagtctgcagaccaattcccaacaatcgttcagtagtagctgtaaatggaagtccaaggatctagcagttactcagtcctacatggcaagcaggcgaaggagtgagagcgagactcccttcttccaatgtccttatatggtctccagcagaaggtatagcccagattaaagatgtgttccaccacacctttaatcccagatgaccttgaactcagagatctccctgtcttaatcttctggaatccatagccactatgcctcaagatctccataccaagatccagatcagaaacttttatctcccagcctccagataagggtcactggtgagccttccaattctggattgtagttcattccaaatatagtcaagttgacaaccaggaatagccactacaatccaccccttgtcaacttgacacaaataatatctcatgttcacatgaaacaataacaaggttgtgaatttgcctaacatgatataactatccctcgtacaattgcaaacgcatttgtaaatttacaatggggcagtgtcccttgggaacatccttttagtgtctcaacttaaatacaaattgatgttaaagaaattggaagaaagacaaatgtattcgttagcaaaataagacaggagcattcatactgctttaaaacccttgtttctgcaactggttatgtgccttaattggtatttataactaccttcctttactacccattctgtatttccttcaccttaagcaagcacctcagcaggtcttggctcttttcctggaggattgacccataccttcattcctgatgggtctgcgtcctttgtcatcctgcttggattaggctgttgtagtttcccattgaccttaatcacaggacatggcagtactaagagatgccctaagggatctcctacactccagacataatcttgcttaccaccattgtggagaggcaatccagtttccccacgataatctggatctatcacccctccttacactgttattcctttcttagcctgttggtttaagggcattagaagcccaaaatgaccagggggaagtctgagcttctagttcaatgggatgtttgttgtagctcctggtaggagcaatccccactctggagccaaaacttctaggccagcagaatctagagttatggggacaggagcaaaatttttcctagagggtcactaggagtgatagtaagtggaactattcccttttccaccccttgattcctggacccatggatcctggctatgggggaaactgtaccatatattgaatgctgattcaaagcatatactgccttctgaagaactctgccccagccttccatgctaattagttatcacctaattggtgctgtaactgcgtcttcaaaaggtcattctatctatcagacaagctgcttcaagatgatggggaacatggtaagatcagtgaattccatgattgtggatccagtgtcacaattctctggctgtgaaatgagttccttggtcagaagcaatactgtgtggaataccatgacgatagataaggcattctgtcagtccgtgaatggtggttttagcagaggcattacgtgcaggaaaggcaaatccataaccagaataagtatctactccagtaagaacaaaacgctgtcctttccatgaaggaagtggtccaatgtagtcaacctgccaccaggttgctggctggtcacctcgaggaatggtgccatatctgggactcagtgttggtttctgctgttggcagatctggcaatcagcagcagctgtagccaggtcagctttggtgagtggaagcccgtgttgctgagcccaagcataacctccatctcgaccaccatgaccactttgttcatgtgcccattgagcaatgacagggatggctggggagagaggctgactgtccacagaatgggtcatcttatccacttgattattgaactcctcctcggctgaagtcaccttttggtgagcatttacattagacacaaatatcttcacatcctttgcccatttggagagatctatccacatacttcttccccagacgtctttctcaccaattttccaattgtgatctttccaagtcgctgaccatccagccaatccattggctacagcccatgagtcagtgaataatcgtacatctggccatttcttcttgcaaacaaactgtaataccatgtgtactgcccgaagttctgcccactgtgaagatttcccttcacctgtgtctttcagggttgtcccagaaaggggttgtaatgctgcagctgtccacttctgggtggtgcctgcataatgtgcagagccatcagtaaaccaggccctagtcttctcctcttcggtcaggtgatcatagggaacaccccatgaggctataggcacatgcttggcagcatatggcattgtaacaggagtagaaaccatttgagcaacttcttcatgtaacttgcttgtgccttcaggacctgctctggcccgatcacatatataccacttccatttgataatagactgctgctatgagcgtcccactttatgatttgcagggtctgatagtacccagctcatgatgggtagttcaggtcgcatagtaacttggtgtcctattgtcaaacattcagattccagtaaggcccaatagtaggccaagagctgtttttcaaagggagaatagttgtctgcagatgatggtagagctttgctccaaaatcccaaaagtctcttctgggattcacctacaggggcctgccagaggctccaaacagcatctctatcagccacagacacctcaagtaccatcgggtctgctggatcatatcgttcacgtggtagagcagcctgcacagcagcctggacctgttgaagggccttctcctgttccaggccctacacaaagctagcagctttctgagtcacttggtaaataggcctgagtaacatatccaagtgagggatgtgctgtctccagaattcaaatagacccactaaaccttgtgcttctttcttggttgtaggaggggccaggtgcaataacttatctttcactttagaaggaatatctctacatgccccacaccactggactcctaagaatttcactgaggtatcacaaaggaactcacacaatatgtactcactgataagtggatattagcccaaaacttaggatacccaagatataaggtacaatttgcaaaacacatgaaactgaagaagaacgaagaccaaagtgtggacactttgccccttcttagaattggaaacaatcacccatggaaggagttacagagacaaagtttggagctgagacaaaaggatggaccatcaagaaactgccatatccagggatccatcccataattagcctccaaacaatgacaccattgcatacactagcaagcatttgctgaaaaactctgatatagctgtctcttgtgagactaggccggggcctagcaaacacataagtggatgctcacagtcagctattggatggcgcacagggcccccaatggaggagctagagaaagtatccaaggagctaaagagatctgcaacccagtaggtgcaacaacattatgaactaaccagtaccccggagctcttgactctagctgcatatgtatcaaaagatagcctagtcggccatcactggaaagagacccattgggacaggcaaactttatatgccccagtacaggggaacaccagggccaaaaatgggaatgggtgggtaggggagtaggggggagggtgtgggagacttttgggatagcattctaaatgtaattgaggaaaatacgtaataaaaaaagaaagaaaaaaaagaatttcactgaggtagatggtccttgaattttggttggatttatttcccatcctctgatactcatatgtgttaccaaagagtccaaagtggttgctactatctgctcacttggtccaatcagcataatgtcatcaatataatgtaccaatgtgctattttgtggaagagccaaatgatcaagatcccttctaactaaattacgacacagggaaggagagaatatatccttgaggcaaaactgtgaaggtatatcctggctttgccaactgaaagcaaattgcttctggtggtccttatggataggtactgagaagatagcatttgccagatcaatagctgcataccaagtgccaagagatgtgttaatttgctcaagtaacgaatctacatctggtacagcagctgcaattggagttactacctgatttagtttttgatagtcaactatcattctccatgatccatctgttttctgcactggccagataggagagttaaagggagatgttgtgggaatcaccacccctgcatctttcaagtccttgatagtggcagtaatttctgcaattcctccaggaatacgatactgtttttgattcactcttttctttggcagaggcaactctaaaggcttccatctagcctttccaaccataatagccctcactctacagttcaaggaaccaatatgagaattctgccaatttctgagtatatctatcccaattatacattctggaactagggaaatgaccacaggatgtgttcggggacctactggacctactgtgagtcagacatcagtcaaaactccattaatcacctgctctccataagctcctactttaactagagggccacaatgtttcttgggatctcctgggatcagtgtcaattcagaaccagtatccaatagaccacccccccccccagaaagtctgatcatttcatttcccccagtgtacagttacccttgtaaaaggctgtaggtccctctggggaagaactggagaaagggtaacagcaaaacttttaggtgtcttatcaagatccttcctcaggggaacctggccaccccttcattcaaggggttccaaatctgcagactgactcaagtctggaaattgattcactggccgagattgccgtttaccattatctaatgtagcctttctttcatttgtttgagaatttttctgcttatacagatcaaacaaatatgcagtaggcttcctatgtatttcattcctggaaacaccatgattgattagccagtaccaaaggtccaagcaagtcatgccattataaatttcacctctcctgtgctgaccattactgggtttgttattataaacatagttttgtctatgctgtccattataataactaggatcaccttgtctctggagactcaatgctgccacctggaccttgttacttcagagaccaattaaacccattgaatttaatttatctaattgagcagcagcatctccaatgctaaggactggcccaaggaaaagggcaagaacaaaactcttcaaatatgctggtgcccctctcaccagtttgtgtcttatagggttggtaaagggcatatcttctggaccttcccattgtggaggattaggttttacacaatatatccactctagcattgcaatttccctaagtcttaaaatccctttgtcaacactaagccacggaatatcaggcatttccaagtcatttccagtaggccatcttttgataaacacttcagccaaccattcaaacaaacttttgacaccttttttaactgtgcgagcttctgtattaaacctagaatctccactcagagggcccatgttaataaactcagcctgctctagttttatgttccttccaccctatcccacacccttaaaagccattcccacacatattcaccaggtttctacttgagtgaattagcaaactcattaagctccttagtagtgtaacgaatttcctcatggactacactttctacctcccctctagaagcctggtttgctttgagtctggttgcaggtctagaagaaactattggtggaccttgagaaacatcagtattatcttgtctggcattttattcagtgaaagtcactgctggtttatcagactctgcagaattaatttcctcatgtggggaaggcattatttcaaggggtggggctgaggatactacttcctcaggtggggcaaacccttgagaatctgaagattcaaaattctcagcttcaacacggtcttccacacatcactcatcccaagttataggatcccattctttgccaattagagcccttactttaactgtagacacactctgaggctgagacttgaattttcgctgtagttcaggcaaccttacaatgagggtttcagtttgattttctgcaacttgagctctatggctgaaggagagaagattctcttgaaggatacacttagcaacttttagatcgtttacttgtgtctggagccttcgattttatcacaactccttcctttcattcatcattttccccagatgctaagagcagccagccagtaaaatcattttttgattttttccccatcttgtagaaagctttgtacaacgaatcacctaattcatcaagaaaatcaagggcattagtttctttaagtttgaaatacagtttcaaccacgggtctttcaaaattctctgagctcccaggagggagagaatctggagaggtttcagtagttgaaggtgctggtggatcaacaagccaattccagtattttaaaagattcatccgtatacttctgctcctctagagccactcctgataccaacgtctgtattagtcagggttctctagagtcatagaacatatggatagtctctatatagtaaaggaatttattgatgacttacagtctgcagttaaattcccaacaatggttcagtagtagctctgaatacaagtccaaggatctagcagttgctcagtcccacatggtaagcaggcaaaggagcgagagcgagactcccttcttccaatgtccttatatggtctccagcagtaggtgtagccgagattaaaggtgtgtgccaccacacctttaatcccagatgaccttgaactcagagatctccctgtcttaatcttctggaatccatagccactatgcctcaagatctccataccaagatccagatcagaaacttttatctcccagcctccagataagggtcactggtgagccttccaattctggattgtagttcattccaaatatagtcaagttgacaactaggaatagccactataccatgtattttagataaagaacaagtagttaggggtataggaggagttgaggggaggaaaggtaaagggaaaattaagcaattatattttttttcaggttttttttccattatttattaggtatttagctcatttacatttccaatgctataccaaaagtcccccatagccacccacccccactcccctacccacccactccccttttttggccctggcgttcccctgtactggggcatataaagtttgtgtgtccaatgggcctctctttccagtgatggccgcctaggccatcttttgatacatatgcagctagagtcaagagctccggggtactggttagttcataatgttgttccacctatagggttgcagatccctttagcttcttgggtactttctctagctccttcattggggaccatgtgatccatccaatagccgactgtgagcatccacttctatgtttgctaggcccaggcatactctgacaagagacagccatatcagggtcctttcagcataatcttgctagtgtatgcaatggtgtcagcatttggaagctgattatgggatggatccccggatatggcagtctctacatggtccatctttttatctcagctccaaactttgtctctgtacctccttccaagggtgttttgttcccacttctaaggaggggcatagtgtccacacttcagtcttaatttttcttgagtttcatgtgtttaggaaattgtatcttatatcttggatatcctaggttttgggctaatatccacttatcagtgagtacatattgtgtgagttcctttgtgaatgtgttacctcactcaggatgatgccctccaggtccatccatttggctaggaattttataaattcattctttttaatagctgagtagtactccattgtgtagatgtaccacattttctgtatccattcctctgttgaggggcatctgggttccttccagcttctggctattataaataaggctgctatgaacatagtggagcatgtgtccttcttaccagttggggcatcttctggataaatgcccaggagaggtattgctggatcctccggtagtactatatccagttttctgaggaaccgccagactgatttccagagtggttgtacaagcctgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctcaggtgagaatactttgttcagttctgagccctattttttaatcgggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctattcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtggcagcaccaattgttgattatattttaatttcaaaaatatgagagaatgatgtatacaaattaaaaaagaattttgaaagtgtcagtatgaagcaaaattagagtaaagaaaagttttcattaggcacaagcattaagaaatgcaaaccaaaacaaccctgagattccatctcatcttttggctaagatcaaaaattcaggtgacagcagatgctggcgaggatgtggagaaagaggaacactcctccattgttggtggtattgcaagcttgtacaaccactctggaaatcagtctggcagttcctcagaaaattggacatagtactactggaggatctcgcaatacctctcctgggcatatatccagaagatgttccaacctgtaagaaggacacatgctccactatgttcttagcagccttatttataatagcccgaagctggaaggaacccagatgcccctcaacagaggaatggatacaaaaattgtggtacatttacacaatggagtactactcagctattaaaaagaatgaatttaggaaattcctaggcaaatggatggacctggagggcatcatcctgagtgaggtaacacaatcacaaaagaactcaaatgatatgtactcactgataagtggatattagcccagaaacttagtatacccgagatataagatacaatttgcaaaacacatgaaactgaagaagaacgaagaccaaagtgtggacactttgccccttcttagaattggaaacaatcacccatggaaggagttacagagacaaagtttggagctgagacaaaaggatggaccatctagagactgccatatccagggacccatcccataattagcctccaaacgttgacaccattgcatacactagcaagcatttgctgaaaggaccctgatatagctgtctcttgtgagactaggccggggcctagcaaacacataagtagatgctcacagtcagctattggatggagcacagcgcccccaatggaggagctagagaaagtatccaaggagctaaagagatctgcaaccctgtaggtgcaacaacattatgaactaaccagtaccccggagctcttgactctagctgcatatgtatcaaaagatggcctagtcggccatcactggaaagagaggcccattggacaggcaaactttatatgccccagtacaggggaatgccacggccaaaaaatgggaatgggtgggtagggaagtggtggggagggtatgggggacttttgggatagcattctaaatgtaattgaggaaaatacgtaataataaaaaatattaaaaaaacaaaaacaaagaaagggaaagagttgtgtaaaagaatagtaatagtgtctgtttgagcaagcaagagagaaacttacatttaagtgtctttttaaaattaatatatttatttacattaaactctgcaccctctcggttcctccctcacagggaccctcctctatcccactccccttttcctctgaggtgaaccccctggtatcccccaccctggcccatcaagtctttgccagggtaggcatattctctcaccaatgtcagtcaagtcagccctgttggggagcagataccacagtcaggctacagctttagagatagcctccactgcagttggggggcccacatggagactgagctgcacatcttctatatatctgcctggggcctcctttaagcctgtgtgtgttctctggttggtgcctcagtctctaagagctcccaggggtcctggttaattgattctgttggtttttgtatggggttcctatccccttcagggccttcaatccttccccaaactcctcccaagagtctctgatctctgtccaatgttaggctctgcattgggtctctgcatctgtttcagtcagctgctgggtagagcctctcagaggacatttattctaggctcctgtctgcaagcatatcattaataacaccagggattggtgtttgcccatcagatgagtttcaagttgggccagttattggttggtcattctttcagtctctgctctatctttgcctctgcatttcttttagatgggacacattttgggttgaaagttttgtggttgagtttgtgtccttatacctccactggggctcctgcctggctacaggaggtgggctcttcaggttccatgtcctcacagttaggcatcttgactaaggtcagctgcattgactcctgggaacctcttctatctcagttctctgggacttcctaaagattcctccccaaactgcaactctcagaaactgcagatctccctcacatctgatcctaccccccctacttccttctcccctctgccaggcacttccctccctccctctaacttgtttaagttatttggatctgtggggtgtatcatgaatattctgtactttatgggtaatatccacttatgagtgagtacataccatgcatgtccttttgtgactgggttgcctcactcgggatgatattttctagttttatccatttgcctgcaaaattcatgacatccttatttttaatagctgaatagtattccattgtatattccatgtgtacattttctgtatccattcttcagttgaggggcatctgggttgtttccagtttctggctattatcagtaaagctgctatgaacatagtagaacacatgtccttgtggtatagtagaacattttttgggtatatgcccaggagtggtacagatgtgtcttcagatagaactatttcccattttctgagaaccccccagactgacttccagagtggttgtaccagtttgcaatcccaccagcaatgttcctctttctccacatcctcgctagcatgcactgatgcttgagtttttaagaatgttagccattctgattgggttgttttgatttacatttccctgatgactatggatgttaaacatttctttaagtgcttcttggccatttgagattcctctgttgagaattctgtttaactctgtaccccatttttaaattgggtctaacttcttgagttctttatatattttggatattagccctctgttggatgttgggttagtgatgatcttttccgaatctgtaggctgccattttgtcctattgacattatcctttgtcttgcagaagcttttcagtttcatgaggttccatttatcagttgttgatcttagagcatgatccatttcacgaagttgtctcctgtaccaatgcattcaaggctcttccccactttttcttctatgagatttagtgtatctggctttatgttgatgtccttaatctacttagacttgagttttatacagggttataaatatgatctatttgcattcttctaaatgcagacatccagttagaccagcaccatttgttgaagatgttttcttttttccattgtgtggtttgggcttctttaccaaaaatcaattgtgcataggtgtgtgtatttatttctgggtctttgattcaatttcattgtctatttcagtatcaatatcatataattttttatcacgattgctctgtagtaacagcttgaggtcagggatggtgatttctccagaagttcttttattattcagggttgttttagatattctgggttttttgtttttacatgtgaagttgagaattgctctttcaaggtctataaacatttttgttggaatttttataggaattgcaccaaatctgtagattgcttttggtaagacggccattttcactgtgtttatcctaccgatccatgagcattggaggtctttccattttctgatatctttctcaatttctttcttgtggggcttgaaatttttcacatataggtctttcaggtgctttgttagagttacaccaagatatttatattatttttggctattgtgaaagatattgtttccctaatttctctttctgctcatttatcatttgtataaaggaaggcttcttatttcttcaagttaattttgtatccagccattttgctgaaggtatttattagctataggagttctctggcagaattttttgggttgcttatgatgatgctttcatatctgcaaaaagtgatattttgaatatcttcctttccaatttgtatccccttgatatcttttagtttcttattgctctagctaaaacctcaagtaccatattgaataggtaggaagagggtgaacatcctggtcttgaccctgattttagtggaattgcttcaagtttctctccatttaatttgatgttggctactggcttgctgtataatgcttttattatgtttaggtatgggccttgaattcctgatttctctaagacttttaagatgaaggggtattggattctgtcagaggctttttcagcatctaatgaaatgatcatgtgctttttttctttgagtttgtttatatagaggactatgttaatagattttcatatgttgaaccacccctacatccctgggatgaagcctacttgatcatggtgatcaagtttttgatgtgtccctggattcagtttgtgagaattttattgcgttttgtgtgtgtgtgtgtgtgtgtgtgtgtgtgttaatgttcatatgtaaaattggcctgaatttgtgtagtttaggtatcagggtgatcgtggcctcatagaattaattaggtagtgttctgtgtttcagttttgtggaatagtttgagatgtgttgatattagctcttctttgaaagtctggtaggactctgggtgagttttaatgactgcttctatttccttagggattatgagactgtttatatagttaacatggtattgatttaactttggtaagtggtatctgtcttgaaaatcatctatttcgtttagttcttctagttttgtggaatataggcttttgaagtatgacttaatgatttttttaatttcctcagtttctgttgttatgtctccttttacatttctgattttgttaatttggatactgtctctgtgccttttagtgtcttaataaatagctaggtatatgattttgattgctgttgaagttacattgttcagaatgttttaaagttaagttaatttttggaatatttttccctactctctgtccatactagactgaaaaaggttttaaatgtatcacgttttcatccctagaatttatgaatattatatgatactgtaaagaggactctgaaaatgttgttcagttaaggatcgtgagctttgataatgaccctagataattttgatgggccctaatgtcacctcaaatgccattatatgagggagacagatgaaaatgggtccgaaaataagacagtgtaaccgcttgtagagtttttagagtgaaaacttgaccctaatagcgccaacaagcaagactcagccttccttccattcatccacttaaacaagacaagtaataggaaaagtagagaaaggaggtttagtcaaagtggttgtattgggaagagaaacaaataaaggagttcagtgaagctcaagtcagttttcagggtataggaatgaggttttacttcggggtaaaaagtatgcatagttggcagtcatggtcaaaatgtggctcctttccattactggcctttgtttggtctccagtgtcttgcaaagttctttactaagttgtcacaatttcatcttatctcttcctgggagccaagtgacttttcttgctgttaccagagcttccctttcctagcatggacttattttggaaatttaaattcactgaagtccattgtttcagtatccagatacctaaaatgaggagcaaaagtgtctctccttagagtatcttctctcctactggttaaatgatggctaaattattaaactggttaaatgatgacataaacactgcactaatggctttgaaagtgaacgagaggccacaaggtaagaaatgcaacttcaaaccttgaaactgtggagcaaatatgacccagctgatacattgatttttttccctaagtgaaattgatttttagctcttagcttcgacaaaagtaagagcctgtttgtttgtttgtttgtttgtttgtttaaagccaccaattctgtggtaacttatttagaagccacgggaaaataatatgtaggagattgttactgaagttaggatcagagcatgtacctaacaagtcaaagatctgtccttgataggccagttaactaagccaaattaacaatggggagagggggaaagggaaaatgtactcgctgattttgtgtgtcaacttgaaagaagctggagttatcacagagaaaggagccacccttgaggaaatgcctccatgagatctagctgtaaagcattttctcagttagtgaacaagagttgaagggccgattgtgagtagtgccatccctgggctgatagtcctgggttctataagaaagcaagctgagcaagccaggggaagcatgccagaaagtaacatccctccatggcctctgcatcagcccctgcttcctgacctgcttgagttccagtctggacttcctgtggtgatgaacagcaatgtggaagcagtataaatccttttcttcccaacttgcttcttggtcatgatgtttatgcaggaattgaaaccctgactaagacagaatgggaggggtaagggtaaggatgtgagagtgaggacaagggagagagagagtttgattctgtgggccatactgagaaaagggacagaggacagaggtccactgattcttacaagtctgtcttcagggtcccaacatgagtgtaaaacttaaatagaatagaatgcataactaaatagttccatcaaggtgtgggtctcctgaccaccactatctcagctccaatatcctactaggtcagtctctcctccaatgccatctgactagttttaaatctttcctggagaaaagttcgtcctctgttatcccttttctcttcttgtcatgagaatcctaaggagactgtaatttcttaggtccattgtttcaataatttgatggtcaaagggagggccaggagtctttctttagaatatcctcatttctgcctggcaggcaggaacataattatctttcatcttactaactttagccattattatagcctgtcaaaattgtagaggaaaataatggaataacattgatttaggaaatgtaaaatgcagttgtgtctttgtttatattctattgctgtgataaagaccatggactgaaaataacttgagtagaaagggctcattttgccttactgttttacatttcatcatttagggaagtcaggggagaaacctagagacaggaactgacgcagaggccatggagcaatacttactggcttgttttttcatggattgcccagcctgcttttccataaactccagaggtaccatcacttataatgggttggggcctcccatatcagtctttagtcaataaaatgcacccccccagacttgcatgtagaccaatctagtggaggtatttttctcagtttaagtttcctctttccagaaactaccctggcttatggtttgtttgtttgtttgtttttgtttttgtttttgttttgtttttttgaggcagggttgatctgtgtagccccggctgtcctggaactcactctgtagaccaggctggcctcgaactcagaaatctgcctgcccctgcctcccgagtgctgggattaaaggcgtgtgccaccaacgcccggccaccgtggcttatgttaaggcaacaaaaaacttaactagttacaagttgagaggccatgtaaatcagatttcagcaagtagaaccttaaagtgagactgcagataatcaccctgagtatgtatcaactttggaaaaactgttccatttttttctgtgcaatagatttatgaagtatagtagacttcttcccagaaactacccgaagtttgaggttacaccttacatatggaaagtcactgagatgctctggtttaactgttgctaacaagcaaaagaaacttgtcctaagtattgccattttgtttttaggttccatttaataatagggggggaactaagttcaaagtcccaggccctagaggagctggggacttcccaagagctgaacagtgtctgttactcatcttctgttccataacataatgactattgctaaccacagctcccattcatcctttgttccccaaaacataatgactgttcctaactacaaaagaacaaatggatttgattggatggactctaaaacctacattctgtatcagttgacatatatcaaccgctaaggaaagcccttatccctaaatcctaattggtaggaaaatgtaactataacttggcacagatgattggggttttcaagcttaaatattctgtaattttctgggtaatggttccagttcagtttttgagtctgttctgctgccctgatctatcagtagtgtcttgattaaaataaagtttgtcatccaaattgacctggtgtttgaactgtattggatccaaatggactccataacatgacaatttggtttccatgtgtttgtgctgtttggaaggttgggagacctttaggaggcataacattgctagaattgggttcctgggaatgaaacttgaggttttatggcctgatcatttatctgctttctgcttctgacttcagatgcaacgtgaccaaatgtctcataatcctgctgctgtatattcactgccatgatggactgtatccattcaaactgtaagcaaagacaaactctctcttataagatactttgtcacagagatgagaaaagtaagatttccctttcttccctccctcctctctctccctcccttccttttatccttccttccttccttttttccttccttcctttatttttttccttccttccttccatccttccttccttccttccttccttccttccttccttccttcccagactgacttaaaatttatgaccttgttcaagatgatcttaaacttgactctgtgagctggaattacagtcatatgaatgctgttcattttatgtggcctagatgaggaaagctttctagtcttcctctgaaactaatttttcaaaaataatgttcttggggctggagagatggcttagtgtttaagagcgatagctgcttttgtagagttcctgagttcaattcccagcaaccacatgatggatcgcaactatctgtaatgagatctgatgccctcttctgtcacgtaggcatacatgcaagtagagcactcatatacataaataatataataataatgttattataaggtagtttaatttttgtcagtcccaatcacaatttctgaataacaaatggaacaattaccaacacctttgccttttaaagctataagtaccatttccattttttataacctgaaagcacattttcagcaatacttttaactgtatttgcccacattgcaatctcatgtggcttcaaataaatgcgacttttctttagccttcactagactgagttaattctaggtcatcagcattgttttgttttcatttttcatttttaaatattaagaactaaaatctgaaatgtacaaggtgatattacttagagtatgtttacttttaataatgcttttcaaataatcccattttataggtgagaaactgaggttcagagtaattgaaatctataagatcatataattgacatccaagtagtctctaaatatagtgtttgttgcttaaaaattggagtggagatggaattgaaaatgtacattctgagaaatatatctttagttactattattgtttgaatgtcatgtagcatatttagataaaccaaggtggtatgtatcaattcagctaagaagcacagcaaacattaagtgtgtgaaacagctgtctgctggtttttttgcttgtttgtttgtttacagtatagctatcttttaaaaattagttattttatttatttacatttcaaatgttgtcccgccttcctggtctcctctctgcatcgtccccatcccatcctccctcctctttgcctctatgagcatgctccttaacccacctacttttgcctcactactctagcatccccttatgcctgtgacctgtccagcaggtccagttattcgagggtctcgaggggaccttctcctaagaaccaaatggggggatagagagagacaaggaccaagtgcaagaacgacatggaaacattccgagtggcatcaaggtcctgctgtattagcaaggctcaaggtttaaatgcacaagcaaaaggggaagtacttctcagcaggaggaatggggcagcggaaatgcacctcagcaggagggatggggcagggaaaaagaggaagtacttctcagcaggagggatggggcagcggaatttttcttttggcgactacacggggaagcaggaacttggtggtatcagggtacatcttgaggtcaggacatccagcgctgacttagggctggaacaatctgtggttgttctcggagcggtacatcggtgacccacttttgacccccttttcttcttgggtgggggagaggcccaattcagagatcaggacaattgtgttgtcttaatagctcccaacatgcctgggcatcaagcctctatgggaccaagggcctgccctcccactgatgaccaacaaggccattctctgctacatatgtggctggagccatgggtccctccatgtgtactccttggttggtggtggtttagtccctgggagatcttgggggtttgtttggttgatgttgtccttcctgtgaggttgcaaaccccttcaactccttcactcctttccctagctcatccatatgggtcccccagctcagtccagtggttggctgagagcatctgcatctgtatttagtcaggtgctggcagagcctctcaggagacagctataccaggctcctgtcagcaagcatgaagcagctttctgaatagtaatatttttgtttttaagcattatatactgtacagaattgtatatgctatattttataggtttgtccagcatagcatttgtataggtatcaattaaaaagtcagttttattttaaaacgtccatcaagaaatgattaaaattataatttgataaattttgaccataaatttgatcacttgatactctttgcagcataagaaataagatggttgctgtatgttttcattgtgaggcaaactagtcatttttcatggaatatcattttattaaaagaaacaatgaacagaacacctttggttattcaaaatcaacatcttacagactttttttctaaataattaataagatgaaccacttatttcattacaaacagttgagaatatgtgtgccaatgatgaaatttaagctttcagattaaaattagaattttggaaaatttgttcccattgccatagctacattgcttcatgatgaaatcattcagtaatatttaatgaaggttgtatttttaggttgtgcaatggaatggggagagctgcataactcagtgagttaatacatcaaaacatgatgttgcagaattatgcatgtgtaaagttggtattcaaagtggaagatgggactttaggtttttgtcttggcatgtaattagtgtaggattcaaaatcccattctaaacaattaagcaaactgaaaaacagcaatctttttaaaatataacacagaactgacatgctgttgaaaaccactgagccttaaattgaattaatggggcaaatatagagaatcacatcttagcaggtaagagactttcaagcagaacctttgtagaccctgtccttatgaggaaaacctcaaccatgtgtctgtaatgaagatcagctgtgagcaaggtaagagctaaagcttgagtatacattagtaaaaacttccaacatgaaaagcaaaaggacaacaaaactaaaaacaaaaaatccccaaacctgaaaactttgtaatgtagaaagaaaatccataagctgtggggcaactaaaaacgttcagtgtataccaagtgtgagtgttaagggtgaaaataaggaacaaaagaaatatttgaagggaaaatgactaagaatttattcaagttaatatcagataccaaatcatagatgtggcgagctcaccatgtccaaacagatggtagaacacacagatgaaaccaaatcaaaccaaacaaaattaagactagatttatcatacaaactacagaaaaccaaaggtaaagaaacaatattgaaaggagtgagaggaaaaatagacactacttaaaatatatctgatttcttagaaagcataaaagcaaaaataaagtgtatactttagaatttgagagacataaactatatcaaactagaatcttgagcctctaaaacttattctttaaaggtgaaggagacatactttcttagacaaacagaaattaaggaagtttgttatccctgccctgttggaaataatagaagtttctttagaaaactgagcacttagctaaataaaggcaagatagctataccaagaaactacaaatgtcacaactctagatgcctagacctaagtgcaaaatcatgaacaaccaagacaatatgcctcctgagaagccagcaaacctactgcaatgtgccctgagaaaaacaatttcactgaagcacaaggaggatttcaaaatagcaattatgaatattttcaagaactttaaagaggatataaataaatgtcataattaagaccatgaaaaacaaacaaatgaaataagaaaaacaatctaagatttaaaagtagaattcaaaaagaaatataattcaagctgggcagtggtggtgcacgcctttaatccagcacttgggaggcagaggcaggcggatttttatcaatttgaggccaacctgatctacaaagtgagttccaagacagccaagggtacacagagaaaccatgtctcaaacaaaacagaacaacaacaaaaataacaatagaaaataaacaaaatagaaatagaattcctaagaatagccaaattgaagtaaactcaaaatgaaaaactcaggaaatcaaaaaaaaaaatcttaggtaagcctcatcaacagattaaaagacatagaagagagaatttcaggtcctggacataataaaatagaagaaatctataactcagtcaaagaaaatactgcatcttaaaaattttaggcacagaatattgaggaaatctaggacattatgaatagacaaaaacaaactaaacaaacctacaaataaaatgtataggaggagaaataagtcaaaggcacaaaacaaatatttttattattagttttaaattttatttttgagattataatataattaattcatttctcacttcctttccctccttccaaaccatcctatcaaactaacccaccaagccaaatcctcagtgctagaagtgagttagttccatcttgctgagcttttggccaaagggttcctagagaaagggatacacgcatccatcattggtgagaatgcaaacttggacatgtactatacaaatcagagtggaggatcctcactgtaagaaataggtctactaaaagatgtagctatccaatacttggacatatacccaaaggtctctactacagagacacttgctcatccaaattcgttgctgttctactcataatggcagaaattggaaacaggctagttgtacatcaactgaaagaatgaaataatgaaaatgtgctgcatttatacaatgggatattatttagctgttaaaaaattaaattattaaattcacacataagtggatgaacatagaaaagaatatattcagtgaggtaacacagactcagaaagaaaaatatttgcatattttcttttacatgtggctgttgatatttaagctttagattttatttacagttaccacacaggttgtaagggatccctgagaaaaagaaggggatcttgcaaggaaatggaagtagaatacagtgttataaaaagataaagggaaaactagaacaggtagagtaaatgaggaggggctgggcaagtagggtaaagtgagttatatagggaggatcaattaatactaaaggccttttgaaaaacccatatgtgaacatactttagaagcttactaagtagatacatatgtgaatgtgacttaaatgtagtgggggagacttgctccaaatatccatttaattctaccaagtaaaatcctcagtgctagatgagttacatcttgctgaatttttggccaaagggttcctagagaacctcccagatattgcaggctatttcctgatgataaaaccctattgttgatgctaacatttatgtcattggacatagagaaattcagctggtgcctaactagaagcttcactcctactgactagagttcatggtacttgaaggtattatagatgctaccagatgagaatggtaatcatcaaaatctcccagctccaaagtctgtgtcctgcccacaagatgtattagtgtaatagtgacataaatgttatgggagtaaccaactggtttttaaaaaaattgaatctaaggcccattcagtgagatagaacccatacctgacactagtcaagtagccaagacactagttaagccacaggccttggggaaaacctactactgttaatttgctaaaggaccatagcaataaaataactcccttatgacataatttctgtatgcgtaagtaagtgcagcacaaagcctcattatagagaagcttcttgcaatagatgataattaacacggatacccacaactggacaatgtatagagactaagagactttggagcactcagtcctaaatgcagtgtctttatcaaatccttcccctcaagcctcggggatctatgaggcagaaagattggaagagcgagaggtagtagatgagtccttggaaagagtatcttacagacacagcaggactgatacacacattaactcacagaaactgtgacaccatatggaagacctgcccaggttcaaactaaacaaaatcccacggttaagaaggggaagtgggcacaaaatcccacccctaaccaagaaactctttgaaatcaataacttttaggagagggaaaaatcagttttctccaagtgaatgacattcgaccatactcgaaagcattcctcctgctcaggagtacttgtccaatacaagacagactccaagtttcagtggtattattttttgtttttgttttggtttctttctcatttcagttttgttttgactttttaatactttttacagatataaaaagaacatgaggttggttagttagcaagatggggagtatttgggaacaattttggaggtgatagaatatgataaaatatactgtcataagcattttaaaaatccaatgaatacacctctgggggctcccagccatcaaccaaagagcattcaagggcttatttgtaataatagtcagaagcttgaaaccaaagaatggatacagaaagtgtggttcatttacacaatagaatactactcaactattaaaaatgaggaaaacatgaatattacagggaaatgtatggacctagaaaatatcatcctgagtgaggtgaaccagacctaaaggatgtaaatgatacatattcactaataagtggatattagcccaaaagttcagaatacccaggacacaactcacagaccatatgaagcttaacaagacggaaggcccaagtgtggatacttcaatcctacttagaatgtggaacaaaatgatcacaagaggcagagggagggaggaaccttggtataagggggaggggagggaaaggggggcaggatcaggtatcagggagacaggagagaagcccagagggccagaagaatgaatagaaatatgtagtagtgtgggatggctcctctgagaggctctaccagcagcagactcagacagatacagatactcacagccaagcattgggctgaggtctgagaaccctatggaagtgttaggggaaggacttacagagtttaaggagattacaaccctataggaagaacaacagtatcaactaaactggacccaacagagctgccagaggctaagccaccaaccaaagagcatatatggactggtttgtggcccatgctacatatgtagcagaggatgtagtagagatatgtagtctgtcctcagtgggaaaggatgtgcttaatcctgtagagacttgacatttctctggatatttgcaccacactgctgtaagtttgttgatccagtcacttacttgtattctgtccattatgaatgaacggatgtattgtgaaaaatgtgtcaaatatttaactaaacaagatataccatatctctgccttgcatttcctctttcaatctaataatccaacagaaatagtgtactttgcccttactcattttgttggattggcactggctgttgttaaacaccaggttcttcctgcattattgataaatcattaactttattatattgctgatattttatattatgtacatcattttgaattttatatagctttccttttctttctttttttatttctcctcattagataactacaaatttatattcattcttctggtatcttccacatttcaaaattgtagatatttcttatagcaactgtctaatttgaatgagagtgacacccataggcttatatttgaatgcttggtccccagttaatggaactgtttgggaaggattaggacatatgtccctattggagcagatgtgaccttgttgaaggatgttgctggagttggaagcccacacaaggcccagtctctctctccccatcccctcccctacctcttcctctctttcttcctctccctctctctgtctctctgcctacaacttacggatcattctgagctctcagctatttcattgccctacctccctgctgctgtgtttcctgccatgattgtcatggactaaccctctggacccaatggaccaagtgttctctagacagattgggatccaactcactgtttcctacaacatgtataggtatacatcaccattttggcctcctatgctgctggtgggtttagcctctatgactagggaacatgctgtgaggggtttgaatttcagcctacacggaaggtccatgagcaggtgtgtttggagaaatagaaacaatgaggttaggatgattatttcataactgtctgtttctaaccattgggggatattcagttattcaggaagtgaaattatagaaccaaaacatagcttataagagtcacagctataagtatagtaaggattttaactcattttaatctttatcatctcacctgttatatttcaattctccattagccatatttcttttactttctctggttattcattcttaaagaaaattaaacaaactagaagttaagtaattctgccttttcatttgataaggatctaagtactcagaagaatgaatatatgacctatgtacatttcattctgtttatatgtatcataatacattctgtattagtattagcatgtttgtgagactgtttcactttacgcttagcctctgttatacacgtgacagggttattatgctgtgatgtgtttagtctcatcatctgttgaatgtcctccctttcatcttttactcattatacatgaggtgtgaattcaaacttttaaactatggcttataataagaaatttatttcacagtcatgaccaagtgcacatgcacacatgcaactgaatgaatatgtattgtttcagtctgagcccaatcaagatacaaaaaaaatctacaaggattactactaccccccccccccgtgtgtgtgtgtggtttttctatattttatttcaagtagttcaatgtatatttcctttctttaattacaactcaattcttcacatgttagaaatggtaatttgcaaattcatttggaataacaaaaacctaggatagcaaaaactcttctcaaggataaaagaaccactggtggaatcaccatgcctgacctcaagctgtacaacagagcaattgtgataaaaactgcatgttactggtacagtgacagacaggtagaacaatggaatagaactgaggacccagaaatgaacccacacacctatggtcacttgatctttcacaagggagctaaaaccatccagtgggaaaaaagacagcattttcaacaaatggtgctggtacaactgacggttatcatgtagaaggattggaattgatccattcttatttccttgtactaaggtctagtctaagtggatcaaggaactccacataaaacttagaagggggaacaaaatacccatggaaggagttacagagacaaagttcggatcggagcctaaaggaacgaccatgggggtactggttagttcatattgatgttccttctattggggcttcagtctcctctcagctcactgggtatttctctggctccttcattggtgaccttgtgctccatccaatggatgactgtgagcatccacttaatgtatttgccaggcacaggaccatgctcatgggggagtctctggatgttgttttcctaatttctttctcagcctgttgatcctttgcatagagaaaggccactaatttgtttgtgattagttttatatccagctacttcactgaagctgtttatcaggtttaggagttctctggtggaatttttaggatcacttatatatactatcatatcatctgcaaatagtgatattttgacttcttcctttccaatttgtatccccttgatctccttttgttgcctaattgctctggctaggacttcaaatactatactgaataggtaaggagaaagtgggtagccttgtctagtccctgattttagtgagattgcttcaagattctctccatttaatttgatgttggctactggtttgctgcatattgcttttattatgtttaggtatgggccataaattcttgatctttccaagactttttatcatgaatgggtgttggattttgtcaaatgctttctcagcatctaacgagatgatcatgtggtttttgtccttgagtttctttctatagtggattacattgatggatttccttgggatgaatcctgcctgatcatgatggatgattgttttgatatgttcttggattgggttttcgagaattttattgagtatttttacattgatattcataagggaaattggtctgaaattctctttctttgttgggtctttgtgtggtttagttatcagagtaattgtggcttcatagaataaattgggtagagtaccttcagtttctgttttgtggaatagtttgaggagaattggaattaagtcttctttgaaggtctcatagaactctgcactaaacccatctggtcctgggatttttttttttttttttttttttttttggttgggagactattaatggctgcctctatttctttaggggatatggggatgtttagctcgttaatctgatccagatttaactttggtacctggtatctgtctagaaaattgtccattatatccagattttccagttttgttgagtatagccttttgtagtaggatctgatgatgttttggattttctcaggttctgttgttatgtctctcttttcttttctttttctttttttttttttttttttttttttttttttttggtttttcgagccagggtttctctgtatagtcctggctgtcctggagctcactttgtagaccaggctggcctcgaactcagaaatctgcctgcctctgccttaaaggcgtgtgccaccacacctgactatgtctctcttttcatttctgattttgttaattaggatattgtccctctgccccctagttagtctggctaagggtttatctatcttgttgattttctcaaaaaaacaatctcctggtttggttgattctttgtatagttctttttgtttccatttggttgatttcagccctgagcttggttatttcctgctgtctactcctcttgggtgaattttcttccttttgttttagagcttttaggtgtgttgtcaagttgctagtgtatgctctctctagtttctttttggaggcactcagagctatgagttttcttcttagcactgctttcattgtgtcccataaatttgggtatgttgtgactttattttacactgcaaagtaatatgtacttaacaaatgatacactcaaaagtctaactatctatgctaatttcagtatggacttcatatacaaatatagtgtattttagccatatttcacaatcttttattcttttattctgatcactacagaaaagtttaggttgcagttggtattaaagtacacttctgtatcctgttgccttaagaagctttttgtttttaagttcaaagcacaatgcttttatgtccacacttcactgccattttctgagtcacaagttgtaggaaaaacctcacaggttataagaactaaatgaggcttagactcagacccagaactttgatttttttgtaacctgtatctaccttggaagtgtttgaagataatttcttaaataacaataaaggaattccaaattaacttggaaatgaccatacctatctcattatgttaaatatgtcacctcttgtctactggtgaactatcttgtatccgtaagcatcatgaaaagaggagggagaagcaagttcattgtttttgtttgtttgtttgtttgttttgtttgtttgtttggttttttaatgtttatagcaggtttatttcttttctttaatttttttatgttttttttattacgtattttcctcaattacatttccaatgctatcccaaaagtcccccacaccccccctcccctacccacccattcccattttttggccctggcattcccctgtactagggcatataaactttgcctgtccaatgggcctctctttccagtgatggccgactaggccatcttttgatacatattcagctagagacaagagctctggggtactggttagttcataatgttgcacctacagggttgcagatctctttagctccttggatacttcctctagctcctccattgggggccctgtgatccatccaatagttgactgtgagcatccacttctgtgtttgctaggccctggcctagtctcacaagagatagctatatctgggttctttcagcaaaatcttgctagtgtatgcaatggtgtcattgtttggaggctaattatgggatgaatccctggatatggcaatctctagatggtccatccttttgtctcagctccaaactttgtctctgtaactcccaaaacctaatctttcaaagtagtttaacctactaaatgtgtctatatatgtctgtatatatatatatatatatatatatatatatatatatatactttcttagaaagtatattcttttctttccttcctgagatgcatacacttaagcaagtcatgaataacttctagctaagagttatgggtattaggtgtaagtatattccttatgtttgtgatgcaaatgacacatcctatagccttaaacatgagctgcctttgatgaagaccgaacacatgggcaggtgagcaccaaggcagaagctttatgtacacaagctatgtgtgatggtttgtatattcttggaccagggagtgccaccatttggaggtgtggccttgttggaataggtgtgacctggttggagtaggtgtgtcactgtgagtgtgggcttaagactctcaccccagctgcctggaagtcagtcttccaccagcagcctttggatgaagatgtagaactctcagctctgtctgcgccatgacagcctgggtgctgctatgctcccaccttgatgataatgaactgaacctctgaacctgtaagctagccccaattaaatgttgttttttataagacttgccttggccatggtgtctgttcacagcagtaaaaccttaagacagaagttagtaccgtaagtggggtattgctgtgataggctttaccatgcttttatttgaaagaacgtggatttttggactttgaattttgaactcagtggaatgctttaaatggggcttaatgggtcatcgtagtaggaatatgggagactttgttgctgggagtaatttgaactgtgttgacctggcccaagagatttcaaaggagaagaatttcagtatgtggcataaagattgtttttgtggtattttggtgaagaatgtggctactttttgcccttgtctgaaaagtctgcctgaggctaaggtgaagagactcagactaattgcactaattgcattgacaaggaagtttcaaaaaagcccagcagagactttgttctctggttaagtctcagaaagagaagtttgaacacacatagcaagcttagaaaggcaaaatataaaatatatggttcgagtattaaaggcataccaggaagtgaaatggagcaaaatcctgtgttcgaggaaataacagattaagggagtgggaccttggggcaagatcctacccagctgaatttagatccaggcaaggtggtacacacctttaatcccatgagacaggcatgctgatctctgcattcaaggtcaatctacagagcaagatccaggatagccaagcttaggcagtgaaggatttagaaaacataaagccagtgataatgtaatagtacaaggggatcatgttctagttcctgtaaacagcagaactgggcagcttcagccatgtggctctggctctagagttaagaatggaaggaactactgggacaattgatgccggttagctggagctaagacattagcaaagagaccagcatcactgagttgaaatctgggagttgttttctgggagcacaaagaaactgtgttccagagatagccaaggttgtacttcatgcttcagctggacttggtaatatgtaagagtcacccaggtgatactggttttgaaggcatgaaggtgtcatgaagaacagctgaggctgtgagaggtcatggaaggccattggagaaggtgtagcctcagctgtagttgatggcccaggactgaaggggtcaggcaaagaatttgatgcttggcaccatgaagagagcctatgagagactattggtgaagcctacttcgagtggaacaccccagtgtattggagatgttagtaccatgggatgatcaccaagcagccgtaatggagtggatcaacctgagcttagtgtgctacagagtgcagagctggagaagtgatgccagcccttaggaggagtccaaaagatcaagtggaatcccagacactgaaacaagaagcgttaacattgaaattgccttggagactcaaagatgttaaagatgccagagccatgggatacatgctgaggaaagctgctaacagggagtggaaccagcccaggagaaagcagtttgttgcagtcaacaaagacaaaaaaggaatggagatctgaagactgctttgacatcagccatggaggtgcagagtttggagtttgcccagctggtttcctgccttgttttggagattacacttaattagttgaataaatctcagaagagcccttgaactttggactttgaacattgttgagactgctatagactataaggactttgaaagttggactaaatgcattttgcattatgctatgtttaagtatggcccccatagactcatgtttttgaacaagtctatgagggccagggagtggaatgggatggtttgtgtatttttggaccagggagtgccaccatttggaggtgtggccttgttgaaatatgtatgacctggttggagtaggtgtgtcactgtgggtatgggcttaagactcacaccccagttgcctggaagtcagtcttccaccagcagcctttggatgaagatgtagaactctcagctctgtctgcgccatgacagcctgggtgctgccatgctcccaacttgatgataatggactgaacctctgaacctgtaagctagccccaattaaatgttgttttttataagacttgccttggtcatggtgtctgttcacagcagtaaaaccctaactaagacactttgttaactctgacactgaacaggaagggtaagacttagaacaaagtcttccattcagaaaaccacaccaaccttacttttaaaattgtgataatttaggctttccaacatttataaggagtattcagggtgatctatgcagcatccaagaagccaacagcacttttgaaacttcagggctcagcagtaccttgaagactcactattcactctgtggttcagcttctcctttttaactgtgactgggatctagttcatgacctgtggttctaaattctgctgctctctctttgcctctgtccctgtatatactagagggaaaaggctgactgaaattgggttttaatgttcactcatccactcacttctcagcctgttctagtgaccatgcagaaagccactcagcttagacacagactcaggtcactgttagtcactaagggggacagagatgtactctctgacacatcatccttccgaaggttcaaaaaggattttcaagttatctgaaggatctctctcaagcctttgttttcttgttcaagttgaaatatccattcctattctttgcaaccctgctgctagtcaatttcaatagcttttctcattactgctgccatctcagtgatctggtcaacatgtgcttgcaactcctttgagtgttgctcttttaacttcattattatacctgggtcatcttttttgctggccattagcaatctgaacatctgctctctgtacgtgctcattttcaattccaaggcagactggtgctctcccaaggatgtttgcagttctttgttatcttgttataattctctgatgtgtctgttttcttgctggattcccataactagtgtggatcgtggctgatatcttgctacttcattaagttcttggatttcttcctgatactcttcattgcttccactcgcttgctgagggcagtggtctgctggatgagagactctgctgcatcatcatgatctctcaacctttcagcaagggctttagggtcagcaagtgccttctcaacggtgcagctcatttctcagttcccagcaggacctcagtgagagcatggagagagggagcccagcccagagggctcacccatgtgtgttattccactcagcttcagtctcctggggcacccagggagtggtctccgtgcccttgctgcacctgctcagcagatgcatagccctgctcacacagtgacgggaaggacaggcaccccacttgtcttggccccatccagggtggtattttatattcatatgactaggtaatttctattgttctactttccagtttattgactccctaccctcttgccttctaaatttcaataaggaacccatttgcaaatctttttaagttctaaaatttccatcaaggactggagagatggcagtgggtaaaagtacaagcataaagacccaagtttagattcctaatgtccacgtaaaagccagatgcaatagcatttgtccataaccccagcaaagggtacacaactaaagacagtaattctccctcgaagaattttatcaatagctacaatttcaaaattaaagggtagtttttcacgatcccttccttcttttgttgttgctagagctgatcttgctcaatgtaggcaagagcagttgaggtgagttaatgattacattggctttatggagtgtaaggaatggcatttcataactcttcacactgttttctggcttttgcatgccctcttttccacagtgttctctgatccatagaggaattagtacaaatgacttgtttagagctgggttcaattcgttgcttatttggcatctcagcagccatgagtctccttattcaccattgtttattataaggagagacttctctgattgaggcttgggtttgcttttgtctatggaaataaacaggaatttagaaggcagtttgctgctatgttaattcagtccaccattagaattgtactctttctgggtctgcacaacctcacaaaacttgggttgttagtcaggcttactcgtagtagatcttaaatccattcagagggcagttgtttgttatatcttattttctaaatgatttttatacttcctttatcctggctaagtctccatttatcttgtactttgatatcccaaatcagcccttaccccactcggtgaataaactgttccaccggcagtcttccctttctttttccctatcttctactattcctccttcaggaaggtaacccctccccacattgcattctttgtttcctggtttttacaggtactctatgttagacatactatactaaagaattgaggcaaaaaaaaagccaggtgtggtgccgcacacctttaattccagcactcgggaggcagaggcaggtggatttctgagtgaggtcagcctggtctacagagtgagttccaggacagccagggctatacaaagaaaccctgtctcgaaaacaaacaaacaaacaaacaaacgaaaaaaacagaattgagactagaatcttcatatgacagagaacatgtgatgtttgtcctttgaagcctgggttacttttcttagatttttttccagtttcatccatttccctgtaaattacataattttgcttttttaaagctgaataatattcatatacaagcatacatatataaaatctttatcaatttatcattgctgtgtatctaggctgcctccactttctagcttttataaatagctcaatactaaccatgatcatgcaggtatgcctgttgtaggatgtatccaggaatggtagagtagggccatatgctatttttatttggtgccttcagcctgatgtccaaactggctgcagtagttttctttcttatgtgaacttgaacttttgatacctgaagagtgctaaaattacagacatgacaactccatacctgctttatgtgacattgtaaatttagcccagctttttgtttgtaccattagtatttttcgaatgctaacgttttcagctccaggtctaagaaatataaggaaaactaaaaaacccagggactgcactaccatgttgtttttcagctcccaagatagcctgtttctttgcttttcttcatatttcattcaagtggaaattcctggtttttctggggactcggttgtgttgtgtgatgtctttctggaaactcttatgagaggatgtttttctgaagcagacacgtgatcttctggaagctacctggaaagagggcatgtgatgttgtgctgaaatggacacttgagaggacacgtgctatttggaaagggtgtaaggataacctaacagacagtggacagtgctctggcattggatctccttgccactctttgctggtcttcattggtcttctttgctgacactggctatcactgatgatggtgtggcattggttcacttaccttctttgctgatcatcacttgtcttgacttcgtagagagaaatgcagcaaagaacttcttgtgagagaagcttcttgtcactcccacaaacttaggtgaattggcataaccttgtgatttcttctggattgaactgctgttgctgattcacaaatggtgcttgagactggatcgagctaccactgctgactcgtgggaactggattgctgatatcctggcaacaaagatttgaatcacctccccctcaaaaaattatttctaaacaggtccatatccccatttgccctattagcttttcctttctactacctctggtgagtggtagactagaagggaggttaaagcatttaagaacccttattaaagcagtgtttgaagaatctaagcctacatttctttttttattttatttactcatttattttttattagatgttttctttatatacatttcaaatgctatcctgaaagttccctataccctccctccaccctgctcccctacccacccactcctgcttcttggccctggcattcccctgtactgggaaatataaagtttgcaataccaaggggcctctctccccactgatggccagccgactaggccatcttcttaagcttacatttcataatcatctttgtttcatatataaaatttaaggttctagttgtacttagcatgtaaactaggggaaaatgtacctaatttcaataaatgaaactacatacctttttatatttgtgtgcatgcatagtttcccatagagtccagaaaagcagaagagggtgttgaatcctcttacactgggattacacatggttttgcaactgagtcttgttttgttgtccagtccagcctagaactgagaatcacctggtctctgccttttgagtactccaagttagcttttaaataagattttaagatgaaggattttagaacccagatgtccctcaacaaaagaatggatacagaaaatgtggtacatttacacaatggagtactactcagcaattaaaaacaatggatttatgaaattcttagacaaatggatggatctggaggatatcatccttagtgaggtaacccaatcacaaaagaagtcattagatatgcactcactgataagtggatattagccaagaaacatagaacacccaagataaaatttgcaaaacaccagaaaatcaagaagaaggaagaccaatgggtggatacttcattcctccttagaatagggaacaaaatacccatgaaaggagttacagagacaaagtttggagctaagatgaaaggatggactatccagagactgccccacccgggaatccatcccataatcagccaccaaacccggacactaatggtgcacaatgccagaaagattttgctgaaaggaccctgttatagctgtctcctgtgaggctatgccagtgcctggcaaatacagaagtggatgctcacagtcgataagatggaacatagggcccccaatggagaagctagagaaagcacccaaggagctgaaggggtctgcaaccctataagtggaacaacaatacgaactaactagtacccccagagatcgtatctctatctgcatatgtagcagaagatggcctagtcggccatcactgggaaaagagtccccttggtattgcaaactttatatgccccagtaccagggggacaccagggccaagaagcgggaatgggtgcgtaggggagcagggcgtaggaagggtatagggaactttcgggatagcatttgaaatgtaaataaagaaaatatctaatgaaaaatcaaaaattaaatttaaaaagatgaaggattttagatacttatttaagatagatgcaaaaaagttattttaagtttaaagactatttatttgtttcgccagactccctgggtccatgtctttgtggaaatcaaatcagtccaaaataccaagaataactatcacaaatatggacatttatttgcagcaaataaggaaacaatgagaaataacttctaaatttgtgactagaggaagctagggcaggtggtaattattttggctaggaatacatattcagacatgagaatggcattgtcacatgtaggttaggttgatttggcacaagtactgtaaagcaacatgttccttcatacttatggaaatggtgcttctgttttttcttagttgtgtattttgtcatggtatcatggtaatgacataaatttcatttgataaactcataaatagaaataatttctatttctattcctgaaatagaaattaaaggatataatagaaaacttttgattagcagcccaggctgctgagtgggagagaatctatgtcctaccttcataaggttactgaactggagaaattctgtatctttcgtaggctgctgatggggagacaactgcatcttgctttctcagcctaatcttcttctaataaggtttttttttaaaaaaagaattagcattatgagtgctagagaatacttagttaaactatggtattggttctttgatagaacaatttctgatcagggtaatggatcatgatatttttaaaaggtcgtcattgagaaaaatgggaaataagtattgagtacttaagtgtcattattttgtgtttcatgcaatttaacacactcaaacacaacagtcattatcttgatttaaattcacatcaggaaaatataaaatgaacaaagaacccatttatcattttatttccaaagatgataacttgcttgaaataaaatgctcttgtgtgtaaatgtattatttatttttaaatttaaaagccttctctcttttttttatatttaggcatgaattttttttaattagttattttcctcatttgcatttccaatgttatcccaaaagtcccccataacctccccccaactcccctacctacccactcccactttttggccctggcgttcccctgtactagggcatataaactttgcaagtccaatgggcctctctttgcagtgatggccgacaaggccatcttctgatacatatgcagctagagtcaagagctccggggtactggttagttcatattgttgttccacctatagggttgcagttccctttagctccttggatactttctctagctcctccatagcctttggtggtgacttgacctggcgatatcagtatggcttcaggcagaagtacagaccacacctggcctttggtggttgcatgggccagtgaagtaaaaactatctctggctgtagaaggaccataccacggatgccatcctggccatctgctatagcatggaccacagatatcaacagagcctcaggtggtagcaaaagccattcatattaacatggcccccgtggcaaccaggaccacagatactgtggcctcctatagcacagttttttgtgtctttattttagacatcctactattattgctcagagctagggctatcatgtggctgagcagtgtgttggggcagggctcagtctgcacaagtgccagtcagctgcatgccaccttgccagctatacttggcaaggacatgttctcaacctcagccttctttcacacatcactgctttcatgtctctatgtctctctctctctctctctctctctctctcacacacacacacacacacacacacacacacacacgactccatcccttcatctttcccatttctacacctcatattcatttgtcatagtggcattgtaaactgcagtctgtcacacagtatattttttgttcaaacagctttatgcaaatattcattgtaatgagttattagtctgactcaagatttctgacacactgtaaacactagaccacctctgaaactcttttggatatcttgctgtagcccagagtcaggatgatcttgtagtggatagagcatcagatagcaggttccatgctgcagcacacctccccaccctcaatattggctgcccagaggctccctgagcttgccctttgtgccatcttccagcagaacatgaagtccaggctgcaaccacagagcctccatgctgggggacctaggaccagccctattcagtaatgacatcgggttctgcaggcctggctcctccatgcactccaatagttcattgacagagtagatgttgaggtggactgactcaagcactggatgtgggcccagatggcagctgagttagtctgcctgggatccatgcactagtgctttttgtttgtttaacccattacaaaacaaaaataatatttgtgtagctctccagtttaatgtgatgagaaactgatgtggtggttagttatttaacattccttctagatagaacacacttggaaaatgtgagtaattatggcacaggcctctttagtaactacttctacttaataacatttaggaattaaaaataaagctgcctgttaaccacgttcaaagtaaaaattaaaagaaaataccagtaaatttgttgaattacttaaatatcttaaatttattataagtattttctctagtaacatttaatcgtctataagcatattcattatatcaatctataatgatatttttatttagttgaaaaattaaattaatctcttgaattcatatttttgcttttcttttctatttttattataagccataattacttcttccttaggctgtgcatcctgatactaaagataacagaaatccttttttataaattgcatttattatttttattattattaaaattgtattgttcctgtgggcatcatgatgatgggtgcaggatgcgtgtttgggaacatgtacacagcacacatggaaattagaaaatgatttggcggagttggttctctccttccacctttatgtggtaccaataacccatcaagcatcatcacactgtctcagatgagacaaaaatatttaagcagatttcttcatgaactcatatagatactacatatttaggtctataaatatttttaaagaccaacagcaaataaatattcctttgaacttttaaatttgctgagataaaggctaaggatatcagttttgttggataagaagcaattaatgaaatgcctagccatttcaatcttgagatccaaaggccatttctttcttttgtttacgatactttctttgcttttctcttgtaatggaactcatcaatactccttctttcctttgacattctattctccactattatggctacatagtgggcatgtgagcacccatttcttgagctttttccaaagataaatacataataccctgtttttaaaagattgatttatttattttatgtatatgagtacaccattgctttcttcagacaccccagaagagggcatcagatcctattacagatggttgtgagccaccatgtggttgctgggaattgaactcaggacctctggtagagaagtatgtgctcttaaccactgagccatctctccatccccataataccctttttaataaaatgcttctaattgaaaaataataattttgtgtattaatatggaataatgtgagtttttttaagaaaaaaaactgactttgtagcaaatgctggcctcaaatttatggtcctttttcttaagcctccaaaatgctgagcttataggtatgttttatgtctaagcaatgtgatgttttagcatatatatatatatatattaaagttttcatatatatatatgtacatatatatatatatatatatatatatgatagatccaataaaattaattgatattcttaccataagtcccttttatttttggtatttttctaatgactctggataacagaaaattgaaaaataacatgtagataattcaattcatttctgcaagcactggttattgaatgtttataatgtgtcagaaaactgggttacttcttggataaatgagctcttgaatacatcacagcattgtggaaaacattacatttcagtttattagagagtggatagataatgttacaaaagtagtagaagctagagatgttttaatagtcatggtcattgatctttagttttctcttcactatggagatatttaaaacatttgatgatacatgctgatgggtattctgctcttcctttctgtagttttaacaatttagaccaggatggtcagtgcatctcagggggctacaaatagtcgtaacagtgttagctatctgtccaattgggtagccttcctagaggagttttcttgaccttagtatggagtaactccagagtactcccatgaacacttttttttttcatgtaggttgatagtcatgcttcccttttgtggaattttagtatatgaggacctagctggatatgttcattttatatgtgcatgtttgttgttgttgttgttgttgttattgttgtttggtatctacagtctttttctatatttttattagatattttcttcatttacatttcaaatgctatcctgaaagtcccctataccctccccccatcctgctccccaacccacccactccagcttcctggccctggcattcccctgtactggggcatatgatcttcacaagcccaggggcttctcctcccattgatggccgacaaggccatcctctgctacatatgcaactagagacacagctctgggggtactggttagttcatattgttgtttctcctatagggttgcagacccctttagctccttgggtactttctatagttccttcattggggaaatgtgttccatccaatagatgactgtgagcatccacttctgtatttgccaggcactggtatagcctcacgagagacagttatatcagggttctgtcagcaaaatcttgctggcatatgcaatagtgtctgggtttggtgattgtttatggaatggatccccaggtggggcagtcgctggatggtcattccttccatctcagctctgaacattgtctctgtaacttcttccataggtattttattccccattctaagaaggagtgaagtatccacactttggtcttccttcttcttgagtttcatgtgttttgcaaattgtatcttggatattccaggtatttgggctactaatatccacttatcagtaagtacatatcatgtgtgttctttatgtggttgggttaccttactcgggatgatatcctccagatccatccgtttgcctaagaatttcataaattcattgtttttaatagctaagtagtagtccattgtgtaaatgtaccacattttctgtatccattcctctgttgagggacatctgggttctgtccagcttctggctattataaatagggctgctatgaacatagtggagcaagtgtccttattacaagttggaacatcttctggatatatgcccaggagaggtattgctggatcttctggtagtactatgtccaattttctgaggaaccaccagactgatttccatagtgattgtataagcttgcaatcctaccagcaatggaggagtgttcttctttctccacatcctcaccagcatctgctgtcacctgaatttttgatcttagccattctgactggtgtgaggaggaatctcagggttgttttgacttgcatttccctgatgattaaggatgttgaacattttttcaggtgcttctcagccattctgtattcctcagttgagaattctttctttagctctgtaccccattttttaatagggctatttgattttatggagtccatcttcttgagttctttatatatattggatattagtcccctatcagatttaggattggtaaagatcctttcccaatctgttggtggcctttttgtcttattgacagtgtcttttgcgttacagaagctttgcaattttatgaggtcctatttgtcaattctcgatcttacagcacaagccattgctgttctgttcaggaatttttcccctgtgcccatatcttcaaggcttttccctactttctcctctataagtttcagtgtctctcgttttatgtggagttccttgatcaacttagagttgagctttgtacaaggagataagaatggatcaattcacattcttctacttgataactgccagttgtaccagcaccatttgttgaaaatgctgtctttttttccactagatggttttagctcccttgtcaaagatcaaggaaccataagtgtgtgggttcatttctgggtcttcaattctatttcattcatctacctgtctgtcactcaaccagtatcatgcagtttttatcacaattgctctgtagtacagcttgaggtcaggcatggtgattccaccagaggatcttttaatagtttttgctatcctaggttttttgttattccagatgaatttgcaaattgctctttctaactctgtgaaggattgagttggaattttgatggggatttctttccccttgagggacttttatatgtgacactgttgttctcttgctgtttttcttgaacttttggcaattaaattatgtatgttaaagaaaaataattttgataaaaataaaattggaacactttggacatcctagatataaattttttaatatctccaaggatagggaaagtctcatgctctttcctgttgttatttttaaatggactatgtgggcactgcagagcatctgggaaagggtcctccaggcctactcctgcactcaggaggtggagctcatcctcagtcctctgtgcaccttctctgccaggagagagcttgcctccagggagtgctctgacaccaggactcaggggttgtcaccattgtctctctggtgacactctaaggcaagtccactcaggagagcacaggtctcagaagcagcagagcttcagggacctacaggcctacatctgcactcaggaggtgggactgctccgcagccctctgtgcagtggtcttgccaggagagagctggtctcccaggagtgctaacacaggctgacagactcacaagaggaacaatctccagccagagacagcaagaacatctaacaccagagattaccagatgatgaaagacaaacacaagaatattaccaatagaaaccaagactatatgacatatcagaacccagtactcccactacagtgagtcctggatactgcaacacaccggaaaagcaaggtttgtatttaaaatcatatctcatgaagctgaaagaggattttaagaaggacattaataactcccttaaagaaatacaggagaacacagctaaacaggtagaaggccttaaagagaaaacacaaaaatccttaaagaaaaaaaaaatctttaaagaattacagaagaacacaggtaaataggtagaagcccttaaagaaaaaacacaaaattaccttaaagaattacaggaaaacacaaccaaacaggtgatggacttgaacaaaaccatctaatatctaaaaatagaagtagaaacaataaataaatcacaaagggagaaaagtttgtagatagaaatcctaggaaagaaatcaggaaccataaatgcgagcatcagcaacagaatgcaagagatggaagagagaatctcaggtgcagaagatttcatagagaacatggacaaaacaatcaaagaaaatgcaaaatgcaaaaagatcctaactcaaaacatctaacccctcttccacaaaaatccctaagcttggagtgaaatatgaattatgatcttgggctaagcactccacagtattttgttctcagcatattaacaagttgggagtctctgtgattgttgtcatctacttcaaagaggaggttcttttatgagggttgacagagataatctgtgatctgtaggcatatctgtaggtcattaggagtcatttttaatactgttcatttttcatggtaatacttctataagtcctatgacctatctagccagaggtttttggctactttaatagcgacatgtgtaggctccatctcatggagtgggcctttgatctgatcagaaagtggttggttattcccataacattaatgtcactattctactagagggcttgacttgtcagaataatcattgttatatctcgcagggtttactggtggacaatactgaggcttatgttatccaattgtgaacagataggttctaagaaattattttgatttttctgtatttgctatgtattttttttgtcctgaaatgagatctgttttagaaattgtctcatgaactactgagaagaatgtatattctctagtctttgggtggaatagcctgttaagttgatttgaactataatgtcattgaactgtgatatttcttttttaatgtttttgtctgagtggcctgtcggagttattgaaatcaaggtttatttggggttgaggtcaacacatgcctttatatacagtagtatttattttatgaaaatgggatcaccagcgttcagggcacatgctttgtggctataaattcctttagtttgtgttcttcatggaaagttttcctttctccaattgtgaaagatggtgttactggatatagtaatatgatttggcagttaatgtttttcagaaaacttggagtacattttttttcacaccctctaagcttttagaatttcttttgagaaacctgctgttattcaaatgggtttaactatatgtagcttgtgggttcccttttgcagctttcaatattttttatgttgtgtatccttaatgtttaactatattctagagagattctttcctggtcttgtctgcttaatgtacaaaatgcctcctgtatctggatggccatctctttccttagatttgtggaattatctgctgtgaatttattgaatatattatctaagctgttagcttgaaatgcctttctttctttctcatgcttcacaaatgtgttcttttaatagtatctgacagctcttctcttctgtttgtagttacttattattttatcattgctgttgtatagatgttcacattcatcttgtttggctttaagacttgctattcttgaactttatccactgtattgacaagactttccactgaatagtttattttcttacaaagcttttcatttataaaatttcaaaatttccaggcatttctttctctttgttaaaattttctttcaaatatccagtgttgacttgctttttttattaatcattttatttgtttacatttcaaatgcaacaacccttcccggctacccctccataaccctccccatcctacccccctcccccctcccctatgcctctatgagggtgctccttcatccactcacctactcctgcctcaccactctagcctccccctgtactggggcatcaaaccttcacaggacccagggcctctcctcccattgatgccagagaaggccatcctctgctacatatatagctggagccatagatccttccatgtgcactcccagtgcctgggagttgtggggtttctagttagttgataatgatgttcttcctataggggtgaaatccacttcagctccttcagaccttcccctagctgttccattgaggtctccaggctcagtcccatggttagctctgagtatctgcatctatattggtcgggtgctggaggaacctctcaggaaacagccatgccagacttctgtcagcaagccctttttggcattagcaatagtgttgggatttcatgtctgaagatgggatgaatccctaggtgggacagtctctgggtggcctttccttcagtccctgttgcgtttttttttatccttgtctttcctttggacagaaacatttctgggttaaaatttttgagatggaggatggcccatccatcaactgggggccatgcctatctattggaggtggtctctataggcactgttttcccctttgttgcatattccagataaagtcatccccattggatcctgggagccttttgcttccctggtgtctgagactgtctaatggctccccccagctcctcatcctccactgctacatatttttattcaatttgctgaccctttgtacttctctcttgtctcttccaatacctgatcctgccccccttttctcctccccatcctttatccctcccaggttcctcccttcctctatctcctgtaattattttgttctcccttctatgtaggattgaagcatccacaccttggcctcctttttaagctacatatggtttgtaggttgtatcatgggtattctgagcttttgggctaatgtccacttatcagtgagtacatatcatgtgtgttcttttgtgtctgggttacctcactcatggatgatattttctagtttcatccatttgcctttgaatttcatgaagtcattgtctttaatacctgggtagtacctccattgggtaaatgtaccacattttctgttaagggacatctgggttatttccagcttctggctattataaataagggtgctataaacatagagtatgtatccttgttatatgttggagcatcttttgggtatatgccctgtagtagcatagctgggtcttcaggtagaactatttccaggtttctgaggaactaccagactgatgtccaaagtggttttcccagcttgcaatcctgccagcaatggaggagtgttcctttctccacatcctggccaacatgtgctgtcacctgcatttttgatcttggccattttgattggtgtaaggtggaatctcagggtagatttgatttacatttccctgatgactaaggatactgaacatttctttaagtgcttctcagccatttgagtttcctcagttgagaattctctgtttagctctgttacccattttttaattagatattttctttatttacatttcaaatgtcatcccctttccttgtttcccctctgaaaaacccctatcccctttcccctccccctcctcaccaacccacccactcccacttcctggccctggcattcccctacactggggcatagagccttcacaggatcaagggcctctcctcccattgatgactgactaggccatcttctactacatatgcagctggagccatgagtcctaacatgtttactctttggttggtggcttagtccctgggagctctggaagggtactggttagttcatattgttgttcctctgttcaccattttgaatagggttatttggttctctggagcctaacttcttgagttctttgtatattttggatattatccctccatcatatgtagggttgataaatatcttttataaatgtgtaggttgtcattttgtctcattgacagtattcttcccctttcagaagcttttgttttgttttgttttattggttattatatttatttacattgcaaatgctgtcctccttcccagtttcccctgcacaagcccacatccactcctccctccctctgcctctgtgaaggtgctccctcacccactcactcctaccttagcagcctattgttcccctatcttgggtcatcaagccccccactcgaccaaggggatcccctcccactgatgccatataaggcagtcctctgctacatatccagctggagccatgggtactccctgtgtactttttggttgctggtttagtccctggcagctttgggggatttggttggttgatattgttattcttcctatgagattgcaaacccttcaactccttcagtcattgccttaacttctccattggggtccccacattcagtccaaggtttggtatctgtattggtcaggatctggcagaacctctcaggagacagctatatcaggctcctgtcagcaagcacttctcggcatctgcaatagtgtctgggtttggtgtctgcatgttgaatgatagaaccccaggtgggtcagtcactggatggcctttccttcagtctctgttccactcttcgtcccggtatttcctttagacaggaccaattctgggttaaaattttgggatgggtgggtggccccatccctcattgctacatacctctgttcaatttcctgaccctctgtacatctcctccatctcctcccatacctgattcttccccctctcttttcccttcctctcttctcttcctctcaagttccactacttcccttgattattttgttcccccttctaaggaggactgaagcatccaccctttggttttccttcctcttgagcttcatgtggttcatgaggtgtatttcagaattaagacatctcggtagatttttttccctttgataagtatgtccttccttaactttcttaataacttttggtttgaaagttgatttttttttcggtattaaaatggctactccagcttgtttcttgggaccatttgcttagaaaattgttttccagtcttttactcagaagtagtgtctgtctttgtccctgaggtggagttcctggatgcagcaaaatgctgggtcctgtttacatattcagtctgtttagtctatgtctttttattgggtacttgagtccattgatgttaagagatattaaggaataatgattgttgcttcctgttattattgttgttagaagtagaattatgtttaagtgactatcttcttttgggtttgtagagagaagattactttcttgctttttctagggtgtagtttccttccttgtcttggagttatccatctattttctttgtagggctggatttgtggaaagattttatataaatttattttggtcaggaatatctccattttttcatctatggtaattgagaattttgctgggtatagtagcctgggctggcatttgtgttctcttagggtctgtatgacatctatccaggatattttggcttttcatagtctctggtgagaagtctggtgtaattctaatagtcctgcttttatatgttacttgacctttttcccttactgcttttaatattctttctttgttttatgcatttgatgttttaactattgtgtgtcagggggaatgtttttttctggtccagtctatttggagttctgtaggctttttgtatgctcatgggcatctctttctttaggtttgggaagttttcttctatacttttgttgaagatatttattggccctttaagttgaaaaatcttcattctcatttatacctattatccgtaggtttggtcttctcattgtgtcctggatttcctggatgttgtcagttaggacttttttgtattttgcattttctttgattgttttgaccatgatttctatggaatcttctgcacctgagattctctcttccatctcttgtattctgttgctgatgcttgcatctatggttcctgatttttttcctaggatttctatctccagagttgtctccctttgggttttctttattgtttctacttccatttttagatattagatgttttttcctgtaattctttaagggatttttgtgtttcatctttaaagacttaaagacttctacctggttagtagtatcttcctgtaattctttttttttaagatttatttaaatttttatatttttttgtcttcttttttattaggtattttcttcatttacatttcaaatgctatcctaaaagtcccccatactccccccactcccctacctacccactcccaagtcttggccctggcgttcccctgtactgaggcatataaagtttgaaagaccaaggggcctcttttcccagtgatggctgactaggccatcttctgctacatatgtagctagagacacgagctctggggggtactggttagttcatattgttgttccacctatagacccctttagctccttgggtactttctctagcttcctgtaattctttaagggatttttgtgcttcctctttaaggacttttacctgtttagcagtgttctcctgtatttctttaaggtgtgttggggtatccaggactcactgtggtgggggtaccaggttttgatgatgccgagtggtcttggtttctgttagcaagattcttacgtttgcctttccccgtctggtgatctctggtgttatatgtcttagctgtctctggctggagcttgttcctcctgtgattctgttagcctctgtcagcactcctgggtgactcaactttctattgagtcccagtggtcagagcactttctgcaggcaagctctcctcttgcagggaaggtgcacagaggactggggctcagctctgcctcttggctgaggatgaaggccagaagggaccctgtaaaagaagctctgttacttctctggcccatgtgctctcctgcgtggactggtctctgagagacccagaatacaagatggtactctcccctgagtccctgggtcagtgccctcactggaggccaactctactctggcagggaaggtgcccagaggtctgggtctcagctctgactcctgactgaagatgaaggcccaaagggatcctgtccaagaagctctgttacttctgtgtcccacgtgctctcctgcgaggactggtctctgtgagactcaggatacaagatcacccttttattttttcaatacctaatagtgctcctgttatgttcatgttttccctgataatttcatgtattagagaaatcatgcaatatttggttttataaaactatataattgtacttaatataatctacagtttcatcattttcctgaaaatgacataatttcatccttcattgtggcttaataaaaccctcacctgggactgttatctgggctaagaatatttggacaagttataggcctaggagacactcaaacattattattctgttaaatggacatagcattaaaatcagagatggtgcacttaaccctcaaaagactggaggccccatggaatttagaggtcaggtggggtagagggtagggacatccatgtggagactggggttggggaggaggtgtgggatgtggaacagtcggagggtggatggggggggataaaatatggagtataaaaataaaagagaagtttataccaataaaaaatattcctaaagacttactgtttttaatttttcttctctctcatatattagatccaaactgcagtttcagttccctcttcatcttttcccagcacccccttttctggaaggcagacttcccagggatatcagagaaatatgacatatcaagttgcaataagactaggtacctcccctcatattaaagctggacaaggaggaaaaggataccagaagcaggcaaaagagttagacagctcccactcccaatgctaggagtctccgaagaaaaccaagctacacacccataacatatatttagaggaactaggtcatacccatgcaggctacctagtctctgtgagccaatgtaagcccaggttagttgattctgtggtcccttttcgtgtgtggtgtccttgactcttgtttctacagtccttacccccatctctgtaagattccctaagctctgcctaatttttggctgtgtgtctctacatcaatttctatcagttgcaggatgatgattatgctaggctcaggtctatgagtatagcagagtatcattaggaatcattttattgagtttttctcccacttgtgattggttctattctagatcactgggctatccaccctctggttcctggtcctctagacagtgtcaggggtgggctccctcttctggcatgggtcccaatctaccaattattaattaactgctcccacaatttctatgcgacctttatcccacccagcatgtctcgaaggcagaaaaacttgtagattgaaggttttgaggctggattggtgtaccagtccctccagcgaaaggcttaactggttacaggagatggatagagtcaccctcaaatatttctgggaatttccattgcactagatttctacttcatcctcaaatgttcccgaattcagttgtctcttcccagtaagtactctggttccttttctgaaagtataaatcaccttttactaatgacttattatacccatggatttgtacatctctcagccctcttcagagagagaggcttatcgtagtaattggcaattaacacaaggatcccctaccattcaatattcagagaacataagactgaaatattcagccctaaatgaaacatatatatgatgcccattctctcaagactcagtgatctttgcagaagagggattcaatgattagaagaaccagaagtgttagattactatatgaaaactgttttcaagacttacaagggcagttccacatttgaatttgtgattgcatacacaaaaccattgcaagctccagtcaaactaaaatccccacaaggagaagggtggtaggcacaaagtcctatgcctacctgaggacctataggcaattgataactgtggaaatggaaattcagtttttattaaaggtgtgatcactgataaaagtcacctattctccagcgaaatgccacatttccaagaagatatagacagcacaaattgtacttcattgattttttttaaactatatcaacccattttttttagccttattgaagcatacttcagtgtaattatataatctaagagatgaaattttatatgctatataataaaagcattttaacagtttttgataaattcatatataaccagactcagaatataacaaatatactttgattgatttgttcagtaggattttcattattcacatgtgttatctaccttctcagatgtctctcttctttcatagatgtcacttgccttctacctacttctagtttatcttattgcatctaatacttgccaggaaaaagtgaaacaaaaaatgttgagttgttgcttaaaagataatgtttaaatgagaggtgaaaggacatatcactgtagatactagcagcataataagggtttccatttagtgtgcagttgctatgttaaaggaattttactaaatgttttctataaccaccttatttaaacacccctttaatatatctggtacaatcctatcttacagatagagaaactaagccataaaggtttagcaaactgctcaaagtcacatagctagtaaattacaaaactgaatctccaacacaaattattttttaaaaacttaaaatcatttgtattagtttgtaattatatgtgcataattatttcagtatcatttcattaatgtcttttttacaattaaataataagttctatgggaatattggctatgtcacttttgagcagtattacatatagctctaaaacatagcatagtatctagaatatattagtctataataatggaatatattattatgtatttattattgaatgacagcattatccaacaatacttattcataattaattcatggtgtatttttgccattggtctgtgtaaaatgcaccactattttttacttaggtatttatttcatttacaattccagtgctaacccaaaagtcccccctacgctcccccacccacacccccaccctcccactcccacttattggccctggcattcccctgtactgaggcatataaagattgcacgaccaatggggctctctttccactgatggccgactaggccatcttctgatatatacgcagctagagacacgagctccagggggtactggttagttcatgttgttgtcccacctatatagggttgcagatccctttagctccttggttacattctctagctcctccattgggggccctgtgatccatccaatagctgactgtgagcatccacttctgtgtttgctaggccccgttatagtctcacaagagacagctgtatctgggtcctttcagcaaaatcttgctagtgtatgcaatggtgtcagcgtttggaagctgattatgggatggatccccggatatggcagtttctagatggttcatcctttcatctcaactccaaactttatctctgtaactcctaccatgggtgggtgttttgttcccaaatctaagaaggggcaaagtgtccatactttggtctttgttcttcttgagtttcatgtgttttgcaaattttatcttatatcttgggaagtttctgggccaatatccacttatcagtaagtacatattgtatgagttcttttgtgattgggttaccacactcaggataatgccctccaggaccatccatttgcctaggaatttcatgaattcattctttttaatagctgagtagtactccattgtgtaaatgtaccacattttctgtatccattcctctgttgaggggtatctgggttctttccagcttctggctattataaataaggctgcttatgaacatagtggagcatgtgtccttcttaccggttggaatatcttctgaatatatgcccaggagaggtattgctggatcctcccatagtactatatccaattttctgaggaaccaccagactgatttccagagtgattgtacaagcttgcaatcccaccgacagtggaggagtgttcctctttctccacatcctcgccagcatctgctgtcacctgaatttttgatcttagccattctgactggtgtgaggtgaaatctcagggctgttttgatttgcatttccctgatgattaaggatactgaacattttttcaggtgtttctcagccatttgctattcctcaggtgagaattctttctttagctctataccccattttttaatggggttatttgattttctggagtccacattcttgagttctttatatatattggatattagtcccctatctgatttagaataggtaaagatcatttcccaatctgttggtggcctttttgtcttattgacgatgtcttttgccttgcaggagctttgcaattttatgatgtccgatttgtctattctcgatcttacagcacaagccattgctgttctaatcaggaatttttctcctgtacccatatcttcgagggttttccctactttctcctctataagtttcattgtctatggttttatgtggagttccttaatccacttagatttgaccttagtacaaggagatagaaatggattgattcgcattcttctacctataaccgccagttgtgccagcaccatttgttgaaaatgctgtcttttttccaatggatggttttagctcccttgtcaaagatcaagtgaccatagttgtgtgggttcatctctgggtctttaattctgttccattggtctacttgtctgtcgctataccaataccatgcagttttttatcacaattgctctgtaatatagctttaggtcaggcatagtgattccactggaggttttttttttttttatccttgagcagagtttttgctatgataggtttttttgttactccagatgtatttgcagatttccctttctaattcattgaagaattgagttggaattttgatggggattgcattgaatctgtaaattgcttttggcaagatagccatttttattatattgatcctgctaatccatgagcatgggagatctttcaatcttctgagatcttctttaatttctttcttcagaaacttgaagttcttatcatacagatctttcacgtccttagttagggtcacaccaaggtattttatattatttgtgactattgagaagggtgttgtttcactaatttctttcttagcctctttatcctttgtgtacataaaggccattgacttgtttgagttaattttatatccagctacttcattgaagctgttcatcatgtttaggaattttctggtagaatttttagggtcaattatatatactatcatatcatctgcaaaaagtgatattttgacttcttccttgccaatttgtattcccttgatctccttttgttgtcaatttgctctggctaggacttcaagtacaatgttgaataggtatggagaaagtggacagccttgtctagtccctgattttagtgggattgcttccagcttctcaccatttactttgatgttggctactggtttgctgtagattgcttttatcatgtttgggtatgggccttgaattcctgatctttccaagattttttatcatgaatgggttttggattttgtcaaatgctttctcctaatctaacaagatgatcatgtggtttttgtcttttagtttgtttatatactggattacattgatggatttccatatattgaaccatccctgcattcctgagatgaaacctacttggtcaggatgggtgattgttttgatgtgttcttggattcggttagcaagaactttattgaggatttttgcattgatattcataagggaaactggtctgaagttctctatctttgttgggtctttttatggtttaggtatcagagtaattgtggcttcatagaatgagttgggtagagtacctcctgtttctattttgtggaatagtttgtgaagaactgggattagatcttctttgaaggtctgatagaactctgcactaaacccatctggtgctgggatttttttggttgggagactattaatgactgcttctatttctttaggggatataggactgtttagatcattaacctgatcttgatttaacattggtacctggtgtctgtctagaaagttgtccatttcatccaggttttccagttttgttgagtatagccttttgtagaaggatctgatggtgttttggatttcttcaggatctgttgttatgtctcccttttcatttctgattttgttaattaggatgctttccctgtgccctctagtgagtctggctaagggtttatctaagagtttagctaagggtttatctaaggctaagggtgttgattttctcaaagaaccagctcctcatttggttgatttgatagttcttcttgtttccccttggttgatttcacccctgagtttgattatttccttctgtctactcctcttgggtgaatttgcttcctttttttctagagctgttaggtgtgttgtcaagctgctaatgtgtgctctctctagtttccttttggaggcactcagatctatgagttttcctcttagaaatgctttcattgtgtcccataagtttgggtatgttgtggcgtcattttcattaaactccaaaaagtccttaatttctttctttattccttccttgaccaagttatcattgagaagagtgttgttcagtttccacgtgaatgttggctttctattatttattttgttgttgaagatcagccttagtccatggtgatctgataggatgcataggacaatttcaatatttttgtatatgttgaggcttgttttgtgaccaagtatgtggtcaattttggagtaggtaccatgaggtgctgagaagaagatatatccttttgttttaggataaaatattctgtagatatttgttagatccatttgtttcataacttctgttagtttcactgtgtccctgtttagtttctggttccatgatttgtccattggtgaaagtggtgtgttgaagtctcccagtattattgtgtgaggtgcaatgtgtgcattgagctttactaaagtttctttaatgaatgtggctgcccttgcatttggagcatagatactcagaattgagagttcctcttggaagattttacctttgatgagtatgaagtgcccctccttgtcttttttggtgactttgggttggaagtcaatttaattagatattagaatggctactccagcttgtttcttcagaccatttgcttggaaaattgttttccagcctttcattatgatgtagtgtctatctttttctctgagatgagtttcctgtaagcagcaaaatgttaggtcctgtttgtgcagccagtctgttagtctatgtctttttattggggacttgagtccattgatattaagagatattaaggaaaagtaattgttgtttccaattatttttgttgttaaagttggcattctgttcttgtggctttcttcttttaggttcgttgagggattaccttcttgctttttctaggtcgtggtttctatccttgtattggtttttgtttgtttgtttgtttttgttttttttttcgtcattatcctttgaagagcaggattcgtggaaagataatgtgtgaatttgtttctgtcgtggaatacttttttttttctccatctaaagtaattgaaagtttggctggatgtagtagcctaggctggcatttgtgttctcttagtgtctgtataacatctgtccaggctcttctggctttcatagtctctggtgacaaatctggtgtaattctgataggtttgcctttatatgttacttgacctatttcccttactgcttttaatattctatctttatttagtgcatttgttgttttgattattatgtgttgtagtggctattcctggttgtcaacttgacaatatttgaaatgaactacaatccggaattggaaggctcaccagtgacccttatctggaggcttggagatccttatctggatcttggtttgaagatcttgagccatagtggctatggattccagaagattgaatctccgagtttaaggaacacacctttaatctgggctacgcctttcatctgggattaaaggtgtggtggaacacacctttaatctgggctacaccttctgctggagacaatataaggacattggaagaagggagtctagctcttgctctagctcttgctcttgctcctttgcctgcttgctgcgtgagactgagtaactgctagatccttggacttccattcacagctgcaactgaacaattgttgggaattcggctgccgactgtaagtcatcaataaattcctttactatttagagattatccataagttctgtgactctagagaaccctgactaatacagaagttggtaccaggagtggttctagagtaacagaagtacaaggatgaatcttttaaaatactggaattggcttgttgatccaccagcactttcaaatattgaaacctctccagattctctccctcctgggagctcagagaattttgaagacccatggttgaaactatattccgaacttaaagaagctaatgcccttgattttcttaatgaattaggtgattcagtgcacaaagctttctacaagatggggaaaaaatcgaaaaatgattttactggctggctgctcttagtatctgtggaaaaaatgatgaatgaaaggaaggagttgtgtgataaaatcggaaggctccagacacaagtaaacgatctaaaagttgctaagtgtgtccttgaggagaatcttctctcttgtagcaatagagctcaagttgcagaaaatcaaacagaaactctcattgtaaggttggctgaactacagagaaaattcaagtctcagcctcagagtgtgtcgacagttaaagtaagggctctaattggcaaagaatgggatcctacaacatgggacggggatgtgtgggaagaccatgttgaagctgagaattttgaatcctcagattctcaagggtttgccccacctgaggaagtagtaccctcagccccacctcttgaaataatgccttccccacatgaggaaattaattttgcagagtctgctcaaggcccaccaatagtttcttctagacctgtgaccagactcaaagcaaaacaggctcctagaggggaggtagaaagtgtggtccatgaagaaattcgctacactactaaggagcttaatgaatttgctaattcattcaagcagaaacctggtgaatatgtgtgggaatggattttaagggtgtgggataagggtggaaggaacataaaactagagcaggctgagtttattgacatgggtcctctgagtagagattctaggtttaatacagaagctcgcatagttaaaaaaggtgtcaaaagtttgtttgaatggttggctgaggtgtttatcaaaagatggcctactggaaatgacttggagatgcctgatattccgtggcttagtgttgatgaagggattttaagacttagggaaattgcaatgctagagtggatatattgtgtaaagcataattgtccacaatgggaaggtccagaagatatgcctttcaccagctctataagacgcaaattggtgagaggggcaccagcacatttaaagggttttgttctttcccttttccttgtgccagatcttagcattggagatgcttctgctcaattagatgaattaaattcactgggtttagttggattccgaggtaacaagggccaggtggcagcattgaatcaccggagacaaggtgattctagttattataatggacagcgtagacaaaagaatgtttataataacatacccagtaatggtcagcacaggagaggtgaaatttataatggcatgactcgcttggacctttggtactggctaatcaatcatggtgtttccaggaatgaaatacataggaagcctactgcatatttgtttgatctgtataagcagaaaaattctcaaacaaatgaaagaaaggctacattagatcgtggtaaacagcaatctcggccagtgaatcaatttccagacttgagacagtttgcagatccagaaccccttgaatgaaggggtggccaggttccgctgaggaaggatcttgataagacactcaaaggttttgctgttaccctttctccagttcttccccagagggacctacggccttttacaagggtaactgtacactggggaaaaggaaataatcagacttttcggggtctgctggatactggttctgagttgacactgatcccaggggatcccaagaaacattgtggccctccagttaaagtaggggcttatggagggcaggtgattaatggagttttgactgatgtccgactcacagtaggtccagtaggtccccggacacattctgtggtgattttcccagttccagaatgtataattgggatagatatactcagaaattggcagaattctcatattggttctctgaactgtagagtgagggctattatggttggaaaggcaaaatggaagcctttagagttgcctctgccaaagaaaatagtgaatcaaaaacagtatcgtattcctggaggaattgcagaaattactgccactatcaaggacttgaaaggtgcaggggtggtggttcccaccacatctccgtttaactctcctatctggccagtgcagaaaacagatggatcatggagaatgacagttgattatcgaaaactaaatcaggtggtaactccaattgcagctgctgtaccagatgtagtttcgttacttgagcaaattaacacatctcctggcacctggtatgcggctattgatctggcaaatgccttcttctcagtacctgtccataaggaccaccagaagcaatttgctttcagttggcaaggccaacagtataccttcacagttttgcctcaaggatatattaactctcctgccctgtgtcataatttagtaagaagggatcttgatcctttggatcttccacaaaatatcacattggtgcactatattgatgacattatgctgattggaccaagtgagcaggaagtagcaaccactttggactcattggtaacacatatgcgtatcagaggatgggaaataaatccaaccaaaattcaaggaccatctacctcagtgaaattcttaggagtccagtggtgtggggcatgcagagatattccttctaaggtgaaagataagttattgcacctggcccctcctacaaccaagaaagaagcacaacgtttagtgggtctatttggattctggagacaacacatccctcacttgggtgtgttacttaggcctatttaccaagtgactcggaaagctgctagctttgtgtggggcctggaacaggagaaggcccttcaacaggtccaggctgctgtgcaggctgctctaccacttggaccatatgacccagcagacccgatggtacttgaggtgtctgtggctgatagagatgctgtttggagcctctggcaggctcctgtaggtgaatcacagaaaagacctttgggattttggagcaaagctctaccatcatcggcagacaactattctccctttgaaaaacagctcttggcctgctattgggccttagtggaaactgaacgtttgacaataggacaccaagttactatgcgacctgaactacccatcatgaactgggtactatcagaccctgcaagtcataaagtgggacgcgcacagcagcagtctattatcaaatggaagtggtatatacgtgatcgggccagagcaggtcctgaaggcacaagcaagttacatgaagaagttgctcaaatgcctatggtttctactcctgttacaatgccatctgctgccaaacatgtgcctatagcctcatggggtgttccctatgatcgactgaccgaagaggagaagactagagcctggtttactgatggctctgcacgttatgcaggcaccacccagaagtggacagctgcagcattacaacccctttctgggacaaccctgaaagacacaggtgaagggaaatcttcacagtgggcagaacttcgggcagtacacatggtattacagtttgtttgcaagaagaaatggccagatgtacgattatacactgactcatgggctgtagccaatggattggctggatggtcagggacttggaaagatcacaattggaaaattggtgagaaagacatctggggaagaagtatgtggatagatctctccaaatgggcaaaggatgtgaagatatttgtgtcccatgtaaatgctcaccaaaaggtgacttcagctgaggaggagttcaataatcaagtggataagatgacccgttctgtggacaatcagcctctctccccagccatccctgtcattgctcaatgggcacatgaacaaagtggccatggtggtcgagatggaggttatgcttgggctcagcaacacgggcttccactcaccaaagctgacctggctacagctgctgctgattgccagatctgccaacagcagaaaccaacactgagccccagatatggcaccattcctcgaggtgaccagccagcaacctggtggcaggttgactacattggaccacttccttcatggaaaggacagcgttttgttcttactggagtagatacttattctggttatggatttgcctttcctgcacgtaatgcctctgctaaaaccaccattcacggactgacagaatgccttatctatcgtcatggtattccacacagtattgcttctgaccaaggaactcatttcacagccagagaagtaagacagtgggcccacgatcatggaattcactggtcttaccacattccccatcatcctgaagcagctggtctgatagaaagatggaatggccttttgaagacgcagttacagtgccaattaggtggtaacagcttggaaggttggggcagagttcttcagaaggcagtatatgctttgaatcagcgctcgatatatggtacagtttcacccatagccaggattcatgggtccaggaatcaaggggtggaaaaaggaatagttccacttactatcactcctagtgaccctctaggaaaatttttgcttcctgtccccataactctaggttctgctggcctagaagttttggctccagagaggggagtgctcctaccaggagctacaacaaacatttcattgaactggaaactcagacttccccctggtcattttgggcttctaatgcccctaaaccaacaggctaaaaaaggaataacagtgttaggaggggtgatagatccagattaccatggggaaattggattgcctctccacaatggaggaaagcaagattatgtctggagtgcaggagatcccttagggcgtctattagtactaccatgtcctgtgattaaagtcaatgggaaactacaacagcctaatccaagcaggatgaccaaggatgcagacccatcaggaatgaaggtatgggtcaatcctccaggaaaagagccaagacctgctgaggtgctggctgaaggtgaaggaaatacagaatgggtagtagaggaaggtagttataaataccaattaaggccacgtaaccagttgcagaaacgaggattataaagtactatgaatgctcactgtaaatttactaatgcgtttgcgattgtacgagggatagttatatcatgttaggggtattcacaaccttgttattgtttcatgtgaacatgagatattatttgtgtcaagttgacaaggggtggattgtagtggctattcctggttgtcaacttgacaatatttgaaatgaactacaatccggaattggaaggctcaccagtgacccttatctggaggcttggagatccttatctggatcttggtttgaagatcttgagccatagtggctatggattccagaagattgaatctccgagtttaaggaacacacctttaatctgggctacgcctttcatctgggattaaaggtgtggtggaacacacctttaatctgggctacaccttctgctggagacaatataaggacattggaagaagggagtctagctcttgctctagctcttgctcttgctcctttgcctgcttgctgcgtgagactgagtaactgctagatccttggacttccattcacagctgcaactgaacaattgttgggaattcggctgccgactgtaagtcatcaataaattcctttactatttagagattatccataagttctgtgactctagagaaccctgactaatacatgtgtcaggaggaatttcttttctggtcctgtctatttggagttctgtaggcttcttgtatgttcatggacatctctttctttaggcttgggatgttttcttctataattttgttgaacatatttgctggccctttgagttgaaaatcttcattctcatctactcctattatccctaggtttgatcttctcattgtgtcctgtatttcctggatgttttgagttaggatctttttgcattttccattttctttgattgttgtgctgatgttctctatggaatcttctgcacctgagattctctcttccatctcttgtattctgttgctgatgctcgcatttatggttccagatttctttcctagggtttctatctccagtgctgcctcactttgggttttctttattgtctctacttccctttttaggtcttggatggttttattcaattccatcacctgtttggtcgtgttttcctgcaattctttaagggatttttgtgcttcctctttaaggtcttctacccgtttagcagtgttctcctgtatttctttaagtgagttattaaagtccttcttgatgttctctaccatcatcatgagatatggattttaaatctgggtctagcttttcaggtgcgttgcggtgccctggactgggggaggtgggagtgctggggtctgatgatggtgagtggtcttggtttctgttagtaagattcttacatttgccttttgccacctggtattctctggaattagttgttatagttgtctctggttagagattgttcctctcatgattctgttagcctctatcagcagacctgggagactagctctctcctctgagtttcagtggtcagagcactctgtgcaggtaagctctcctcttaacagggaaggtgcacagatatctgttgtttggacctccctcctggccaaagatgaaggccaaaacaggacctgtctcagaagctgttagcttctgtagttcacactctcacctgcacagactagtctcagaagtatcccggaaccaagtggctcccccagatcctcctgcaaagccctcctgtgcagggcagacacctctcctgtggcagggaaggtgtccggatgtctggagcccgaaaagggggctgcctcagaagctcttttgctcctgtctgtcccagaacctgttagcttgtgtagtccacactctcacctgtgcagactactcttggcagagtcccggaaccaagatgtctcctcagatgctcaggcaaaaataatgcaccactttttagaaatttatttggttttgtatctattctgtctgacccaaccccaatcgaaatgtttaaatttttatttacgtgtgaattctttttaaattttactatttttatatatgtgtgtgttgcttgcacatatgtctttgtaccatgtttatacagttccctaggaggccagaagcaggtgttggatccccttgggctacagttacagatgggtatgagctgccatgtgaatgctgggtattaaactagggctctgtagaagagtagtgagtggtcttacttgtgccatcttttcatctctaaggatgaatcattatgagattttttcttttgtgtgcattttagttcatactaagtgatactatagaataaatattattttttatctgttcagtatgtctttataatatctatctatgtctcttgggctatatatagatcattgctttgtttaacaccaagtaaattagtcattcctaatactcagtttcactttatggtaactggcaaccacaactgaaaacattaaatgggggattacataaataaacgatttaagcattaaattgcagatccctattacctactattatgagtagcatggtgaaatattatgctattctgttctgtcccacgcagtccttttgtctaatgtatctatactgtatacaattgacatgtgtttcccatgtagtagctgtataagccaccaaatcaactgtcatggaattggagtgctggtgcttaagtaatctttagtttacttcatatgtctgaaacacaagatgaataatgctgtaaattcagataatagtaaaagtgctacatataaatgagaagataacagtttcacaaatgatttcccaaagaaagaataaatcttctacttacaaaattataaagaaggaaaaataagtccatgttagtttttcagttgaacttcaagaggcaaaagtcatggtcactgtgcatatgaagtatttagattagctgttatctatggctttagaaatccattgacaatcttgaaatgtatcttttatgaatacagtggaaaaggcactaatatagcccataatgtataaaagtaaatataaaaatcttgattccagccaggcgtggtggcccacacctttaatcccagcacttgggaggcagaggcaggtggatttctgagttagaggccagcctggtctacagagtgagttccagaacagccagggctacacagagaaaccctgtctcgaaaaacaaaacaaaacaaaaaatcttgattcctttagtcattattaaacaaccctggtgttatttttccctcattccatcttttaattatggattcattgctcctcctcctcttcttcctcttttttctccttagttgttgcccctctccactattccattttccacctcatgttatctgtaacctactattctctttctaccccatccccaatatggttcctctatatttataccatgttggtttctatggttgctccatattacatgctcatatttgaaggttttgagctaaaaatcatagatgagagagaatgtgttggttggttggttggttggttggtaggttggtttttcttagtctagggtacctcactcaatataatcttgtaagtctatttacttacttgcaaattcatgatgtcattgttctttttttatactttttattaggtattttcctcatttacatttccaatgctatcccaaaagtaccccataccctcccacccactcccctacccacccactcccatcttttggccctggcattcccctgtactggggcatataaagtttgcaagtccaatgggcctctctttccagtgatggccgactaggccatcttttgatacatatgcagctagagtcaagtgctatggggtattggttagttcataatgttgttccacctatagggttgcacctttaactccttgggtactttctctagctcctccattgggggccctgtgatccatccaatagctgactgtgagcatccacttatgtgtttgctaggccccggcctagtctcacgatgtcattgctctttacagctgaataatattccattgtgtttatgtgtcaacttttcattatccactttctgttggaggacatttaggttgctttaattacctggctgttgtggatagagaagttatgaacatgactgagcaagtatctgtgaaacggaatgactaatatccaatatatacaaagagctcaagaaggtggactccagaaattcaaataaccccattaaaaatggggtacagagctaaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctgacaaggatttggagaaagaggaacactcctccattgctggtgggattgcaagcatgtcaaccactctggaagtcagtatggaggttcctcagaaaattggacataatactaccagaggatccagcaatagctctcatgggcatataatcagaagacgttccaactggtaataagaacacatgctccactatgttcatagcagccttatttataatagccagaagctggaaagaacccagatgtccctcagcagaagaatggatacagaaaatgtggtacatttacacaatggagtactactcagctattaaaaacaatgaatttatgaaattcttggacaaatggatgtatctggaggatatcatccttagtgaggtaacccaatcacaaaagaagtcattagatacacactcactgataagtggatattagcccagaaacatagaacacccaagatacagtttgcaaaacacaagaaaatccagaagagggaagaccaatgggtggatatgtcatccctccttagaataaggaacaaaatacccatgaaaggagttagacagtttggagctaaaatgaaagaatgcactatccagagactgccccacccaggggtccatcccataatcagccaccaaacccagacactattgcatatgccagcaagattttgctgaacggaccctgatatagccgtctcctgtgaggctatgccagtgcctggcaaatacacaactggatgctcacagtcatctgtaagatggttcatagggcctccaatggagaagctagaaaaagcacccaaggagctaaaagggtctgcaaccctataggtggaacaacaatatgaactagccagtacccccagagctcgtgtctctagctgcatatgtatcagaagatggcctagtccgccatcactggaaagagaggccccttggtattacaaactttatatgccccagtataggagaatgccagggccaaaaagcaggagtgggtgggtaggggagcaggtcagggggagggtatagggaactttcaggatagcatttgaaatgtaaataaagaaaatatctaataaaaaaagaatgttaagcccttatgtatatgctaaacagtggcataactaggtcacatgatagatttattttcaacttttgagatttctccactgatttttttttttttttttttgaaaaatctccacactgatttccagggtaactgcactaatttgtattcctaacattagggaattaagattcgtctttcagcacaacgctccagcatttgttgttattttgttgatcttagctgttctgactaaggtcaggcaaagtctctaaagctgctttaatttgcatttccctaatttctaaggatgataagcactttcttttttttttttttttttttttcgagacagggtttctctttgtagccctggctgtcctggaactcactctgtagaccaggctggccttgaactcagaaatcagcctgcctctgcctcctaagtgctgggattaaaggcctgtgccactatgcctggctaagcacttttaaagccatttctcagccacctttatatgtcttctattgagaactctcagtttaaatccctagcccactttttatttggatcattttttcttgattctttgcttttgagtgctttgtatattgtatatattaatcttctgacagataaagagcagaaaatgatcccagtatctgacagaagaaactttctttcaagtgattggtcacggtagtccacatgactcccaaaacaacagaacccactaatgtagctctttgttctagctcaggagtttagggccattttgctgaaggcacaggactgagattcttgagctagacctgacctaaaagccactttcctgaaatttaacttctgtggttctaggaaatcccatgcccgcccgcccactgtgaagcaatgaaaaccaataaacagtcctagccagcagaaacacctgtgaatcatgacaattatgaatctgggaagatatgcaaaatagtgcaggaagtggcattcacatgtcagtggcagtcaacagtttcctgacactagtgaggtcctggaccttaggaaagaatctacttctgccacattgccagagcagcataatttctcattgctttttaaatcttgttcctatatacagaaataagtgtggctacaacacctcatcaaagaaccttctcattatagcaaatgaaaactatcatagaaaactagacacagtgaagagatcaacagattgtgtggaggccagccctaacagatacagctacacacagatcctgtatctattcctcagggaataccatcacagaagaggaggcagaaatattataagagccagaatgccaaaaggtctgctgtgaaacagtctcttctagaaatggccacataaacaaaactagaacaatatcagtgaaacgttaatgaggaagggaagacatttctcagggcttcaccattagaccaaaaaaacaaaaacaaaaacaacaacaacaaaaaaaaaaacccaaaaactacaggcaactaataactgctggggaaaaaaaattaatgatgactaggccatcttctgctacatatgcagccagctagagacacaagctctgggggtactggttagttcatatagggttcctcctatagggttacagacccattcagctccctgggtactttctctagctcctccattgggggccctgtgttccatccaatagatgactgtgagtatccacttctgtatttgccaagcactgggttagccttactcgagacaggtatatcagggtcctgtcagcaaaatcttgctggcatatgcaatagtgtctgggtttggtggctgattataggatgaatccccaggtggggcagtttctgaatggtcctttctactgtctcagctccaaactttgactctgtaacttcttccatgggtattttgttccccactctaagaaggaacgaagtatccacactttggtattccttcttcttgagtttcttgtgttttgcaaattatatcttgggtattctaagtttctgggctactatccacttatcagtgagtgcatatcatatgtgttttgtgattgggttacctcactcagtatgatatcctccagatccatccatttgcctaagaatttcataaattcattgtttttaatagctgaatagtactccattgtgtaaatgtaccacattttctgtatccattcctctgttgaggggcatctgggttctttccagcagctcattcattttatgtcaaataatgttctgcagtatagatgtgcagcatttgtttatccattcctgttgaaggacatctttcttacttccaagtcttgtacattttaacaacacacacacacacacacacacacacacacacacatacgtatttcacgtgtgtgtatgtatgtgtgtgaaaacagaggtgaatcaaggagactatttgagacaagaaattagcaacagcacaatgcgtgcttgccctggatacagaagctttcatgtagactaaatcagaaaaaaactagggtagtaatttgtagtgcctttaatttgaaattttggaaaatggaatgtgaattttactcattatgtattgggactggtaaagaataatttattactttaaattttgtacataagaatttttcttttggtatcatacactctttaaattattttctcaagcaagattaaatggagttataaatacagacatacactacagttttcagtttgaagaacaaagttactcagaaattaatattaatatttttccaaagtctaaaaataaagtttcagttggatcatttgtgagctcaaggcttcactgtacattagctgtgaaacaattaatatttataaaagttacaacattcaccatgggtttctgctactgattgtaacgacctattttttttaactttctacagctgtagaatataaaaagttaatttaatacagattattattttgttgcatacaatatttgatgcttaatataatgtatgatgggctttccttttagcctggttctattataagaaattcctcaaacattccacagtatttttggattagctgcaatttaaaaacattgtttacttaaagttcagattattttctcattctttcacattctctgtttgcattctatacttctactcagcctggtctctatgtcatatactggtggctgataatacccaggtgctctgtatatttactatagctttcagtttggtatttttatgtaactcctgattgtgtaaacaagtgaccctctgattcttggccttctcttgggactgttttccttctgttgagttgcctagtccagtttcaatgattttttttttacattgccttatattttactttgtcaacttttgttcttgtctcttagaaaccatatttttatttcttttttggatgttgaacaatattttattgagattccttcctcccagcctttacaatttcaaggtcaatttctccacttgtagatcttgttctctagttctaagaagatggatgggggctggagcccagagcactgttctatgagactcttgaagtggttgtaactatcttagtcatacttgaagaacatagtctgaagatgcagtgcctcataagagttcagagttgaggggaggtggaaaggaactgggaggaacagaggggaaactataatcagaatatattgtataagaaaagaaactattttcaatgaaaggaaaacataaaataaaaatatatataatgaaaactttaagaaactatatgtgctaatatccaatatatacaaagagctcaagaatctggactccagaaattcgaataaccccattaataaatggggtacagaactaaacaaagaattctcaactgaggaataccgaagggctgagaagcacctgaaaaaaatgttcaacatccttaatcatcagggaaatgcaaatcaaaacaaccttgagattccacctcactccagtcagaatggctaagatcaaaaattcaggtgacagcagatgttggtgaggatgtggagaaagaggaacacttctccattgctggtgggattgcaagcttgtacaatcactatggaaatcagtctggtggttcctcagaaaattggacatagtactaccagaagatccagcaatacctctcctgggcatatatccagaagaggtcccagccggtaagaaggacacatgctccactatgttcatagcagccttatttataacagccaagagctggaaagaacccagatgttcctcagcagatgaatggatacagaaaatgtggtacatttacacaatggagtactactcagctattaaaaacaatgaatttatgaaattcttgggcaaatggatatatctgaaggatatcatccttagtgacataacacaatcacaaaagaagtcattagatacacactcactgataagtggatattatccaagaaacatagaacacccaagatacaatttgcaaaacacaagaaaatccagaaaagggaagaccaatgggtggatacttcattcctccttagaatagggaacaaaatacccatgaaaggagttacagtgaaaaagtttggagctaagacgaaaggatggaccatccagagcctacctgtcttagtcagggtttctattcctgcacaaacatcatgaccaagaagcaatttggggaggaaagggtttatttggcttacacttccatactgctgttcatcaccaaggaagtcagaactggaactcaagcaggtcaggaagcaggagctgatacagaggccatggagggatgttccttattggcttgcttcccctggcttgctcagcctgctctcttatagaaccaagactgccagcccagacatggtaccactaacaaggggccctccccttgtgatcactaattgagaaaatgccttacagttggatctcatggaagtatttcctcaactgaagctcctttctctatgataactccagctgtgtcaagttgactcaaaaaaacagccagtacactaccccacctgggaatccatcccataatcagccaccaaactcagacactattgaatatgccagcaagattttgttgaagggaccctgattttttttttccattttttattaggtatttagctcatttacatttccaatgctataccaaaagtcccccttacccacccacccccactcccctacccacccactcccctcctttggccctggcattcccctgtaccggggcacacaaagtctgcgtgtccaatgggcctctctttccagtgatggccgactaggccatcttttgatacatatgcagctagagtcaagagctcaggggtactggttatttcataatgttgttccacctatagggttgaagatccctttagctctgaagggaccctgatatagctgtctcttgtgaggctatgctagtgcctggcaaatacagaagtggatgctcacagtcatctataggatagaacacaggtcccccaatgaaggaactagagaaagcacccaaggagctgaaggggtctgcaaccctataggtggaacaacaatatgaactaaccagtacccccagagctcctgtctctagctgcatatgtatcagaagatggcctagaccgccatcaccgggaagaaaggccccttggtattgcaaactttatatgccccagtatagggaaatgccagggccaagaagcgggagtgggtgggtaggggagcaggttgggggaagggtatagggaacttttgggatagcatttgaaatgtaaataaagaaagtatctaataaaaaaaaactatatgtgcttttaactgctgagccatttctgtatccaaaagaaacattttttaattttttatactttaattttatttgtaattcattttttacactccatattccattcccagcccctccccatccaccatccaactgctccacagcccacacctcctccccaccctaccctgtcaccacatacatggatgcccccatctcccaccccacctgacttctaaactccctggggcctccagtctcttggaggttaggtgtatcatttttgaatgaacacagacccagaagtcctctactgtatgtgtgcctggggccttatatcagctggtgtatgctgtctgtttggcaggtcagtgtttgagagatctcaaaggtccaggttaattgagactattggtcctcctacagaatcacccttctcctcagcttctttcagcctttcctaattcaacaacaggggtcagctacttcagtccattggttgggtgcaaatatctgcatctgactctttcaggtgcttgttgggtcttttggaaggcagtcatgctaggtccctttttgtgagctctccagagcctcagaaatagtgtcaggccttgggacctccccttgagctggattctactttgggcctgtcactggaccttctttttctcagtctcctcttcatttccatccctgtaattctttcagacagaaacaattatgggtcaaaggtatgactgtgggatggcaaccccatccctcacttgatgtcctgtcttcctgctggaggtgggctctataatttccctctctctactgtcaggcatttcatctaaggtccttccctttgagtcctgggagtctctcacctcccaggtctctggtacattctgggaggggggagggtcccctaacctcctatttcttgaggttgactgtttacattcttttctgatgggcctcagggcttcagtacttttccctcacccagtagagatcagaagaccaggtttccctcccctccccccactccatcccaacccatccactttccctcctaggttgttacttccctccccacttgtgattgctttcttctctctcccaagtgggattgaagagtccttacttgggcacttcagcttgttgagctttttgagttgtgtggactgtatcttgggtattctgtatggttggtttttgtttggttggtttggttttggttttgtctaatatccacttattagtgagtacataccacacatgcccttttgggtctgagttacctcactcgggatgatattttctagttccatccatttgcctgcaaaactcaggatgtcctcgttcttaatagctgggtagtattccattgtgtaaatgaaccacattttcagataaacccacagtccagttcagtagagtcgggttagcaacagtcatgatgatgtagcagagacagctaggcctccgcctcactttgagccagcaggagggaccaacaggaacaccaggtctcacatcttcactgatcttcacttccctgagagaggcacagccaagaacttctcctaaatggggtagctgtgacttgtgttaaggttcaggaatctttacagaagaaggggaagaaaaattggaagagctgtagagagtgaatggcttcatgaaaacactttttttctgggtataactgggtagactcccataagaactcacagtgactgtgaaaacaggtgcaggttctgtacaagcctgacacagtcttagtatggagaactggaagtggccgttagtccaacccctaggtaaggaactattagaatttgaatgttgatgggagatgtaaagttgttgttttttttttttttaatatattgactagacttcatggtaggccccatcaggagtagttgatctatacaaggtgagcccagtgttgaagttggattgggtagaggaggattttggaagagttgtaagtaatggataaatatagtaaaaaaaatatactgtatgaattctcaaagaattaataatattatttttaaaactttaaaggaaaaatttagattattacataatcacataatttctcccttttttcctcactctaaaccctcccatataaccttgttctttttcaaattcacagcctcttttttttttactaattctgttacatacatgtataggtatattcctaaatacataggtacaaactgttacttgtatatatgttatcctatctgattatatggtattagatagccaattggtatgttcttccctgagggagactatctatcccactctcaggattctttattctatagagagagttgaagtcagctgtgctttcctcctatcctaagtccacattagcatgcctattattgttcttgttcaactcatgtttagtcaagttggtgagacattgtgcataacttctgacattcctaggagacaaatctcacaacaaaccccctgttctgctgattcttacaatctttctactcctgcctccctcttccacagtgattccctgagctttgggactggtctaactgcattttgagcacatttggttttctataattgtatctgtctgttacaaagagattttttgatgagaggtgaggactacacttacttagccttgtctgtaaggacaaatatttacaaggtagttgggaattatactggtttagtttaggggtggttataatttctcctccaagattcatgtcactgtcattgaggagttagctaggtttccagtatgagacatgacttcccacttgttgattgggaggagactgaagtccaattagagatctgttggttacagccaatgaatgcatgccattattgcatccttaaggttatactgccatgctatggcagtatattgatatgattcataggtgtcagaggttggtaaagtttttggttgcctcctttacttggaagagtgcatgatgccttctggtgccttgaaagctagttctcacggaggagagtgggggggggtatggggggacttttgggatagcattggaaatgtaaattaagaaaatacctaattaaaaaaataatgggtagaaaaaaaatccagtaaatttgaagcagtgaagaaaagtctctaatcaaaaaattctctaatcaaaaaattcatagccccagtccagatagattcagtgcagaattacaccagaccttcaaagaaaagcagcatcaatatttttcaaatggatccataaaataggtaaggaagaaacaacacttccaattttttttttattaagctagtattatcctgatactaaaacctgtcaattccaaaatgggtttgggagaggctcatgaaaacctataccaaacagaacagcaattggaagttgctctggggagcaactgttttgttttttgttgttattgttctgtttttgttttgttttgttttgttttgtttgttttttcatgtttgtggctcctggaaacttgtccacatgccaatggaagaccctacatatatgtacatactagaagcattagttggactcagtagatcaaaaagagagagcaagaacatgaatttgagggagaagttcagagtaattctggagatgggaatagatggtacatataatgaaaatatactgtttatatgtatggagttctaaaagaataattaaaaaatataaaaaaaccaagattataggccaatccctctaatgaacatagaagtaacagttctcaataaaatacttgtgaaacaaattcaagatcactccaaaaaatcattcagagatgaaaaaattccattgtgtgtatatatcacatttttattattggttcatcagttgaacactgtggttgattttatttcttagctattgtaaatatagcagcaataaacatagataatcatatattcctgtagtaaaatatagagtcattttggctacatgtgtgtgtgtccatgtgcgtgtgcgtgtgtatgtctgtgcgtggatgcaggaattttgtatctggttcacatggtaattttatttctagcttgttgagtagttgtcatactgtcttctactgaggcaatatcaacttacatgtccatcaacagtgaataagagttccttctttcctacattctctcctacatttgttgttttgatttctcaatgatagccattccacttggagcatagtcaacagaggcctccatggcctctgcatcagctcctgcttcctgacctgcttgagatgaacaacaatgtggaagtaagccggaaaactatgtgagattccctataaataaatttacagacagttgtaagaaccatgcagtttctgggcatcaaacaatgatcctctgcaaggcagaccgaactattaccctctgagctgactttgcagtcttcttgagtaactctctaattatgatatctatttaaccctggctctttatgagaagaaaaaaatcatgctatgcacctatgctgacatgtaactcagaaggatgggaagacgtttttgtcacatttactgaaacaaagtgcatcagcttaatcaggtatgtcttttgtctactgcacaaccacactggctgtgctctgagagacttcacagtagatcttagcaggagattgacacagcagatccaggaaccaaatctgctataattttcagaagagtatctttgaaatacatagacaggatcgaaactggtgtctggcatgagagttcttttaggaaaaactcagcaacattttaaaatttattgatgaagtagatattatttaccaattataagtatattggaaattcctgtgacaaagcagagtttgttttctgaatggagcagtgccttgtttactctgtgagaccaagcaagtattatttaattctgaaaagtctgtggcatcataggagaatattttgttatgatgtgctgccaaaagaaaattcctaatttctttattatctaaataaaattgtgctgacctttaacacatcagatagtagttaagtagcagagccacagaatttaagttgatttattttaatacaatgtgcataaaacaatttaattttatatgatacttccttatataaagaagatgtttgtcctatcagcaaatatccatgaaacctaactaaatattaatggaaaagccagggaagagatgactttacatttcaagtgataacaaaactgacttttcaggaaaacgtgtcttgtgttgaaaccctaatacagtaggtcctcttatactgacaggccttaagcaatggaacagttaacagggaccagcgcagcctataaatgtgctggctaaatccctgtgtcagaacacattaattaaaccagtcagctaccttcctccttcataacattttttattaaaatttcacacattacaatgatatatttcttttctacaagctgtgaaatttactcagccatcaataggtttggattttattcctaagaagcttgtagtacatgaaaagttgacttattatctctgaagagtgaaatcgaagacagtttcctttggctagatttagaattttataccagtgaaggtgctggagagcaaaacattcataagtaatattgtacctccaaaagcagtaacttctctcttaatatattgcctcaaaaatttataactgtaaggcttaataaagctgtagattatggtttgaagggtacattcaatgtaatgaatcatcaaagataaaaaataaacaataaaagataatcaaaacaaaacaaaacaaaaagaaataccagaaaacacaatgaaacaggtgaaggaaaggaataaaactattcaaggcctgaaactggaaatagaagcaataaagaagttaccgtcttttcagtacttatgaaacttttcccaaaattgaccatatacttggtcatgaaagcttcaatgtatacaagaaaatcaaacccctgtgtatcttatcagaccaccctggattaaagatagacttcaataacaacaggaacaacagaaagctagctaactcacggaaactgaagaactctctactcaatgaccagtgaaagaaattaaagattttctagaattcaatgaaaatgaagacacagcataccaaagttatgaaacacaatgaaagtagtgccaagaggaaaggtcatagcaataagtacctttataaagaaattggagagagcttatactagcaatttaaaagcacagctaagaactctagaacaaaaaagaagcaaacatatccaaaaggagtagatcaggagtgaaatcaatacattagaaacaaagagagcaatacaaagaatcaatgaaaccaagagctggatttctgacaagataaactagatagaaccattggccaaactaactaaaaggcagacagacagtacccaaatttttaaaacttcagaataaaaagggatacaaggcccatacctaaacagccgacaaacaccttaagccaagttgctggatataaaattaacaaaaacaaaaataggctgagaaagaaattagggaaataacacccttcaaaatagccacaaataatataaaatatgctggtgtaactctaaccaagcaagtgaaagatctgtatgacaaaaacttcaaatctgtgaacaaagaaatcaaagaagatattagaagctggaaagatccctcatgctcatggataggtgggattaacatagtaaaaatggccaccttaccaaaggcaatctataaattcaatgcaattcccaccaaaattccaacacaattctttatgctccttgaaagagcaattctcaactttatatgtaaaaatcataaacccaggagagaagaaaaatcctgtacaatggaagaatttctgaaggtatcttaattcctgatttcaagctgtactacagagcaatagtaacaaaaactgaatgatattggcataaaaacagagacattgatcaatggaacagaatcaaagacccagaaataaacctacacacctatggatacttcatttttgacaaagaagccaaaactatgcaatggaaaagagagagcacctgcaacaaatggtgctggtccaactggatgtctgcatgtagaagaaagcaaataaatccatacttatcactatgcacaaaactcaagtccaggtggatcaaagatctcaacataaaactgtatacactaaatctcatagaagacagagtgggaaatagcctcaaatgcaattttctgaacaatggatcaggctctaagatcaacttttgttaaatgggacctcatgaaactgagaaacttctgtaaggcaaaggatattgccaataggacaaaatagcagcttacagattcagagaagatcttcactaaccctacatccaacagagggataatatccaaaatttataaagaactcaagaagttagactccaaaatcccaaatatctcaattaaaaattagaatctcaaataccttggaaacaatttaaaaaatgtacaacatcctttgtcatcatggaagtgtgaatcaaaatgaccctgagattccaccttataccaatcagaatggctaagatcaaaaactcaagtgacagcagatgctggcaaggatgtgaagaaaggggaactctcctccattgctggtgggattctaaactggtacaactactctggaaatcaatctggaggttcctcagaaaattggaaatagatctacttgaagagtaattctggagatgggagtaggtaccattccttggcacacactcaaaagatgccataccacaaagacatttgctcaactgtgttcatagcagctttattggtaatagccaataaacatgatgtttgtcagttgaaaaggaataaagaaaaattggcacatctacacaatagaatactattcagctattaaaaacagagacatcatgaaatttgcaggcaaaaggagggaactagaaatatcatcctgagtaaagtaatccagacccagaaatgcacacatggcatgttctcacttataagtacatattagccataaagtacaggataaccatgctacacagacccaaagaagctaagttacaaagagggctcaagggagaatgcttgactctcactgagaaagggaaataaaatacacatcagaagtagaaggagagagaactgggtggcagatggggtgcatagggaaacagggtggggtggggatagcaggggtggggctgagagggataggaaagagaagggaaattggtagggaacatctctggaacaagccagagacctgggatgtgggactgaagaccagggaagatatgggggtaaacctaggtgacacccctagcagcaggggatatggagcctgaagtggctacctcttgtagccaggcaggacttccagtggaggaagagggtcatcaacccacccatttcacctaaattttccctgcccacaagatgtgtagggataaaggtgcagcagagattaagggagtgaacaaccaatgagtgacccaacttgagactcaagacatgggacccaatccctgacactattaatgctactttgttatgcttgcagagaggagcctagcttaactgtcctctgagaggctctacaggtgactgaaacagatacagatacccacagccacacatcggacagagatcagggaatcttatggaagagatgagggaaggattgaaggctcaggaggagatggggaccccacataaagacctacagagctaactaacctgggctaagggggttatagaaaatgattcaccaacaagagagtatgcataggctgaacctagtcccctacacatttgtagcagatgtacatcttgctcttcatgttgaccctgcaacaactggaatgggaactatctctgacttgaactctgttgcatgtctttaagatccctgtcccctaactgggctgctttgtctggcctcagtgggaaaggatgagcttagttcagatgatattttatatgctaggtcaggttggtacccaggaatgggaaggatcccttctctaaggagaaggggagaagaaaatgggggaagtagagtagggggattggactgggatgggagaagggaggggagctgaaattcagatgtaaagtgaatgagtgtgtgtgtatatatatgtgtgtgtatatatatgtgtgtatatatatcccacttcttggcttggaagtcccctgtactgaggcatacaaagtttacaagactgatgggcctctctttcccaaaatgtggacactttgtcccttcttagaattgggaacaaagggttccctgactctgccaaaagtagtctatacaggtgagagtatgcactacagaagctaacagcttctgggacaggcgggagccacagagcttctgaggcagtgcccttttcgggctccagacatctgtccaccttcctggccagaggataggtgtctgcccagccctagagggctttgcctcagcatcagcggaaaacatcttggttctgagactcggccgaaagtactctgcacaggtgagagtgtggactacagaagctaacagcttctttgacaggccaaagtaacacagcttctggaacaggtcctgttttgggccttcatcttcggccaggagggagggagatctttagcatccaccatcttctccatctccatttcctagaggagcaaagacttgggatgacccagaagagcacagcaaaacatgtttttgtaccgtacacttatgaaagcaacagacccaagaagcacagatggtggagacagcagcagacatgtggtaagagtctgaagatgagagatcataacacatcacctccaaccccaagcacctaccatatctggaacaaactatatagaaactaaatcataagaactttgtgaaagagcttcctgtagtattgtaaagctgtcttcaccagaagaagaggaagaggaggggaaggggaagagggaggaagggagagagggagggagggagggagggaggaagagaaagaaagaaaaaagaataaaggaatgaaccagcaaatgcttgtgggcatggccttcatactttatagtctcaggcataaaaagccttgcatagtctgaactaaccacaaagcacaagaaataatgttgtggtttgcaacatgaggaaatcagacaaagaagtctcagaaaactgatattctgctaaagaaatcattctttcaggacaaacttacttaatgtgtttgaattactgaaactagtagtcttccaccagcagcatcttataagaagacaatacatgcgttgtggagcacaccctcatagaagcaggagtacggggtatgagatagtgggtttctggggggatcaggaaagggataacctttgaaatgtaaataaatgaaaaatccaattaaaaagagaaagaaaaaagaagaaggggagggagaaaccatattttctcaacaaggaagaaacatggacttaaaacataaccctccttaattatattttaccattttaatctttaattttacttcatttttagtatgtataccttagtataatagtcattgggttataagttaagtcttgctgtaaaaagacttttgtatctgtcatttctttctcaaaacctaatgttcaatattttgcctactgccatccatgtctctaatcatattcttatgattcttattttacccactcttcctttcccattcactcccccactttgtcacttaactgttgattccattaactttaaaaacaaaaatgaacaaaatacactacactacagttttttccaaactgtactcaatggtacctcttcctgaactttacaggggataaaaattaaggagagaattatcttctcctgtagtttccagtaagctacttctaataattatatttgcttagggaaaggggagggaggtaaatacaggagaagtggggaaataggtaaacaagtgaaacaggtggatggaatattaactagttaccaaaaaagaaaaattacaacacacttaattcagtacataaatatatgcatgtaggtttttttttaattacatgaatcacatgtctcaagttttatttcctctcattcccctcttcttctactaagtaattctaatcttagaattttataagtctatatctctatgtggagaacagaaatcaacagaataagaagggatggtaaacagaactaggcagggacccttctagtgaggcttgagggtctgggcaggatgtaggtgtacgtggatcagatctctggctgcaactggtgagatgtcttttgtggtacccggctcgttcgctgtagccaattgtgaccagccttttttctgcaccacctgtaagccttttaacttagcatacagattattattacaacaacatgtaggtttaaacacatcatttaagacagtgatgaacatgggagccccataaaggatcttaaaaagagtaaggctgaatcaaaagggagtatttctagttctaaatagggcatggggaaggagcaccaagtctgcaccagtctcttttagaatcttattcatcttttctacctgtcctgagctttggagcctgtatgcacaatgtaacttctaaccaatctctaatatcttggccggtccctgatttacctgggcaataaaggcaagtccattaccttgggaagatttcttttaggatcttcttggatatcacattggttgtctcagtcctggtaggaaaagcttttatctatcttgaaacggtgtctataaacactaataagtacttgttgccatatctagctggcttaatttctgtaaattctacctcgtcatagcacaggccttgcagcttttgactatttcttctgccaagtcagagagtcctgtaacatagtagtcaaaggacctaaccacaccttttaatttcttggcccccaggtgggtcaagcaatgtccataacttgatagtgctcaggggtgtatctaaagctggtctctttgacatcataataatctttaggctccttgactgccaggatcattgctctttgggccacatgtttagcggttagatttgccatctgatttcctttagccacagcatcttaggtccttctctgcagatgtcaacagccctctttgtattaaagtcacaagttcagctttttgggccgatgtcccttccgggaggctgctggcctagattacttggtttctgtccaccaccgtagtactgtcactgccttctgctcaccttcaactgcgaggctactgccatcagtgtaccagctcgaactctcaggccaaggctgatctgatccttcagatcattttaagtaccagtttcttctgctagaatgtcagcgtagtgatgagtaggtgaagtctcaggcagtagtgtagtgagattgaggacagcaggtagagcgaaggtcactcgttcagtcaacaaaaagctctgatatgtcacaggagcgttggtcgtcatccatcagggggctttcagataatgctttcaagagtgtgggatgccactacagttatttgctgtcccagagtgagcttattagcatccttgacaagcagagctatggcagcaatagctttcaggcaagaaatcacccactggcaacagggtctaacttcttggataggtaagccactggcctttttcaaagtcccaaagtctgagtaaggactcctctggaaacccctgatctctcttccacataaagagtgaaaggcttggttaggccaggcaaaggctggccatcagtaaggcctttttcatttctttaaaggctttctggtgatctggggtccacacaaacacttccccttccttggttagggggtacaacgggcagctaaggttgccaacccaggtatctagagtctgtagaagctagcggtacccaagaattcccttacttgccttagtgtaattacagtctttttctggcttcttttagccactggttttcacctctaacggtgtatctcaaatggataacttgagtctgacacagctgagcctttttagctgaggctcagtcttctgttgcccagatttcctgtctagatcttgtcttttctttctctcctaccactgtggccaagtttctagtcaaatttctttcttgtctacgatccctcctgttttctctttcttttacctcttgcctcttgcctctcgcctctctctctctctctctctctctctctctctctctctctctctctctctctcataatatgccttctctgcctcttacttactggttctactctaaatatttctcattcggggtatctctctcatctcggacctctctaatctctttcatctctattttcactagtatctatctctcctgagtctgctgaagctttgctcttccttacagtctaagctcacctttttctagacctctatacccatttgtcagagcctggtgatcagactagtaggtgctccttatccgggacagaagttttaagtgacagatgtctccctcgctggttagcagcttagggcagggctgccctagaagagaaaacacgtggggcagagaaagggaaggcagctctcacagctggctgcaccaggccacctggggggaggggaggaaggcggtggaggcagcgactctagtctgccctaggaagccaggaggggccggctgggggggggcccagcgagcctcgcccctctttcctttcttgcctgtaccacaggcggtgaatccgtggtggtggtggtggggtgggcatcccggggaaacctccgcatcggtgttcccccctgggccacggtttcccatgtggcgcctcgccttggccagcaagcgctgctgctgccaccgaagcaggaagttcccagtctggtcctgcagctgcatgcagccagggacatgcactgagttgtttttcttaactatcactgacaaattctgtcctaacgtcagtccaagtccacagtcggcaccatacacacagtctgtcccatgacgaaaaccacaaacaaaaacaagacagcaacacaaaaacaagacagcaaaagagaataaaagacaccagtatctaagtaaactcattcctcactctgccatatgtaaaaccaaggcacgaggtgggactcaaacccacgatctcataaccggaaaaccaagttacgaggtgggactcgaacccacaatctcgcaaccctaaaaccaaggcacgaggtgggactcgaacccacaatctcacaaccctaaaaccaaggcacgaggtgggactcgaaccaacgatctcgcaaccctaaaaccaaggcacagattcacaaaccaagacacaaattcacaaaccaagacacaaattcagtggtgccacacttagacaacagacaacatgtaagacgcacacaaacaaacgtacctccaaggggtctttcggggttcctgggtgtcacacagatctcggtgggacctccaaatgaaagaacctagtggggaaacccccactcaattcccgttcagtgtgcacccaagaatcatgaacagacgaccatcttgatgtaaaagcatgaggtagtttaatgacggagctccgcccaacacatatctcccgcaggagacagaggtgtcaaccacatggtggagccataatgacagagctccggttcaaaacatatctcacacaggagacagtggtttcgaccatatgcatgtagttttaatgaacttttctcatctaggctgatggcactccctccaagagccaaaggtcacctaacaaaaatcccaataccagacatgacatccatctttagaattgttcgtcaggcctgtccaagttcctccccaaacacacagtctattgctgttgtccttggttactccccagaggtggaaggtaccatgcactccagaaggcaccatgcagttttccaaaggaggaatgcaaccagtaattctaccagctataacatccatgaaccacaccaatgatcagcattgcattataaccctaaaggtacagtagtgacaaacttaccttggtagtaaccactagctctctaattggacttaacaagaggtttaccatgcttaacaagagagttaccatgattggtacttaaaacataaataactactcactactagtgagatcatggttattggaaaagaatcaacagccactaattctactgaaccagaagaatccctgacaacaatctgtaaacatttgtccttatacctatagataagtgtagtcttcaccactgatattgggttctacaactacaacatctacaaaacatgattacacctaaggctcagggaacattgtggaagagagagcagaaagattataaaaactaaagaatccaggaagtttgctgtgaaattgtatatcctagttacactggatgctacacctgtaaagtgtcactaatatgactggctaaatgtgacttgaacaaggaggatgccaatgaagactccaaattacatcagaaaaaattacatgaagtctcaatcctacataagtaactcttaagaaactaggtaacatttaggagtgagaaaaatggccctcccagagggcatgctgattggttgtccaggaccaaatgatcaccctgaaaatgtgcatacattaacattatatggactcaagaggctatattttggaacacacacacacacatataatgataaaataggtcatgaatttacaatagagtagagggggtatatgggaggatttggatagaagaaaggaaagggagaaatgctgtaagtaaaatataatcttaaacaagcaatgatatttgttattatagtcagtgctgtcccccatttactgaacataaacctatgagtgatgaaaataactcatggaaaataaaatatacaaacaatggggaaaggtagataaactacacatacataccaaaagatacacaaaacacaacaaattagcacaaaatagtgagatgacattctattatgacatcctcacaaattgtcaacatatcaatatcagaaagcaaagttaataaatggccaaaattgacccgtccagcaggtccagttattcgaggatctggaggggaccttctcctaagaaccaaatggggggagggagggacagacaccaagtgcaggaacgacaaggaagcattctgagtagcattaaggtctcactatattcagcaaggctcaaggcttaaatgcacaagcaaaggaggaagtacttctcagcaggagggatggggcagcagaaatttttcttttggcagctacaaggggaagcaggaacttggtggtatcagggtgtggtcaggacatctggtactgacttagggctggaacattctgtggttgttctcagaacggtgaatcggtggcccactttggacccccttttcttctcgggggggagaggctcaattcggagatcaagacaatagagttgtcttaatagctcccaacacaaaatttcaagaaatatttcagagttctagttttaaagaggatcacacatgtaaatgattcacagaagcaggtgactaaaagaattaattcaagacctagaaaagaaagtcactaaggtacattaaatagttactcgagggaaagtaatttaaagcagacatcaattgtgacagcatgtgcaagatttgtgtaatccccggctggtaaaaatttcagcatagaacaggaaaggtggacatataatcctaccactagctgaagacctattaacatttaatggctacctaaagaggggaaatcttgattttttttttctgttttaaattatgtgactactgctggctgaccacataatatatggcctcaatcccaagactagctgtgcaacaccaattcaattttggggggatagaaagaaaaaaaataacctcgaagttcattgggaagggatgggctgtttgagaaggtagttaaagagaggaattgtgggagtgaatgtgttaagacacattgtatgaaattctcaaaaacttaatgaaatagtttaaaagtataaaacattgacagaaattacagcaaagaaatatatacactagaaaaaaggaatgccaaaattctgaaaattgaaagaattaatttaaaacaacagaaagtcaagaccagaaagaaaaatgaattttgaggatggagataaaaaagtatgcacatacttttaattaatgaatgtgggactgaaaacctgtatgctgagtgacttgtagattcaacaggtagtactacctcaattcccactgcctcaagaacctgtgagccaagccattcaggcattctacaagtcccaccatactatcccacccactctgactttatgcacttgccatctgagaacctgtaactcagcccctggcacaccacaagggatcccttccttttccctacccattgatactctacaactgtaaactgaagaactgctgagcatctctgcccctcactgataactctctccatttcctccccacacctctctttctcgcttgcactccaacctcaacttctgagaaactatagtgagaatctgctagatcatgaagaggttttgttgatcagaaactgcacctaagtttgtctgagctgggaccactactaatactgaattgcacatcactacttgagtggcccaatctcaagtactacccagttgacctaaaacccgacaatttgggataacagtaaaaaaggatccaaattctcactcaacaaaaaagtaagaccataccaaaataaatagccaattatataattcaagatggattcaaaatagaagttataaatatgctcaagaaactcaaagggggtatgaacaaatgctggaatgaaggccaagagaatgcaaacatttgaataaaataaggcagacaattcaggacatacaatctgtaaagagatagaaattctgcataaaacacaaacagaaataaaactttaaatgaataaatcagaagatcagataaaaagatcagtggaaaatgtcaccaataaaatgtaccaaatagaagacagaatatttgggcttgaaaataaggtagaggaattgtatcactcaatcaaataaaatgacgaatctaaagggaaaatatgactggaacacgtaagaactctaagacaacataaaggccaaattgatgaaatataagtatataagaagaagtccacagaaaatattcttatataataagaaagacacagaaaatattttcaacaaaatcttagaatatgtcccaaaaatatatacagagatgcttttccaagtgtaaaaagcataaatgatactaaacagacaaacataaaagaaatttcacactttctataatagacaatacactaaatgttcagaaccaaagaaaaaaccaacactgtaactgcaagagagaaagtccaactcacatataaaacaggtcttatcagagtaacagctaaattcagtggagaatttcaaggccatgaggtcatagttatttgttgctgtgataaagccccatggccaaaaacagcttagggaagaaagggtttatttcagcttgcaactttaaggtcatactcagtcactgagggaattcagggcaggaaacagagactacagaggaatgctgcttgctaggttgaccctcttggcttgcttgattttcttttaataaatcccaagatcaccttccagggagtgatgtcatccaaatgggctggacccttccagttcagagctaaacaaagaattctcacccgaggaataccgaatggctgagaagcacctgaaaaaatgttcaacatccttaatcatcagagaaatgcaaatcaaaacaaccctgagattccatctcacaccagtcagaatggctaagatcaaaaattcaggtgacatcagatgctgacgaggatgtggagaaagaggaacactcctccattgttggtgggattgcaagcttgtacaaccactctggaaatcagtctggtggttcctcagaaaattggacatagtactaccggaggatcccacaattcctctcctgggcatatatccagaagatgtcccaaccgataagaaggacacatgctccactatgttcatagcagccttatttataatagccagaagttggaaagaacccagatgcccctcaacagaggaatggatacaaaaaatgtggtacatttacacaatggagtactactcagctattaaaaagaatgaatttatgaaattcctaggcaaatggttggacctggaaggcatcatcctgagtgaggtaacacaatcacaaaagaactcaaatgatatgtacttactgataagtggatattagcccagaaacttagtatagctaggtataaggtacaatttgcaaaacacatgaaactgaagaagaacgaagaccaaagtttggacactttgccccttcttagaattggaaacattcacccatggaaggagttacagagacaaagtttggagctgagacaaaaggatggaccatctagagtttgtgttctcttagtgtctgtataacatctgtccaggctcttctggctttcatagtctctggtgaaaaatctggtgtaattctgataggcttgcctttatatgttacttgatctttttcccttactgcttttagtattctatctttatttagtgcatttgttgttctgattattatgtgtcgggaggaatttcttttctggtccagtctatttggagttctgtaggcttcttgtatgttcatgggtatctctttctatagatttgggaagttttcttcaataatcttgttgaagatgtttgctggtcctttgagttgaaaatctttattctcatccactcctattatccgtaggttcggtcttctcattgtgtcctggatttcctggatgttttgagttaggatctttttgcattttccattttctttgattgttgtgccgatgttctctatggaatcttctgcacctgagattctctcttccatctcttgtattctgttgctgatgctcgcatctatggttccagatttctttcctagtgtttctatctccactgttgcctcactttgggttttctttattgtgtctacttccctttttaggtcttagatggctttattcaattccatcacctgtttggttgtgttttcctgcaattctttaagggatttttgtgtttcctctttaatgtcttctacctgtttggttatgttttcctgtaattctttaagggatttttgtgtttcctctttaatgtcttctacttgtttagcagtgttctcctgtatttctttaagtgagttatttaagtccttcttgatgtcctctaccatcatcatgagatatgcttttaaatccaggtctagcttttcaggtgtgttggggtgccctggactgggtgaagtgggagtgctgggttctgatgatggtgagtagtcctggtttctgttagtaagattcttacgtttacctttcgccatctggtaatctctggagttagttgttatagttgtctctgtttagagattgttcctctggtgattttgttacactatatcagcagaccagggagactagctctcttccctgagtttcagtggtcagagcagtctctgtaggcaagctctcctctttcagggaggtgcacagttatctggtgtttggacctcctcctggccgaagatgaaggcccaaaacaggatctttcccagaagctgtgttgctttggcctgcagactgcccgctgcagagtcccagaatcaaggtggcccccacggaacgtgaggcagaagcctctcgggccgggtggacccctgtgctctcaccaggaaggtggctggttgtctggagccggaaatggcgccgcctcagagcggatggaccatctagagactgccatatccagggatccatcctataattagcctccaaacaatgacaccattgcatacactagcaagcgtttgttgcaaggaccgtgatatagctgtctcttgtgagactaggctggggcctagcaaacacagaagtagatgctcacagtcagctattggatggagcacagggcccccaatggaggagctagagaaagtatccaaggagctaaagagatctgcaaccctgtaggttcaacaacattatgaactaaccagtacccccagagctcgtgtctctagctgcatatgtatcagaagatggcctagtcggtcatcagtggaaagagatgcccattggtcttgcaaactttatatgcctcagtacaggggaatgccagggtcaagaagtgggagaggggggtaagggagtgtgggggagggtgtgggggacttttgggatagcattggaaatgtaattgaggaaaatacgtaataaaaaaataaataaatcaaaaagaaaaaaagaaaattccctacactgtttccaacaagcagtctggatgaaggcatttgttcacctgaaattccttttcccagataactttaaagatgtcaagttgacaaaatagtacaacaagggtaagtgaccttttatgaacttgacacacagactcaaaactttttaattgtaaatgttcaattccaagatcccatattaacaccatgatataaagcacaaataatattagaagtactatagtctttaaatattcaaatacattataagagcaatctcttcaaaatattcagtctctcaactatgggtgcttgtaaaataataagtcatatgctttcttattctaagaaggaagaaatagggcacagttacaataagatgaaagcaaaacctaaattggaaaacttaaaagttagattaatttctcaatgcatattactgtcaaagttaaaccacaagaaataaaaattaaacaaacccatcacaagtaatgagaatgaaatatcaaaataaaatttagatggcagatattcagacggatttgttgcaaaattttaacagaagttttaactgagaaataaaacttatacttctcaatttattctggactgaagaaacataaaaaaaatcaatccactgtaattaagttgacttcatctcagtgattcaggaatgattcatacatacacaaatcaataaatattatctacctgtggtagaacagagtcaaagacagaaaccacaggatcatcatctcattagattaagacaagccataagcaaaatataaatcttttcatgataaaaactctagattatctgggaatacagaggaaatatgtcaacatacaaaaagcaatatccagcaatcctacagccaacattatgccaaatgaataagatcctgaagtctttccattaaaatcaggaacaagaaaatgatttctactctctccactcaggttagctgaagtaataagacatgggaacaagataatattgacataaattaaaaagctaaaaagtaaaagtatacttatttgcagaatatatggttctatacaataaatacaggaaacatctcaccaaaagttcctacaaactttcaaaatatcacaggctacaaaattagcacataaaaatgagtggcttttttatatactagtggaaaacatcaagaaagaaacacacacacacacacaaaaataaacctatccaagaaagttaaagacatatacaataaaatttttaagtgctgaaaaaaatttaaagacaataacagaagattgaaagctttcctgtgctcatggattgatagtttttatattgtgaaaatagccattcttccaaaaccagtctacttactcaatgcaatgttgattgaaattgcaacccaatccttcatataaatagaaaaaaatcttataattcttatagaaatgcaaaagacagatacaatcaaaaaactattgaacaatagaaatgttgcaggagctatcaccacatttgatttcaagttatactatagagatagagtaataaaaagacattataatgtataataagacaataaaaagacaacataaactataataagcataaatcatatataatatgtgagtataataataagcagacagggatgaatggagcagaattgaagactcagatataaacctgcagtcctacagctatcttgcattttacaaataagccaaaaatataaagtaggggaaaatgcagttatgtacaaatgaatgaaactaagtccttatctctcatcccacacaagactcaacttctaattgatcagagacctccactgaaaacccaatactatgaatctgttagaagagaaactagagaataggtttcaactcataaacagaagaaagaattttctgaagtggactgaagtagcacaagcttcaataataaaaactgacaaatctgacctgatgaaacgaaaaagctacagtacagtaaaagacaccatcaatcaagttaagagacagcacacagaattgggcaaaagtctttatcagctaacatctagaattttcaaagagctcaaaaaactaaacaccaaggaaagaaaggactcagttaaatatgggctgtggaactcacacaatatgtactcactgataagtggatattagccccaaacctaggatacccaagatataagatacaatttgctaaacacatgaaactcaagaagaatgaagactgaagtgtggacactatgcccctccttagaactgggaacaaaacacccatggaaggagttacagagacaaagtttggagctgaaacgaaaggatggaccatgtagagactgtcatatccagggatccaccccataatcagcatccaaacgttgacaccattgcatacactagcaagattttattgaaaggacccagatgtagatgtttcttgtgagactatgccggggcctagcaaacacagaagtggatgctcacagtcagctaatggatggagcacagggctcccaatggaggagctagagaaagtagccaaggagctaaagggatctgcaaccctataggtggaacattatgaactaaccagtaccccggagctcttgactctagctgcatatatatcaaaagatggcctagtcggccatcactggaaagagaggcccattggacttgcaaactttatatgccccagtacaggggaacgccagggccaaaaagggggagtgggtgggcaggggagtgggggtgggtgggtatgggggacttttggtatagcattggaaatgtaaatgagctaaatacctaataaaaaatggaaaaaaaaaagaaaaaaaatatgggctgtggaaccgaacaaagttctcacaagaagaaatacaaatgactaagaaatattttaaaatcttcaacatgcttagcaatcggagaaatggaaattaaaactatcccataatttcttattaccccaatgataatagctaagatttttttaaaaaatagatgaaaacaaatgttgtgagtttggggacagaggactacttactcactgatgttacaagtgtaaactggtacaaatgctatggaaatctttgtgaagggtcctccaaaagctagatatagcttttctatatgacccagctataccactcatgtaaatgtacccaaaagactatattttcctataaagatatttgtttattcatgttcactgatgtcatattcacaattaccaaataatggaatcagtctggatgtctattaactgaaaaacgaatagtgaatatgtagtatatgcaattaaaatttattcagttgtaaagaaaaatgaaatttgcagttaagtgtatggagctagaaatagtctttcttaagccgcatcagagaatcttctctctctctctctctttttttttttctgtaggtggtaatagacatagagactcaccattggacaaagggagactattgagtgcttatccttaaatgtcctatctattgcacactatctcctttttggcatagaaatactgaagaaaactcaaagtgaggtgaagatgaacttgcaaaaatacaagaatccaattagaaaatttaatggaaagacaattatggatgagtcagaaaataaaacaccaaaattccagatgattaagtagattaatcagaacactcaattaaaaatgtgaagaaaacccacaggaaatgaatttgcataaactttgggacacagtgaaaagactaaatatatgaattatgggctgagaaaaaggaggagactccacaacaaaattggtatagacaagattttcaaaagagttattttaaaaactctaaattaaggaaaatatagccatatagataaaagagacatacaaactatcaaatgagaacaaaaaaaaaaataagagttccctacatcatattatagttaaaatactaactagacagaccaaatagagcattttaaaatctgcatgagaaaaactacaagttatatataaaggaaaacccactaaaaaatagctaatttctcaatggaaactttaaatgccagaagaaccttgagcaatataccgcaaattccaaaaaagatacagatgccaacccaaactgctttgcccaacaaatctatctgctgtagttgaagaagagaaaaaaagttcccatgatataaaacagctaaaataatgaatgttaccaaaacaaccctacagaaactactggaagcaacagtttggactggatagaataaatatacccaagagaacacaaacaaaaaagagagtgataaatacacacctttcaataccaattttcaattttcaatagccttaactacccaatggaaagacacacagtgtagctggatggattaagaagcaaaatcatgtgtacaatcaattcatcttaccttcagggatatatatatctcattatagtgaaagaactgatggaaaggacgtttcaagcaaataagacgagaaaacatgcagatatcaccatcattgtatctggaacaaatatccttcaaatgaaaattaatcaaaagtagtaaagaaggacattttgttgtgatcaagaggaaaataccaagaatatatcacaatcctaagcatatgtgaaccaaactctggaatacacaatttcataaaaaataattctggtactgaacttcaagacacagagtaataccaacctaataatagtaaaaaaaattcagtaccccattttctccaatagacaagccatctaaacaaaaagatgaaaaaataccagaattaaatgacactagatgggtatgatagatatttatagaataattcatatatatatatatatatatactcactcaacctccaattgaagtgtctctaaaaatataccatatattgtgacctaaaacaaaacaactttcaacaaaataaaagaaattgaaataactatgtgtattcttatcagacaatgctataaagctcaaagtaaccagcaaagatataatacaacatcatagagactattgaatgttgaatgttgaattggttaaaaaaaaatcaagaaataaacttttaaaattctaggaataaattaaactaaaaacacaaagcaacaaaatgtctgagatacactgaaaacactctaaagaaagatatcgggctggtgagatggctcagtgggtaagagcacccgactgctcttccaaaggtccggagttcaaatcccagcaaccacatggtggctcacaaccacccataatgagatctgatgccctcttctggtgcgtctgaagacagctacagtgtacttacatataataaataaattaaaaaaaaaaaaaaaagatttatttgtttaaaaaaaaaaagaaagaaagatatccagagctctgagcacctacattaaaagatcagaaagatgcaacttaaatttttgaaaacaaaactaaacaaaatttagaaaacatgacgaaataatgaaaatcagatgtgaaggtttgaatgagaataatatccattttctattagctaacatatttaaatgctgggtctatagttggtggaactatttcgcaaggattggaagatatggccttattggaggaggtttgtcaccgagggtaggctttgaggtttcaaaaactcaggccattccactcctctctctttttctcttctctctctctctctctctctctctctctctctctctctctctctctctctctctctctctctctcccctctctctctaaagtcactagatagaagcaaaagtcactagatagaagcaaagaaaacaatacaaaaaaatccacaagcataagagctggttctttaaaaagataaaattggaagacccttagtctaattacccttaaagagagaagagacccaaattaacagaaccagggatgagtagggaaacagacaccagaaaaatgagaatattatgagggaataattcaaaatcctatactccattaagttatttaatctaaaagaaatggataaatttttagattcaccgacaccaccaatgttaaaacaagaagagataaacaacttaaacagacccataatggataaagagattgaaaccctaacaaaaatcattacatctgaaaagctcaggcccatccaaactcacagcagaattctaccagactttcaaagaagaatgataagcaatatttcctaaattatctttaaatataaaaaaagtagcgcttctaaattccttctataaaattggtcttactttaatacccaaatcaggtaaagaaccccccccccaaagaagaaggaaaactacatgtcaatatccctgatgaatctagatgcaaaattcttagtaaagtagtacaaaaccaaatacaggcatatatcaaaaagatcagccaaaccacagtgaagttgtctctaatcctgatatgcaataatgtttcaacatggttaagtagatacatgtaacaaatcatataaatggacttacacacaaaattcacataatcatagcaagataaggaaaagatgtttgaccaaatctataatttcgtgatacaaatcctagagacaataagatggaaaagaacatacctcaacataataaaggctatatatgacaaactcacagctaagatgagacagaatttttcattctctccacttcttttcttttttgagatatttttattggatattttatttacttactgtactggctagttttgtgtcaacttgacacagctaggagcttcagttggggaaatgcctccacaagatccagctgtaaggcattttctcaattagtgatcaagggggaaaggccccttgtgggtgggaccatccctgggctggtagtcttgggttctataagagagcaggttgagcaagccaggggaagcaagccagtaaaaaacatccctccatggcctctgcatcagctcctgcttcctgacctacttgaattccagtcctgacttccttggtgatgaacagcagtatggaagtgtaagctgaataaactctttcctccccacttgcctcttggtcatgatgtttgtgcaggaatagaaaccctgaccaagacacttacattacaaatgttgtctcctttcctggtttcccctccacaacccccccatcccatctccctccccttgcttctatgaggatgctccaccactcactcacacactcttacctcacctcactgccttagcctgcactggggcatcaagtcttcccaggaccaagggcttcccctcccatggatgctaaataaggtcatccactgctgcatatgcagctggagccatgggtccttccatggtgctttgattggtagtttagtccctgggagctctgggggatctggttggttgatattgttgttcctcctatggggctgcaaaccccttcagctccttcagtcgttccctaactccttcattcgggtccctgtgctcagtctgatgattggctgcaaccatccgcatctgtattggtcaggctctggcagaactttcaggagacagctatatcaggctcctgtcagcaaacatttgttagcatctgccatagtgtctgggtttggtggctgcatatgggatggatgtccaggtggggcagtctgtggatggccttttcttcagtctctgttccatactttgtccctgtatttcctttagacaggagcagttctgggttaaaattttggagatggatggttggccccatccctcaattggggtccatgcctaacctctgtatatagtctctacaagttctctctctactttgttgggtatttcagctaatggcatccttgttgggttctagaagccacttgggatcctggcttctgggactttttcgtggctacccccagttccccatcccccattgctatacacctctatttaatttcctgacctctcctcaatccccatcacctcccatacctgatcctgccctcctttttatcccctccccctcctctcttcctcccaagtctctctcaccctctacctcttatgattattttcttcccccttctaagtagaactgaagcatccacacgttggtcttccttatatggtctgtgaattgaattgtgggtattctgagggtttgggttttttttttgttttttgtttttttggttttttttgcctaatatccacttatcccagactacataccttatgttcttttctgactgggtcacctcacttggaatgatattttcaaattccatcaatttgcctgagaatttcatgaagttctccactccttttcaatataatatttgaagcactagctggaatattccaccaaagaaggggcacaaatagaaaaggaacaaataaaattatccatatttgcagatggtatgatattatacataaaagatcaccaaaattccagcataaaacttctagaaatgatcaatactctcagaaaagtggcaggttacccaaaaattcagtagtgtttctaaaacatgattttaaaaagagataatggaaacacccccactcacaatagccttaataattttggtagaaataaatctaccaaaagaagtggaagaccctacaatgaaaacttcactacaatgaaacaatcactgagaaagagattgatgaaggcactagaagatagaaaaacctcagtattaataagtgttctctagatgaacaaaactgatataatatatatatatacatatatatatatatatatatatatgtatatttaaatggtttatggggtgtggtcagagagtacaacagtggctgtctgacaacacaatggctaagaatcaggtaattgtccagtccacaaaagttaatgtgaagtggaagattttacattcttaaagacacaaagcctaccctggtcattaataaggttctatgcagactgcagatatcaactccttgatacttctttttgttttgttttgttttgttttgttttgtcttgtcttgttttgttttgttttgtttttgagacagggtctcctggctgtcctgagtttgctatataaaccaggtttgctttaaactcatagaaatgtctacctctgccactcaggtactagagttaaaggcatgtgtcccttcacccagcacaaaaacttagtttttaaatgaccaatatttgtttatttgtttgtttatatgagggctctgtgtgtatgtacacctgcatgccagaagaaggcattagatccctttatagatggtcatgagccaccatgtggttgctgggaattgaactcagaacctctggaggaacagccaatcgtctttttttgggggggtggggtggggttcgagatagggtttctctgtatagccctggctgtcctggaactcactttgtagaccaggctggccttgaactcagaaatctgcttgcctctgcctccctagtgctgtgattaaaagcatgtaccaccacgcccggctcagccagtcctcttaaacactgagccatcttgccagaccaaatgaccaaaccaaaataatctaaataatcttgaaaaacttggtttggaggaaatggggagcatatgtagacagccaatagttttcatgttctaatactgtgaatttaactaaaaatgattttaacccttccgctcgactcgagactcgagccccgggctaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctactttgacagcagagtcttgcccaacacccgcaagggcccacacgggactccccacgggatcctaagacctctggtgagtggaacacagcgcctaccccaatccaatcgcgtggaacttgagactgcggtacatagggaagcaggctacccgggcttgatctggggcacaaaccccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtacctgccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagatttacaggagagcactgctaaagagttacaggctcttaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatcaaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcatacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaacaaattcacacaatatctttccacgaatccagcccttcaaaggataataacagaaaagaagcaatacaaggacggaaatcacgccctagaacaaccaagaaagtaatcattcaacaaaccaaaaagaagacagccacaagaacagaatgccaactctaacaacaaaaataaaagggagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgatagcttggtcaaggaaggaataaagaaagaaattaaagactttttagagtttaatgaaaatgaagccacaacgtacccaaacctatgggacacaacgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcgctttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagatccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagattgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatgtctaagatcaaaaattcaggtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaatgaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaatgattttaaaatgtaaaatttttaggttaattatgattattattaaggcaatatattcactgctattacatagagcaagcttaccaagtcttaatgtttttacttcttgagattgtatgtcctatatcatttgttgtgaaatgtaaattcgaacaaaaagaactaagacaaacatatatacctattattatgtatgtaccatagccttaaataaagatgttattttttatcagttttaatcaagaatatgcctataaaataaatccatagactttaatctaacaaaagaatgtttttagatttgtatttactgtttctgtgagtgtttcgtttgcatgtctgcctgtgcactatgtgtatacctggtaccttagaggtcaaaaaaagactcagatctccaggaactgaagttagaagtgcctgtgtgctacaagtggctgtttgtgtattctgcgaaggaaacccagattctctataagaataagaaatgcacttaaatattgacccatcattctagcccctaacaaaaggatttctaataaacattacatagaattattttaatcaatataaagcacttttattgctcatttttggtacctgttatgactattaaaaattaaataaaatgtttattaactttgttctctttagaacctgtcttggaaagaaatccttatcaaaatctattattttaagattaattttatgacttaatgaatcttttatgactccaattagtgttttttatataaacagccctttggggtttggtaatacagttaatagactgcactatgccattttgataagttgagaaagtcaagagtacctaagtttatatggcagtatgcattttcaggccttttaaaagatccccaaaatgcttgtagtcctacatatatgcacatagttagtttccccaaaacattttttagtgcacaagtaaaaggaaaaacatgaagtgactacaggttttgttgccaagttattttgggaacttttaggttaggggcaagctacatactgtcccatgctgtcttaacaatgaatgtcatttaaacaatcacatgagcataattatgaacatatatgatatagttactttaatgtcaacaaaataaaaattattttgtgtctctcactggagggaacaagattaatgcttgaggaactagagagactactttttgctttttttaatctgtcagtctgtattactggatactctcagtcctgtaaggtagtcgtgtcagagattggccctttctttaaattgacattctgatctgatagttaatggggttttcaacacgtttttaaacctttttgacaatgctattgccattccatatatgtgggtcccttctggggtattaaaattccaagcaatggattcctaatctgggaggtccaatacactgggtaaatgtaatggctgcatgttatttagttcttcacaaatcctgttttgccccatttggacagcaagcattgaggattaaataaaagtcctttcatgttaggttataacccaattttaaggtctgtaagttcctggtgaattataatggatcctcagagaaacttcctgtcttcctcttgcattgttgaaggtctctgaaaaagaggcatgtaccctaaatgtctaagagagtccaggtacttcctttaaaaagcaagctataagcataaaaatagatggttgataggaggtgctactatttgcgtgccctataaggctcgtcttctggttttttggtttggtttggtttggtttggtttggtttggtttggtttggtttggtttggtttggtttttttctatatataaccccttgatctgatgaaagacatggaagggtttaaatcagtcccctagattcttagaaaactggtccagtttaaggatgacattgtaattttggcttccaatctttagctaaccttctctatcatctaacttttatcaaggacataaggtgttatgataaaatattagttacttctttagattctcagatcaatcctattcaaattttgaggatgtattttagatacccaatggaactgaaagtgagttctgtgataacacaaagtgaagagaaaagtattgcagaacctctggagtacagtaaagaatctctttcatttactttgagtcctcgaggaagtttgatgggttggaatttaatttcccatcatcatactctagcatactctagacaaggattagagtagctccaggagagctagaaattctggtttgggtatgggtagccaaccagagatgaccacttagacacagtttatagcctattaaaaattaattccagctggctgcgaccacactcaggtattcagggacctaggtgtgaccccaaatgcccagaacattggtttttttaaaggcaggatccacttcctggcaccttgctcagcatctgtaggggggcttcacaaaagaagcaagcagttttaacagaagctgagataagcggttagctggagggggttctgtacaaacaggcagtttaacagaagctaagataaaattagctagcacaacttgacgtttagaatcccaagataattttccataggattctctttttttattaggtattttcttcatttacatttccaatgctatcccaaaagtcccccatatcccaccccactcccctacccacccactcccacttcttggccctggcgttcccctgtactgaggcatataaagtttgcacgaccaatgggcctctctttccagtgatggccaactaggccatcttctgctacatatgcagctagagacaagagctctggggtattggttagttcatattgttgttccacctatagggttgcagatccccttagctccttggttactttctctagctcctccattgggggccatgtgatccatccaatagctgactgtgagcatccacttctgtgtttgctaggctccggcatagtctcacaagagacagctatatctgggtcctttcagcaaaatcttaatcaaggagatcagattctagttaagcctgaaatagcctgagcaagaatacaagttgaaggagactctgtactgtcttacccagtcacagtttgacttcctaatttctcttaacttgattcccaccaagggtttaatctattacgcatatgacctctttcctgagctgaagttccataatattggaatgctcatctgtattgtgggaatttctgaggttattgctagtggagagaatttgagggcatttagggtataattaaatggaaataagtaaacgatagtagtagtaaaatgtggaacaaattaactaggagtcagttcatatggttaggatgtgaggcctgtgggtgagacagtctggatccatctctttaagcattgggtagggatgagtctctggagaattatctcaagtaaaagatatggaaaagagctgctgtactttttcattggagccccctgagtctgatgcttctatcattccttaggacctctggaaaaatcaaaagactcatgaaagagtaggagtgggcaaatactggcagttcacaagtctgtgggttcggtgattcttgagaaatttagtggactcaaacctatgtgtagctctcattgtttttcttagcaccatcttggccgcctccatatgggtattgccatcttattttgtccatgtgactacatggttgctctctgtctgtagtttgcaggcagctccctaaatctcttgggctcagtactagatcattgtctaagcacatgggcattttaataaatgcaaaccctccaggcagctctatgcatgcttaaactgcattttaggcagcaattggacaatgaactcttctttgcctcagctcacattccattatggcagggaagagggtccagacactgaaacatcttggagggagattcagtaggatactgagacagattgttgggggcatggtgtttagtacaaaagttattaccattgtggccatacaaacagatgttaacagcatggtaaaggccctgaagagaggaaatctgggtccacatggaaaaagcctgggcctcttcttaccttaacacttgatcttagccaaaagaccaagaagctactcttaaacttttcagaggatgcagatagtttcacagcaagaaccacaggcagggtttctgactcagggcaggaggcaggcaagggagcaggatgaggctcaccaaagctttctttgatgtaaactcatttccccaggtggcacctggaaatttgttatttagattcacagacaatatctcagtagggtgcctgttgttaccatctgtgagagggggaagggctgctataggtttgtggcctgagcagcagctgtattctagcattacattctaaactatggaaggaaagaggggaaaaggctgatcaggatcctcttgcttttcccaggagctttctcaacattctcaagggtcccaaagaaactgaaaaggggaagatatgaatattctttacctcctgggtggtggcattatgattatagttggggttctgagtccaggcaggcacccacggaaatttccagcttcatgcgtcctgaagcaaatgaatggaccaggaacaccaggacagttataataatagtctattaaacaagagagacactctcaagaatggaagtgggccagagagccatccagaacaggtctaagattcaaaattcctatacataacccttaagtatcatatttatattgtacattatagtttattatcataattttaatttatatatattaaatttataaataatttggtttaatatgtaaaataattatatagttatatatactttatataaaattataatttatatagcattgctttccctgtgagatgttgggaatttttctcaattttggtgtgttttattgcatgaagctctgttggcaagcagtatccagtctttctgacaactgaatcctttcatacttatcttgatgccttttttcccatgccttgttttcctgccacaggtaagaaagaaataagtcaaaggttatccgttctgattgtactaggagttttctcaaggcactggcctctattcatgtgtcccatatcactcttgagacctaaaatacttgagaatcaaaaagatcattacaaaaaacaaagtgtgtgggaaccagcatccgtgtttgaacaggctagttattaagggtaagtctataaaggtatataaaatgaatgctttgtatagactagcacaaagacttcaaggaaattaagaaataggaaaatgtttttcaaacgaaggaacaagacagatatttagaaatctatactagtgacaagaaaatatatggagttaggcatgatgctgtgtcagttttcccagtacttaggtggctaattcagaaaaaaaaaaaaaaaaaaaacaaaaactttagttcaaggccagtctgagctacagagaagacaatatctcaaattgtatattcaaagtaaccatcataaaaatgacatagaaggtcaaatgaaaaaaagacatgcatgaagaatttgaatgaagaaagtggaaatacaaaatgtaccaaacatatccctggcatcagtactcttctctgtaagggccaggacggtggcaggattataccattgttctgtgccagctaggacccatgcctattcatccttcctcaggccatgtcactcagctaagtcatgcctgagaagtggtctttgacactgtcaaatctgctagaaactacaggaaaggtgcatatgaagcctgttaaaatccagcttaggtctacttgagtaaatctccatcaaagctattattggtactattatggcaggctctgaatggaaagaaaaaggattaaaaacaagttgatgaaaatgtgatatgaccattgtgatcctgccatcacttgaactgtgttaaatgcagcacctagattgacagtggagttcttacaaaatagaattagcaggtggatgtcttgtaattaaattcctatagcaagcaataaggaattcatccaactcttatttctggcctttcatagggcagtaagaaagaatattagatgtgaatgacagataaacttattttctttttcccatttattcatcgaccacccgattgctgcccctcctcccagtctgcttgcatacagtccctcccccatccctccttcacttctcctctaagcagggggaggtccccctaggtatcacccaaaactactagcacatcacatccctgcagggctaggtgcatcctctctacggagaccagacaaggcatctctactggggcacaggatccacagataggtaacagctttagggatagaccctgatctagttgttgggtcccacatgatgactgagctgtatatctgctacacatgtgtcagggacctctgtcaagccacagataaacttttttgtaatatatactttgagttctttaaactcaaagatcacctctcaatgttcaagtttacatttttccactaaatttaaatgcagtgatgaaagagacctttcttcaattattattgaatagcttagagatgctagtcaggaaacttagggagataactgataaatgtgagttggaataaaatctacttgttacccccaaagtggctagtatttggtgtattcagtttcacctatcttttctcacaacagatatgaaaaataaaagcccttataaatacataatgttgaaattagtgttatgagaaaagggaagcttgattctaaattcagtgaagcacaatataaaattcactaagtaatatacatttcatacagaatcctgttctgtaagatattttctgtgatcttatatcatacattctaaactaaatgaaagataagtattaagaaatcttagggatactgggagacaacctagttaattgatttgtaacacaactgaccaattcactactgatatgcttaattctgctcagccatggagaaatatttaaaggtttctggcaaaatgctcaagactctaagctttctatcctttggggaagacgttttagttgttgttcatgaccctaacaaaccagtgtaagctcaatggtccattcatgatatcttgttattcactattaagtgaaagagaagtttccactgcaggaggtggtgctcatgaaaaattagccctaggaatggaaaggtacatcagcacttaaaaccatatactgttctttcagagttcatttcccagcacccatatctggcagctcacaattgcctgtattcctaatgccagagaattcaacattctttctcaagctctatagatatctgtgatcatgtgcacatacccccgcccaccccccgcacacatacacacacaattacaaataaaaatccttactatcaagatgtttattagcactgaaagatatagagtccaaatatattcacttttttgtatatgctatggatcatgccgtcaacactagcagagtatagtatccatagtcacatttctataataacaaaactaagaaacgtatatatataagaagaaaatattaaaggcatacagatatcaaaaggtattattgttagtacttgtatgaattggttttctaacctcagttgatcccagtcagtgatctgatcctattaactttaaactatctttttttgtttgtttgttttgtttggttttttttggttttttcaagacagggtttccctatgtagccctagctgtcctggaactcactctgtagaccaggctggccttgaactcactctgtagaccaggctggccttgaactcagaaatccacctgcctctgcctcccaagtgctgggattaaaggcgtgcaccaccacagcccggcaactttaaactatcttaagcactatgaaaattgctgatgcactaaataataaataatatggataacaatgacaatctactgtcattattgtcacaagtaatataactggagtaaaaaaatcagtgaggtacacaaaaatctttgaaattttatcagcttagtcagagtaaaaaaaaagaatttaaaaggctaaggcacatatggaacaacatcaaatggatcaatatgtgtagtgtgggatttcaaagagagaagaagaaaaagatgtagaaaggttatttaaggaaacaatatgcaaaccacccccaattctgaggaagaaaatgaatatccaggtttacgaaggctaaccaatcaaaatgagattaatggaaagaaatttacaacacagccacatttactttttttatcttttaaattaaaatataagtatttcattttcctttcctttcttccttccaacccttccaacataatcttccatgtttgttttccaattcatgatttctttttctttaattattgttaacagaatcatgtttatttacatgatttaaattcaagagcaaagataaaaattgaaagcagttaaaagtgacttttaacatcaaaaggaactcatgaaactatcactttccagaacaaatcttaaaaacataagtgagtaggatgatatacttaaaaatactgaaatgaaaaaaaactactgaacaagaatattatgcctaactgaaccatacttcaaaaatgaagaaatactgtcctttgcaaccaaaagctgagaaacaacatcaccatttaagaaacaccaagggcaatgttttaaattaaaaggatgctaagcagccatatgggtacatacaaatatagaaaaatagttgtatagactaataaggaattctactatggtgttatatcaataatttttaatttgaatataaaaacaaatgttacttaatgtaattatttacaaaagatgtatatggatatacaatgtgaaaaacatgaactgtaacacaattgaatgtaaactgtaacacaattgtaacacaatatgaataagtaaaagtagagttatcatatgcaactaaactaagttaatatcagcaaaaatagactcctaaaatttgatttatatgaaccttatgataaacacaaaaatgtctataaaaatacaaacaaaaaattaaattgtgccagtttaaaaaatttgtcaaatatgaatatggacaacataaggaaaccaagaattatataactgtaaaatgatagaaaatattaataaataactattttaaatgtaagtggattaagacccccaaatcaaaggatatctaaatgcttcatgaattaagaacaaaaattaacaatctactttctaaaagataatctccttaaatataaggataaaaatagacttaagataaaacagtggaaatatgttctttacaaattatcacccaaagtaatcacagatggctatatcaggtaacatattttgagtcataaaggaagcagtgataacaaagtatcattatataatataatgtgtcagtttaacatagagatgtaattattacaaatctgtatgtacctatcatttgagcaccaaaaagtttcaagtgaatattaatagaattataagctgccatagaaatagaaaagtagttttaacttttgttccccattttcaaaaatagatggaccatccatacagaacaatcatagcacaatactgtgttcaagcagtgttatagatcaaataaatcaagaacataaagaacattctactagagatgacccctgcaggaggcacaggtggtactttgcccagtgctgtgctatgcaggtggggcaccactaagatgagcaggtaagtggtggagagagagatggaagagaaagagaagcagaacactctgtgcacaatgaagagaagcagtagagctggccctggttgcaggggttgaaggtgagccagcctgagggtatgagcatgggaaagtgtgctacaccccttgatggcatagcagtagggtgagctgttcctgcccctcatctccccagcattggagattgaggatgggagagctattgagctgacccaagcccaaatccaatgctttgtgttggcccacccaacatccaccccatctatgaactgctggaatatgagaagggactgggcctcctgaaccaaagctgcaagatcaccacaacacaggacaacaataggctatctgagaggagtcccagagaggatccactattgatagtgtagcagaagccagaggccttgaaccagactgataacttactgcactgaacatttgcaagtaaaagctgtttgggcaaaggggtatattattagataatctcttgtgaggctatgccagtgtctggcaaatacagaagtgggtgctcacagtcatctattggatggagcagaagtcccacaatgaaggagctagagaaagtacccaaggagcagaaggggtctcaaaccccataggaggaacaacaatatgatctaaccagtacccccagagctcctggaaccaccaaccaaagaaaacacatggtgggactcgtgtctctagctgcatatgtagcagaggatgggctagtcggtcatcaatgagaggagaggcccttggaattgcaaagatcatatgccccagtacaggggaatgccaggaccaggaagcaggagtgggtaggttggggagcagggcagggggagggtatagaggactttcagagaggaaactaggaaatgtaaatgaaggaaatatctaataaaaaattaacattttaaaaaagggtatattatgtgacacaccatgagctccacagcttccatggtgagaagtttgtttgtttgtttccttttggaaggaggttgcaagagcagagggcagatatggagaaacaggggatgagtggggttagggtgcatgatgtgacattcacaaagaacactttactacaataagtgaatattgataatgaaatgtacatggaaaattttccaggtttaatcatatataaaatataaaacaaagcttaaaaactttaagaattccgaaatcatatcagattttttttctgattacattagaaaaaaaaaaacctataaatgagtaattgaaaaaaactaggaatgttcacagtatggcttttgaaatattaatgaggcaagaaatctaaacataaattagaatcttgagacataaagaaaatatatacaaaataaaagagaaacaataagttgaggatcttttgacagggtttctctgtgtagccctggctgtcctggaactcactttgtagaccaggctggcctggaactcagaaacctctgcctcccgagtgctgggattaaaggcatgtgacaccacacccagctgttgaggacctattttgcttaaaatgaactctacttacatttatatttactgcaaatggcataatatttgttgttattcatgactgaataaaattccaatttgtatacataaaacactatttttatttgttcatctgttatcagatacctagacaaattctataacatggctattatgaataatgttacaataaatatagctgttcaaggatctctgtggtattttgaataatagtctagcagatatatacagatgagtgatactggggaatcatgtggtagtgttatttctagattttccagtaatctcaatagtgatttacatactagctacactagtctacatatccattagcagtatataaagattcttccctgcatcctctgcatttgtcttaattatagccattttgactgtggtaaaatggaatctcctttttaatttacatttcactgatggctaagtatgctgaacatttttatgtttattgaccacctatccatattttaagaactgcatgtctactccataacccatttattgattaagttgtttgggggttagggtatttcactttttgagctctttatatattatggctacttctcttgcattgatagttagcaaatatttcttctcattatataggctgcctcccccacttgattaatcaattcatttgttttgcagaagatttttaatttcataaaatcacaattgtcatttatttatttgttattttgtttatttatttggttatttagcgagctattagaattccttatgaaagtcatttccctaggctgacaccttgaagcattttctctaagtacctttagcagttccagaccttacattaaggtccttgataattctgaactgaatttaaaaataggattaaagatgggaaaatgcctttaaatgtctatgtgtgagtatttgttttttcccagagcccattgttaaagaggctgtcttttgtccaaaatatgttttgggaattaacaaaacccagatggttgtagccagtgtaggcttattttccagcttctatcacagtgattaaagggaactaaatatccgagataaaatcatgactatatgatttcatcattttcttatgaatagagtttttataccattttcatgttttcaaaaaagtttttcacatggtatatccagaaaatatgtcattggccttaatgtatatatttgaaagaaaaaaaacagcattagaaaaaaaaaaaacaaccattttcagtagtatggaaaacatgtttcagctagggcatattgcagtgatagcatacttttctagcatgcttgagacctcgggtttggtccccagaacatgataagtgaagaaataaggaaataaaaatatgaaggaaggaaactaggaggaggggaaggagaaagaatgcaagaaaagaaggctgctgttaattatgacagtttttcctttttccttctacatgtttcatatattacaaaagtagaattcatatgttttcagagtaggtgtatcttttgtaactatagaaatgaagctttccattttgaaatatttatttagctaaaaacagcaatgcaaagttcattctgattctaaaatcatgtacaaatttagacaactgctcaaagaattgaagtctctttgatattgtaatttagaagtatttacatatttccaaggtaagtttaccatatgtctatttatgttacatagaaccttaatatttagaaaaatttcctcatggcacatgttaattttaatctcatattcattttttaaaatatattaagcatacccaaatcataagcacttgtaatagtgtcaaaaatccttcatatgaagtgggaaaatcaaagttgtaattacatttttccttctattacagactgtaaatttgggcagttgacttactgtctctgaaaacaaatattctcttatcagtaataaaagtatactctttacctcacattgtttttgtgagaataaatttaaataacaaatatgaaattactttgtagacagtaagtttccatagtaagaatgtgaataaaatgcaataaacttaacattaactggataattatcatatgatggtcattgtactagtttttcatttattttatattcattgttcttaggaaggccaagactaatgtgttgttaaaaaatagtagttggtaggactttacaagtatagctcctgatgcacacagtctcacagcaaagtcctgaatcctctaattcttacaatcttttttccgcactcctcaacaatgttccctgagcctcgggtgtaggctcagatacatccatcggtactgggatccacaactgcattttgattggttgtggttttctatagtggtctccatatgttgcaaagagaagtatccttgataaagggagaaagactacacctctctctgggtataagaacaaatgcttataaattgttgttaaggattatgctggtttagtaaattactggttgtagattctcctgtaataaccatgatttcactagcactgagtagttatcaaagtttccagtaccaagcatgctatctctcttgttgagagggtcttaatggacagatggatggatggatggacagatgaatcatacccatattctgttactctcacttattcccctctcattttcactgaacactttctttttatctgttcttccttcttttcttttcttccttcttttcttttctttctttctgtctttctttctttctttctttctttctttcttcctttccttctttctttctttctttctctctttctctctttctctctttctctctttctctctttctcttttctttttctgaatcctaacttctgccaaatgtttccttcttatttgcaggccttttagcaaccaactgtgcttaattagggttgcttgcagaagcattgtttaaggggtatttttcatagtgtggccaactaaccactggttacttcactaagaaaatgatccaccctctcatggtaaccattaactacccatggttccttggggaggaatagagctatccacaatatttattcatgcagaagatctgcacacaagattggacacatcaggaagaaggcttcttaacaattcatgtcactatttttgttcagaaaagtgaaaaggaaagtatggggcagaagttatataacaaaagttttacaggttcagcatggtaaggcattgaagtagaactggaaaggaactgaactggctgaaagggagccatggttctgatgctgcttctcactgcagtctgattgtatcctagtttatctatacaagacttcaaaataataaggcacaaggcagataatttgtctcttgaaaaaactttgctaacatatgacataaaaagtattgctttaaacttataatgaacgtatggagctagcaacagataactagtcaggcacgagtctaaatgaaaagacatgtaaacaatcctgatgtaactccttacaccttactgatctatgacctgaactattgctttaaacttactataaatgtatggaatgtaaaaatgcttagaaaactatgtggtcaattatcctgagacagtataaaagctcagagctacaataaagcataggtacggccttcatcttcatcttcatccagtgtgtgtgtgtgtgtgtatgtgtgtgtgtgtgtgtgtgtgtgtgtgtgtgtatgtgtgtgtgtgtgtgtgtgtgtgtgtgtgtgtgtgtatgtgtttgtgtgtgtatgtgtgtgtgtgtgtgtgtgtgtgtgtgtgtgtgtgtgtcagtatgctttctcactttgattttcctttcttttctttctgcctgaccagtgagaggcccgagtcaaagagaaatcaacccaagtaacaaattcttttcccctgctgctattagcatgagttaattgccagaagtgagctgcttttttccccagaataacaagaagagtcagcttttggcccctatctccagccagcaacaccctttgctgacttcctcaggtctggatgctgagctgaacttcaacacataggatcatcctatagttgggtggaccacaaattgataggtgtcctcattttaaaaaaaaaaaagaggaaatttaagaaacctatgagtacaattccagattaaaaacttctttgagtgatccagtgaagaagaaaatttagattcaataccaaagagtgatataaaggaagagtttgaaaattcagacaggtaagaagatgaccaaaaaagtaagaagaaaaaggaagatttaatgaaaaaaaataagggaagcaaacaacagtctcagctctgtaggtccccagaatgaagaggaaaagcagaagtttcattcagaagataggcttgtggatatgtgatggttagtgttaactgtcaccttgctaaaatctataattacctgagctattgtcttctaagcgtatttatgcaagatcttcttgcttatcctaattgatgtgggaagtcctactcactatgggagggcaccattccctaggcaggagctcctgaaccatataagctaagcacattcactcctcacttctgactgtggacataaataatgcaacccaactgctttaaatctcctgcctctgtgacttccctaccataaaggattgtaacataaaactatgagctaaaacaatttttttccttacgttgcttttctcagagcattttatcatagcaacaggaaacaaaattaagatggaatcctagtgaaagcacctgcactcctacccaaaagacaacctgcaactatcaaaaccctcaaattcagttgccagctctgatgagatggtgattctgccagcagatgggttagaagtaaagtgaaatcccactctgtcattttctagaacttggcatgggagcagtatatgggcactgtaatgataaggaatttgtttaagactgaactactccaggactcaaaggataatcatgtcaggaagtgaagttcaagtttagctggccactgcccctaggccatactgagagatagttgtggagagcaagatagatagacagacaaacctaaaagagatgtcaaaaataacaacctaaacagtgaagtgcatagaaaaaaaaagtacctttaataatgtggcttagaaaagaacccataaatctgggctttaatatccctgaacagaagatagatcaacctctggaagcacctatattctatttactactgtggattctgaaaactctacaactacagtaggctccttgaaactcatagcttcatcctcacagaaggttgattaatatttaccaggttttgaaaatataagaacaggtaatttgtctttactcatctcagtgctgcgattgcttcttacaacccaaccccaaccctggttagaatattagccacctcaggagatatcatctgaagagcctctagagaatgaaaaacccactcagtccatagacttcaatggcaagtatggttagctgagaatcctgatttgtatttttactttttgagctggccttgagctcactgtacagccaaagttgaccttgaactcctgattcttcttcctctaccttccaacagctgaaattacaggcatatgcctccaggcctgatacatccatccaatgttaaggatttatgcacagacaggaatctacaagaacattatcatctctgacatatgtatatgtatatgtatatgtatatgtatatgtatatgtatatgtatatacacatatattttttttcctcagccccagcagcaaagagttgagaagcccaacaatccctccctaccacataatgcatgtaactttcagtgcccaacttttagtgacctcccacaaatactacaacatacatcttaatttgccttttgtgcttcccatgttgtgtctttttgccgtacttatactacgatttttactgtattactaaaacttgaatgtccttttattttattgccctttatatctttgtttaacttagtttctgagttttttattaggcgaaaatttttcttctgattccttttttatctttgttagtccatttcatctattcctattataattttagtagtacttcaattgtaatttatcatttatttgtttatttatttatttacactccagattttattcccccattccccctgtccaccacaactgttccgcatcccatacctcctccccagccccatctccaccaggatgtctccaccacccaccacccacccaacaagacctctaaactctctggagcctccagtctcttgaggattaggtacatcttctctgactgaactcagaccaggcattcctctgctgtatatgtgttgggggcctcatataagctaatgtttgctgcccggttggtggtccagtgtctgagagatctcaggggtccaggttaattgagattgctggtcttcctacagagtcaccctccttctcagctttttccagcttttcactaattcaaccacaggggtcagcagcttctgtccattggttgggtgcaaatatctgcatctgactcttcaagctgtgtgttgggtcttctggagtgtggtcatagccacagtaatcatgtcaggccttgggacctccccttgagctggatcccactttgggcctgttgctggaccttcttttcctcaggctcctctccatttccatccctgcagttctttcagacaggaacaattatggtttttactgtgggatggcaacccattacctcacatgatgccgtgcctttcttctggaggtgggctctttaagttctcttttcctactgtctggcatttcatctaaggtcccgccctttgagccctgggagtctctcacctcccaggtctctggtgcactctggaaagtccccccacctcctatttcctgaggttgcctgtttccattctttctgctggccctcagggcttcagtctttttcccacacccagtaccagatcaggttcccctctctccccccaccccacccctgtccactttccctcccaggtctctaactccctctgcatctcactattgcttttttctccctcccaagtaggactgagatattctcacttgggccctttagattgttgaccttttttagttctgtgaactgtatattgggtattctgtacttttttggctaatatccacttattagtgagtacataccatgcatgtctttttgtgtctgagttacctaactcaggatgatattttctagttccctccattggcctgcaaaactcagggtgtcttcattcttaatagctgagtagttttccattatgtaaatgaaccacattttctgtatgcattcttctattgtggggcatttgtgttgtttccagcttctggctatcacaaataaggctgctatgaacatagttgaacacatgcccttgtggtatggtgagacatcttttgggtatattcctaagagtggtatagctgggtctccaggtagatctatttccaattttctgaggaacctccagattgatttccagagtggttataccagtttgcaatcccaccagcagtggaggagtgttcctctttctccacatcctctccaacatgtattatcacctgtggttttgatcttagtcattttgattggtctaaggtggaatctcagggtcattgtgggttgcatttttctgatcactaagaactttgaacatttctgtaggtgtttctcagccattcgagattcctctgttatgaaatctcggtttagttattgtttatttttaaaagcctcatgtttttcccattcccatgtttattgggaagaaatgatccgtttcttctgtagctgaggccacagacaacaggacaaggttgggaaaaaaatcagtatgggaggtggggcattagtcattcaccccacattagaaaaattacagcacacaaacacaacaaatgagaacaaaagactaagagagactcttattttattttgtaatttctataatcttattttcctttcccttccctaacagtattttccactacttccactatttaaacttgcctgtatgtagtttaccttttttctatacccttcctttatttcattcatttaatatattcacatttactccaaataatttatatctttagagcatagtgttagttttaccatttttaatttttatttttaattaccttactaagtaacaggcttgcttatgttttcatgcatctttagtttggcttaatcccctttgttcctccatctccatgttcccaggcctcctgaaacctgtataccaccagtatttcccttcccactttcatatcacatagatactactattcccccctcacttaaagccccttttactccctttcctgggcgctacacagactgtcacataaataaacacatataaaatttagaagctagcatctgcttatgagaaccatgttatttttgtctctctgaacctcatttaacatgatatgttccagttccaaattggtttctctatgttctgctaccaaatatgttttgttttcatcaataaggccttaccatttatttactctggacaaccaggagcacaccggcaataacatagtattatgaaggtcttttagggtggtaactcatgcctagcacttagatttcttaaattttctttaacaatctatattcatccatacagagtaattctgttcaagctcatttttggataagggtatatattgaaattaacttactaattaacatgtattcttacaaaacagttatctagtggcttaggcacttgaagacaatcaagattactatttggttgtttctgtatagctctatcctgaatggctattggacattattttagcatttaactattttagtttaataaacatggcaaggtggttctatttccagtgggtatggtgtaccacattttgaaatggattaaaataaagctgagcatggaaaactgctctgtgcaaatgcaaacctgatgaattttgttacaaaatgaaaagattgtggttaggagaagaaagtagaaaactggcttggtgaaatttccatgggacagtatttggaattttgccagcatatgtttctctgctgttttagattaagttgcaaatgatcgcttattcacttgtactttttttttctgttttgaagcagtatctttctcattgattccgaagtcagccttctgagtgccaggaatacatgctagattacctagatttaattatattcattttacattttatttattattaatagtagtagtagtatttaatctttttttacagttgggtcattttccccctctaggtcttccctctgactgttcctcatcccattcctcctccactgtctccaagaggatgtccccaccccatccactcccaccttaccaaacctccctgctctgaaacagatgtaataacttacatttatattttttctactcaggaagctgagccagaggatttctatgagttcaaagccagcctgggctatagtgtgaaacactgtcccaaagtaaaaccttgcacactgtggaatctgctccttcctttatgtatattgagaatctactgcattctattgacttttctaagtatcttcatcattcttttcatgtaatccttacaactattctgtgagatatcaattaacatcttcatttcacacataagaaaagttcaaatccctaaagatgaaaaagatagaactgaaaacttccaggacaggtggagtgtgtatacgagaagttagaaataaaattgcatctaattctcttctgtaattaatattttaatgtttatcaaacaagttgagttgatattttgtttctattttacagggtctccctctgttgcctatggggagggatatctctcccaaggctcaagggaacctcctgtcttggcctcctgaattaatgggacttgaggtatgcatcactgtgcatagctggtttactccttttgtttaccacttacaatgggtaaaagaagtggcagatatattaaggaatgagtttgcacacacatacacacacactttctctcagctacaatatgtctttgtaatgtttcccttgcatgatactttagttgtctaaaaggaattttatctctattcaatttctctagatgagattcttaatattttgtaaacaataatgatgaggatatgcttttcagcagtagattgcagtattaacaagacagatctggtgtgtatccctgaccaaagaaagaaaaagagtcttgtcaacacacacacacacacacagatagaatgcaatttctcttgaatttgtaataataactttagtatggttttaggggttatacttttattacccttactgaaatttcatctagaactattggaattaatgactctttataccattgtaaacaggaaagtcaaatccgagagaatctgtaatttctgagggaaaaacctgtatattttgtgtttttcccagaatgttactatatatgattatgccatatgtgtttatttgtagagactgctaacatctgaacatacaaaaccaaacagacaaagtcttgcaccattgctccccccgcattctactctagaggaatgccactgtacatggattccaaacaggttaaaaagaaaaatagctgattagatctcagagtacccagtgaacgggatgacggccacagctgcagtggagacaccaaaaatggagaagagtgcttccaaggaagagaagcaacagccaaagcaggaggacagcacagaccgaggcaatgctgatcctgaagaatgggcgaactctgagagtgaccctgagcagatgagctgtaagagtggccacaccagctaccaagccacagatattcaactgaagaagaaagagatgccctctaagccacatcgtccgctctgtcggtcaccctgcctggaccggccaagcttctcccagagcagcattttacaggatgggaagctagacttggagaaagaataccaagccaagatggattttgctctaaagttgggttatgcagaagagcaaattcaatcagtgcttaataaactaggcccagaatcacttattaatgatgtattagcagagcttgtcagacttggaaacaaaggtgattcggaagcacaagtcaacttgagtctattactgccccgaggagcaagctccagagagattgcaagccctgaattgtctcttgaagatgaaatagacaatagtgataatttaagaccaattgttattgatggaagtaatgtggcaatgaggtaagcctcatggatttttttcctctccttctaaaacagaaattgtcttctattacagagcactataagatgttctttgttgtttgtgtcttgcatacctatagatggacagagtctaaaattatcattcccttgccttttcattctcctttggtattgctaccaatttatcttcaaatatttttggtgaattattagatattagtgatgcttcaacagagccaaaatatttaagccagtgtcctgtcatcttcaaaatcactgcgtacacattgtcagttgaagtctcacttagaaactttctgtaactcccaaccactaaaacagaaaactgggatatttctgccttcaaggcaaaagtgtgatctggacttttctcctcccacttaattgcatcatttatcttagtctctttaatggtcttcttataaattatgctggtttctatatccactacctgcattcatgtcatttcccaacctagaaattatattctcctcatcttcatacccttaaagatgtactacctacatctctgtgatttttctaaactcaatgattatccatggtaggataaatatttaccccacaaagatatccacatgctaatctctgaggcctgtaagtctgttaaatagtaaaacataccttgtatatgtctttaacttaagaagtttgacctggggaatgttaccttgtatgattaacgttagccaagagttgctgctagaggagggcaacagagccagaatgaatagcaagacatgccacagaaataggaaacgagagtgtaaggagagggccatgcgcacaggagtgaaggtagaatcgaaaagctgaaacatcttaagcctgaagaaagaaagcagccttgccagaactttgattttagatttctgacctcttaaactataaaatagtaatttctatacatatagtaatttgttataataacaatgggaaactaataaactgacttctggtgagactgtcatcactatgagagtcagtgtgctgatttctcaaaaagtaaaaatagaactagcatgtggtccaggtatactagtcctggatatagaactgaaggacccaagaatgccacttgcatgtttcttggtgcactattcagaagagccaagatatacaatcagtctcaatgcccgtagaccaattaacagataagggagtatacgcagaaagatgttttgtttgaaggaaaattgagtgagccagagatttatcattccaagtaaaataactcagatttggggaggaggaaggctgatttttttcttctgtgtctaatataaaagcataaatattatatatggcacagaagtagaaaaagagatgaaggaggaagaacaggtctaaactgaaatgaaagaaaaaagtaacacatattttctcttatatgcagaacttaagtttaaatatatacatatatgtatacatgctgtgtgtgtggggggtcccaccacagcaaatggggaggctattgagaggaagggaaccattgaaaggcaggaagagggagaagaatttattagtgatttttctcatttatatgacaaaataccctagaaaaagagcttaagaaaagaagttcttattctggcacagagtttgatagtacagcccatcacgcttgggaaggtatggaggcagaaacataaggcagctggttacactgcattcatagtctgaaagcacaaaaagatgaatgctgctcttcagctacatttctccttccgttcagtctgggtctgcagttcattcctgatgggtctttctttgttaattaatcctttctaggaataacctcacagatacagccagaggtatattctcatggaaattccaacttcaatcaaattgacagtcaaagttagtgtttacaactctaccattcaattttatttctaaatacataactttagaccataacattccagctcaggactctaaagactcagtttcaaatgcatttagtccatcccaacactattctaatagagtataaaatcttttctaaaactcaagagaatctcttaactgtgaatatctacaaaatcaggaaacaagttacatacttctaacctacaaggctccagaataaacaatcccgttccaaaagggaggaacctgataatagcaaggaaaaatcagattaaagcaaaagcaaaggctagcaggagcatcctacatcttgatgtgtcatatctgggacttatgatgacatcatctgggctccaataagcttgggaatcccttctcctccagatccgctccctgtaacacgtatgtcttcaatggctccatggataccttcggattttctcaatcgaggtcttattgtactaatacctccaaatccctggagttttcattgcagcttacacttcactttcctagtttcctgagatggacttctaggggctccttacaagtggatggcctgatctcaacacctctcaggaacgttgacacaaaacttgatatcccccaagtctctcatttcatatgtctgtaaaagcataaccgtgggtatgatgcttccaagttcagctgggatgtcaagacgtaatctggctcccttctatcatagccgcactagcctttgtatgcccttgttgctgaacctggaaaaactttcctagacagttatttttgagcagagaaacccttcagctgcatttttagttgaagtctctccttacaaatgttttaacattgtcacaatatgtgactttaccataaaaaaaaaacctttctcattcaagagagatttctctttaatgtctcagttacaaatgcttcatctcccttctccacaacttgaaacctactctcatttcctgaatagactttacatttttcacacctgtctgctctacattttcttctttttttaaagatttgtttgtttgtatgtgtgcatgtatgcatgtgcatatgaatgcatgagcccatggaggctagaaaagggcattgggtcacctggagctgaagtttttcacagttgtaagcaacacaacttgagtgctgggaactgagctccagtcatctgcaagagcagcaagtactcttaacccctgagctatctacacagccgcctttccttgtgtctttatcttactgtagacttgaataagtgcagtgaacagtaactatgctacagcctgaatgacacaccctattgaaatgtcctctacccaaaaatttagtcattacatttgaattcagtccatttccgagtaaagtgtagcagaagtgactcatttggcagagaagggtcccgagtgctcttctggataatgcaaggccacatcctttttttttttttttttaacttttatttaacatgttttcctttcttttcttttttcatgaccacattccttatattctttttttttaaattacatctctcctagtgaatgtttaacttcacagcttgttttccattaccgttgctattttattttctagtgtgattggcataaaccaggccttgactaaatttaaattgtatttttccttataacttagtttagtggtgttgctagagcagcagttgggtttcttctctttcagtgttgtggttgagacctcaaaaataaggctgacttgtaaaatattcccaaaataaaggtagaagagacactaacctcaacaaatgcccaaatcacaacttagaaacacaagaaatagggaaatgtaagaaaatatgactcttgaaagaccacagtgcttaatagttaaatccaaagatgttaaatggttgactcccatacaaagaagtcaaaattcagtttgaaaaatgatcagtgaccccaaagacaagtcatacagatgaataaagtaaggaagtcaattttataagtcaattacaggaagttctgaattcaagggttgcctcagaaaatcagtaacatggactaaataattgaaatgaataactaagtcaagttaaaatacagcagagtgcaatactgataatccagataaaacagaaggcagtagtaggaattgttacatttagacaacaatagaaaaaataagcaagcataactaccgttttcaataatttcaggatataaaacagcaaacttaagagtgtataggatagaaaaagaagctgaaatacacattgcatgcttgaaatacattctcaataaaatagagaaggaagaaataaagaaaagtctcatatagctctctcttgtaaggctatgccagtacctggcaaatacagaagtagatgctcacagtcatctattggatggaacacacagggcccctaatgaaggagctagagaaactacccaaggagctaaaggggcctgcaaccctataggaggaacaacaatatgaaataactagtaccctcagagctgtgtctctagctgcatatgtagcagaagatggcctagttggccatcagtgggaggagaggcacttggtcttgtgaagatcatatgccccagtacagggtaacaccagggccaggaagcagaagtgtgtgggttgtggagcagggtggggggaggatatagggtcctttggggatagcatttgaaatgtaaatgaagaaaatatctaataaaaaagtctcagcagttaagggtactgacagttcttccaggtgacctgagttcagtttctagaacccacatcagtcaactcacaaccacatatcttttgaccttcacaggaacacacacgcacacttaaaagtaaatcttttcacaactaagaaattaggggccggagaggtgtctcagctgttaagagtactcaatgttcttggagacttgagttcagttcccaggacctacatgtcagcttacagccatccataactccagctccagaggatccaatgccattttctgacttctgcaagcatcagacatacatgtcattcatgaaaaatgatcataatcacaaaataagtacatcttcaaaattaaaaagtaaattattgcaaaaaacccttccaaatctagggaaggatatggacatccaatacaggagggacttggagagctatatggtgtaaaaagataattagcctctgcaagttggcctctatcctccacatggatactatgacatgtgtatggcccaccctccaaacacacacacacacacacacacacacacacacacacacagagagagagagagagagagggagggagagagagagagagagagagagagagagttttaactctctagtttaaagaacaagtaaatgattggtttagaggcaagatccacttatctgatatctgtaagaatcacactttattggtggaaaactaaacataccaaatataaaggaatggaaaatgatatgctgagcaggcagaagctaaaagcagggagtagttgttctaatatctgacaaagtagatattaaatcaaaataaattagaagacataaagaagaatcctacatattaatggaattatccatcaagaagacctgcaattataaatacacaccaatcattgttataaccaatttcatgaagcaggcactactgagcataatggaacacagaagttccaatacaataatgatggaagatcatcatagcccattctcataaagcgataactcatctagatgaaattaatcaaacttcctactaaaactttactatggacttaatagaataaagaaacatctggaaaataatatttcactcaatagctgtggaatatgctgtcttctcaccagcccatggaactttctctaaaatacatcacatatattaaagtaggtcttaaaacataaaagttaatcaaaataatgtcttatgttttataatagaataaaactaagaaacaatagtaagtgaaaatatagaaaatatacacatgtggaatttgaacattacacactgaattattattagtggctcactgcagaaatcagtgataagttcttttttaaattctagaataaaatgataactaaaaagaaatggttttccagaaactttggaatatatttggaatatcctatactttgggagtttataggtatgtgtgactatacttaacaaagtgttcagagaaaacaaagaaatatcttatttggatatcaagatttcaggaaaaatcaagaaaaagacaaactcaaaataatagatggaaaaaatagtaatattggggctaagcctcggttgcctccaaaagtggaaggtaagtcctgttactaaacacagcatacatttcaaacacaaaactcttagaggaaccaagctgaatataacccaaaagactccacctatgaatacttaccttcataattccagaaaatgctatgcaagctaccatgagagaaaagcattcagtagtctcacctagctgtgacattcatagatgaagtacaacaatggtcagcagggtcaacagtgacacatatcttggtggtaaccaacaactgcctaattggacttgaggtctacttaataagaaggaaatcatgtctggcaatgtaaatctagtcagctggtagctagtgaggtcacagatctcagagaagaacctactactactgcttcctaaaccactatcattcctaactgcatttgaaaaacttatatatatgagtaactatagctctgccctctcatcaaagaaggttcattacacaattggagaccatttaagaaagttacacctagtcaaaatgcagggaacaagtaactatgggatactccagatccagtggataaatctacaatacagctctagaactaaaaatcaggaaacaccatgaaaggggtggaagatagatgggaaaagacagagatccaagaaatctgctgcaagattattgttttctatataggaaatcttaacagtataggtgcttaaacaagacctgaacagtaacaacaccagttagcatgccaacactaatagggggaaattgtaggtgtcttgatcattagatgaagagctacagacaattaaaaattgctgagaaagggagaattaattttccctagagatgagctccctaaatggttatccaatctcaagagtgtgtgtgtgtgtgtgtgtgtgtgtgtgtgtgtgtgtgtgtatgcaacactaaacagattcagcaggttgcatttatacatttattcacgtatatgtgtataaaaataattaaagaataatagaccatgaatttgaaaggaggtgaaagatatgtgagtgcttagagggaggagaggcccccagagagatgacacaagggaatattatattttaatcaagtaaaaagacattaaattgatttcaacattttacatgtacatgattttcaaagaataaaaaagaaaatgaaacaaaaatttggttctttgaaaagatagacaatattgttaaacaattaaccaaattaatcaaaagaaataaaacaaatttacaaaatttaaaatgaaaagaaagtagggaaattaaaacagacacctgtgaaaactagaggatcattaacagaataccttgaaaatttatatttaaaaaaaaccttagagtttttttttaaatacatatgtatatatgatctttcaaaattaaaccaaggagaagaattcaatgcatgcgtccatttatgagttgctacaatcttcagaaaataagcaagggataattggagatcagccatcctgtgaagtgggtaatggtggcaaaacactcatttcagttacaatgaaaggaagcatgggaaaacagaagtgaatacagattctgttgctaggtttcctctacttgtttgccttttgttcctaaccttagtaactaatatcttaatacacaccatacttttcatgttcctctactccataagaagttctggagttgaagcactcattgtttttaattggctgttattctatttcggtctatctatttgctgtacttgcttctgcaaatgagatatagtgtttgaatacactgagcacatgggctgtgattttcccaattgcactatacccaaccatagattagaaccttctttggtggcttgaataagaatgccccccataggctcatatatgtgaatacttagtcatctgagagtagcacaggctgtaagtatctgcatctgtctcagtcagctgctggcagagtctgtcaggggacaccatgctgggctcctgtctgaaaatacagcattgcatcagtaatagtgttaggacttggagtctcccttgagatggatcccaagttgggccagtcactagactgcctttccctcagtctctgttccatttttgtccctacatttatttttttcctacatttattttaaacaggaacaatttggggtagaaaaatttgaaggtgggttggtgtccctatccctctactgggggccctatctaaccactctggaaattaatctggcagttcctcagaaaattggaaatagttctacctgaagacccagttatactcttcctgggcatgtactcaaaagatgctccacaatatcataaggacatgtgctccactatgttcatagcagccttattcataatagccagaaactaaaagcaacccagatgttcctcaactgaagaatgaatatagaaaatgaggtttatatatacagtggaatactattcatctattacaaataaggacatcatgaattttgcaggcaaatgatgaaattatcatcctgagtgaggtaacccaggcccaaaagggcatgcatggtatgtaattactaataagtggatattagccaaaaggtaaagaatacctatgatacaccccacagaccttaagaagttaaacaagaagggaggcccaagtgaggatgtttcagtcccactttgaaggggaaacaaaataatcatgggaggcagagaggagggaccttggtgggagaggtgaggggatgggaaaatggggtcaagatcagttttatgagggagacaggagaaaagcccagagggcaaagagaatgaatggaaatacacaactctcaggggcgggggtaggaggaacctctagaaagtccaagagacctgggatgagggtggctcccaggactcactgtggctgcccaacagcggggatgtgaagcctgaagagaacatagtcaatcttaagtgacacaaagaaggctgttcaaagaggcaaattcatagtactcaatttcatattaaaacaaaaacaaaactggagagagctcatatcagtggctgagcaacacacttgaaaggtctagaacaataagaaaaaacagtactcaaaaagtgtaaaaggcaagaaataatcaaactcaataaatcaataaaatacaaacaaaaaacagtacaaagaattaatgagatgggcacttggttctttgaggaaatcaacaagattgataaacccttagccaaattaaaaaatggggagaaaacacccaagtaaataaaattagagatgaaaggtaggaagcattacaatagacactgaggaaatccagagaatcataaagacatactttaaaaatccatactccatcaaacaaaaatctcaaagaaatgggtaaatgttttgatatatatgacttaccaaagttaaatcaatatcagataagcaatttaatcagactcttaactcctagtggaatggatgcaataattaaatgttttccaacaacaacaaaaggcccagggccagatgtattcaatacagtactcccagaccttcaacttcaaagaagaattaacactaatacccctcaaattattccacaaaaagaaaacagaaagaacattgcctagtactttttataagcctgcaattaccctgatgccaaatccatataaatactcaggaaaaccagaaagttatagatcaatatctgttataaacatacatacaacaattctcaataaaatagttgcaaatggaatccaagaacacatcaaagagtattcatcatgatttagtagagattagtaggcttcatctcagaaagtgagggaaggtccaatgcatgtaaatcaataaatgaaattggacacataaacagactgagatataacaaccataagatcatctgctaggttcagaaacgccctttgacaaaatcaaacatcccttcatgataaaaatcctagaaagactagggatagcacaacataataaagtcaatttagagcaagctcacagcctatgtcaacctaatgaagagtttcttcactaaaatctggaacaagacaaggatatccactctctccatagtattcactatagtatgcaaagtcttagctagaaaaataagacaacgaagagatcactgctttccttcataatacttgcttgaatcaccgtgtttctttacagcactacaacagggatgaagacaccaagcaagtcaaagacttgcataataaaaaatttaagacactgaagaaagaaactgaaatagatatcagaaatagatagatctcccatgctcatggatgggtaggattaatagagtagaaatggccatcctaccaaagcctctaaacaagatgtgggtagcacagtcattaaaacaagcaataagtttgacctcattaagctgaaaaggctgtgtaaggcaaaggacatcttcattcaagcaaagcagcagtcttcaaagtaagaaaaactctttaccaattatttaaaatatataaagaactaaaaaaacaaaaaaacaaaaaaacaaaaaacctgaccatcaagaggacaacacaaacacttgttgaaaaagaaacacaggacaagaacacttggaacctacgaaaaccagaaggagctgagaattatttcacctttcaactcagcacagatgtaaaaaaaaaaacaaaaacaaaacaaagcaaaaaaacaaacaacaaaaaagcctccatgtttatgtttctccactccacttctataagctgtttttattatatctcttataaactatactcttatcctttgtcagttttcttttattgaaactagattcttttctcctacaatatatcttgattataatttccccctctctcctctcctcacagttccttcccacatcccctcctcctcccctccaaatcctttttgtctttcatggtaaaagaataggcttctaagagataacaagcaactcggtgaaataaaatataataaaatgaggcaaaaactatcttatagaagttgccccttcttagaattggaaacaatcacccatggaaggagttacagagacaaagtttggagctgagacaaaaggatggaccatctagagactgctatatccagagatccatcccataattagcctccaaacgatgacaccattgcatacactagcaagattttgctgaaaggacccaaatatagctgactcttgtgagactaggccagggcctagcaaacacgtaagtagatgctcacagtcagctattggatggagcacagcgcccccaatggaggagctagagaaagcacccaaggagctaaagagatctgcaaccctataggtggaacaacattatgaactaaccattaccccggagctcttgactctagctgcatatgtatcaaaagatggcctagtcggccatcactggaaagagaggcccattggacaggcaaactttatattccccagtacagggaaacgccagggccaaaaagtgggagtgggtgggtaggggagtgggggggggtatgggagacttttgggatagcattggaaatgtaattgaggaaaatacgtaataaaaaatattaaaaaaaaaagaagttggctatagcaatacaacaggaggaaaagagtcccaagagtaggcaatagattcagacacactcattctcatagtcaggagtcccacaaaaatactgagctaatggctataaaatatattcaaaggacctggtgtagacccatgtaggccctgtgcttgctgcttcagactctgtgagcccataagtgctatgcttagttgattcagaaggtgaggctctcctggtgtcctgcatcccctcagactcctacaatctttcctccctgtattccacaagatttcctgagctctaaagttagggattggatagtgtcttagttagggttttactgctgtgagcagacaccatgtccaaagcaagtctttttttttttttagatttgttaaacatatttttaattaagtattttcttcatttacatttcaaatgctatcccaaaagtcccccataccctccccccccactcccctacccagccactcccacttcttggccctggtgttcccctgtacaggaaccaaggcaagtcttttaaggacagcatttaattggggctggcttacaggttcagaggttcagtccattatcttcaagacaggaacatggcagcattcaggcaggcatggtgcaagaggagctgagagttctacatcttcatctgaaggctcctagtgtaagattgacttccaggcaactaggatgagggtcttaaagccattcccacagtgacacacctacttcaataaggccacatctcctaatagtgccactccttggatcaagcatatacaaaccattacagatagaaacttcattcttagactctgtctccacctaatgtctggctgtaggtctctgcaactgttcccatctgctgccagaggacgtatctctgataatgattgtataagcactgatctatgagtatagcagaatatagttagaaatcattttattgattttttttcttttacagaccagccatttttgcttctatcctaagtctctgggctatacagtctctggttcctggttactcaagcaagcaatgtttagtaggggttccttttcatggagagagccttaagtcatttcagacattgattggctactcccacaagttctgtgccaccattggcctagcatattttgcaggcaggacagattgtaaatcaaaggtttttggctgtgttgggatccatgtatcacttctggtagcttgcagagtgtcatcctgcacgtaaaagatttaaatgtaagggtgagagctccatgtaggcatcagctcaacgtccccatgttaactatgttgtgtgggtgctgtcctcagcagtgttgccctgctgccagtctgtagacaccagccctttttctttgcatcagcctgggttgtttggggattttcaagagactcctttgaccaacaactcagttccctccactggaagccttgtttggttatgagtatactcagagatgtgcagttgcaacttcttctctgttactagaagacccccttaggatcaccttcatagattccaggaagcttccactctactaggtttccacaccattccccaaatgtcctccaattccagccatctcttcccatattctctccctctaccccacactcctcgcctgataccttctgcttccatccctatatgccccagtctacccataaattatatcctatttctcctttccagggaaagccatactttccccactagagcccaactcttaactaaccttactgcatctacagattgtagcttggttgtcgtttaatcaacagctaacatccacatgtaagagaatacatactatctttgtcttttgtagtctgggtttcctcacttaggattatttttttctagttgtatccattcacctgtaaatttcgtgatgtcattttaacagctgagaaatactccattgtgtaaaagtaccatactttacttgtccattcttcagctgagagacatctaggttgcgtctggcttctggctactatgaataaggctactgtgaacaggttgggcaagcatccttgtagtacgaaggagtttcattgtttttatatagctagatcttgttatagcaattcccagttttctgaggaaccaacatattggcttgcatagtggctatagaagtttgtactcctaccaccaaaggaagagtgttctcattgctctatatcctcaccagcatgggctggcaattctattactgaccatggccattctggcaggtgtaagatgcaatctcaaggtagttttgatttcctggtggctaaggatgttgactatttcttatttatttgtttgtttgtttgtttgtttacatcccaaatgctgtccccctcccagtataccagtcccctcttacaaagtccttccccatcctgggtatcccccaaccttggcatatcaagtctctacggggcaaggtaaatcctctctcattgaggccagacaaggtagccctatgctacatatgtgctggtagccttgggcaagcccatctatgctctttggtggtgattttgtctctgggagttcccaggagtccaggttagttgccagtttgtgttttctttgttgcttctatttccatttttatgtcttgaacagttttattctttccttcgatgatttgtattttcttggctttctctaagggatttattaattttctccattttttgtttgtgttttgcttgatttctttttttaattatttattatttgttataatataatatagaattatattatttttacaatacagtaattttacaaacactacttaaaatgtgatgaagactcacatatcatgttactatcagaaccttcttgagtattctagataaactgaccaaccaggtgggctttgtgtagtataatcaagttgaaagcaatgaccttcttcctttcctggtaaatacattgttctgataagatgttcaagtgcttttggaacttcaggatttctgtatggctgagttttagctacattactttgtgctcccggccacctgcctaagagctctttggattcacgaatcacacacacgtgcacacacacacacacacacacacacacacacacacacaagtacacacatgtcagttaatttttgtcatgctgtgattagctcaaagactgagcactccactttgccctccctggggtttttcttttaaattctaacaaaattgtcttttaagttttgtgaagctaggaccaccatcatgagtgagaccatccacagtggtctgagccctcccatatctatcactaatgaagaaaatatcctatgggcttgtctgtagccagtttatttatttatttttttattagatattttctttatatgctatcccaaaagttccctataccctccccacaccctgctcccctacccacccactcctgcttcttggccatggcattcccctgtactggggaatataaagtttgcaataccaaggggactctcttcccagtgatggccgactaggctatcttctgctacatatgcagctagagataggagctctgggggtaatgattacttcatattgttgtttcacctatagggtagcagaccccttcagatccttgggtgctttctctagcttctccattggggacactgtgttccatcatatagatgactgtgagcatccacttctgtatttgctaggcactggcatagcctcacaagagacagctataacagggtcccttcagcaaaatctttcttgcatatgcaagagtgtctgggtttggtggctgattatgggatggattcccgggtggggtagtctctggatagtccatcctttcgtcttagctccaaactttgtctctgtaactcctttcatgggtattttgttccctattctaaggaggaatgaagtatccacccattagtcttccctcttcttgattttcttgtgttttgcaaattgtatcttgggtgttctatgtttttgggctaatatccacttatcaatgaatgcatatctaatgacttcttttgtgattgggttgcgccactaaggatgatatccaccagatacatccatttgtccaagaatttcataaatccattgtttttaatagctgagtagtactccattgtgtaaatgtaccacattttctgtacccattcttctgttgagggatatctgggttctttccagcttctggctattataaataaggctactatgaacatagtggagcatgtgttcttattaccagttggaacttctactggttatatgcccaggagagctattgctggatcttccagtagtattatgtccaattttctgaggaacctccagactgacttccagagtggttgtacaagcttgcaatcccaccaacaatggaggagtgttcctctttctccacagcctcaccagcatctgctgtcacctgaatttttgatcttagccattctgactggtgtgaggtggaacctcagggttgttttgatttgcatttccctgatgattaaggatgttgaacattttttcaggtgcttctcagccattcggtattccttagttgagaattctttgtttagctctgaaccccatttttaatggggttatttgaatttctggagtccagcttcttgagctctttgtatatattggatattagtcccctatcagatttaggattggtaaaaatcctttcccaatctgttggtggccttttttgtcttattgacaatgtcttttgccttacagaagcttcacaattttatgaggtcccatttgtcaattcttgatcttaaagcgcaagccattgctgttctgtttaggaatttttccccctctgcctatatcttcgaggcttttccctactttctcctctattaatttcagtgtctctggtcttatgtggaggtctttgatccacttagacttgagctttgtacaaggagataagaatggatcaattcacattcttctacatgataaccgccagttgtgccagcaccatttgttgaaaatgctgtcttttttccactggatggttttagctcccttgtcaaaaatcaagtgaccatagctgtgtggattcatttctgggtcttcaaatctattccattgatctacctgtctgtcactgtaccaataccatgcagtttttatcataattgctctgtagtacagctttaggtcaggcatggtgattccacaagagtttcttttattgttgagaatagtttttgttatcttaggttttttatttttccagatgaatttacaaattgccttttctatctcagtgaagaattgagttggaattttgatggggattgcattgaatctgtagattgctttcagcaggatagtcatttttactatattaatcctgccgatccatgagcatgggagatctttacatcttctgagatcttcttcaatttctttcttcagagacttgaagttctttttttccatattttttattgggcatttatttcaattacatttccaatgctatcccatgctcccccacccactcccctacccacccactcccacttcttggccctggcgttcccctgtactgaggcatataaagtttgcatgaccaatgggcctctctttccactgatggccgactaggccatcttctgattcatatgcagctagagacacgagctctgggggtgggggggggtactgggtagttcatattgttgttccacctataggattgcagatcccttcagctccttgagtactttccctagctcctccattgggggctgtgagcatccacttctgtgtttgctaggccccggcatagtctcacaagatacagccatatctgggtccttttagcaaaatcttgctagtgtatgcaatggtgtcagcgtttggaagctgattatggaatggatccccggatatggcagttcctagatggtccatcttttcatctctcttatcatacagatctttcacttccttagttagagtcacaccaaggtattttatattatttgtgactattgtgaagggtgttgtttccctaatttctttctcagcctgtttatccttttagtagaggaaggccactgatttgtttgagttaattttatttccagctactgcactgaagctgtttatcaggtttaggagttctctggtagaatttttggggtcacttatatatactatcatatcatctgcaaatagtgatattttgacttcttcctttccaatttgtatctccttgatgtccttttgttgtcaaattgctctggctagaacttcaagtactatattgaataggtagggagaaagtgggcatccttgtctagaccctgattttagtgggattgcttctagtttctctccatttagtttgatgttggctactggtttgctgtagattgcttttattatgtttaggtatgggactttaattcctgatctttccaaaacttttatctttaaagttttctttatctttaaagatttctttcaaggatttatacatttcctctttttatcagatattttatttatttatatttcaaatgttatcccctccccattccccctcccccagaaacaccctatcccatccaccctcctcctgcatctatgagggtgctgccccacccacccactttcgcctcccacctttctattaccctatactggggcatcaagccttcatggaaccaggggcctctcctcccattgatgcccaaaaggccatcctctgctacatatgcagctggagccatgggtccctccatgtgtacttcttgtttgctggtttagaccctaggagctctgggggttctggttggttcatattgttgttcgtcatatggggttgcaaaccctttcagctccttcagttctttctctaactcctccattggggaccctgtgatcagttcaatggttggctatgagcatccgcctctgtatttgtcaggctctggcagagcctcaaaggagacagctatatcaggatcctgtcagcaagctcttgttggcatccacaatagtgtctgggtttggtgactgtatctgggatggatctccaggtggggcagtctctggatggcctttccttcagtctctgctccacactttgtatacatttcctctttaagacctctatttgtctttgtgtggttgttgttcaggtctttgttctgtgctttggctatgttggaattattcagggcctcctctgtaagatggctgagctcaatagtggagatactatatttccctgactgttacagatttttattcttttttaaatcactttacatcctaattgctactccccttctggtgcccccttcacccagtccctaccaccatctctctctcccttctcctctgagagtgtggagctcccccaccccagtatcccccaaccctggcattatgtctctgtagggccaggcacatcctctcccactggaaccagacaagcagcacagtttggggaacatattccacagacaggcagcagctttattgatagtgcttgctccagttgttaagggacccacatgaagaccaaactgcacatctgctacataagtgtggggacccttggtctagcatatgtatgctctttgattggtatgctctctatctctgagagctgccaaagatccaggttagttgactctgttggtcttcctgtagagttcctatcaccctaggggccctcaatctttccccccaactcttccttaagagtccccaaactctgtccactgtttggacatgggtctctgcatctgtttcagccagctcctggggggggagcctctcaagggacagttatgctaggcacctgtcccccacctctggcatctgcatatttccattcattctcctggccctctggccctctctcctgtttctccccacatttccctgccagttccctatcaagcccatcagatgtatagcttacattattgctttttggtcatgttttgtcacaacagtataaactctaactagcaggttgttctatctggttcttatcaaattgacatagcgagagtcgttttggaagaggaaacttcaattgagaaaatgttcccatcggattgaccttgagcaagcctttgcgattatttttttaatgttctttttttttattgggtatttatttcatttacatttccaatgctatcccaaaagtcccctacacgctcccccacacactcccccacccacccactcccacttcttggtgctgtagttcccctgtactgagggataattttttttaatcaatgattgattgaggtggatcagcccaagttggtcagtgacatctctgggctggtggttctgagtgctgagcaaataagccatgaagaaaagggtagtaagcagaattccttcatagcctcagcttcagtttctgcctccaagttcctaccttgagtttcttccctaaattccttagatgatggacttgacaaactgtgagctgaagaaatgcctttccacccgagttgctttgaataatagtggtttatttcagtaataggaattctactattacattgtcatctggaaataagctaaagagaaaaatctgtgaattaaatgacatcataaatcaaacagaactaatgtatttatagaatattctgttcaagtaccaaagaatccatatgcatcacagcaatcccatgaaacttcctccaacacaagacaaaatctacaaatatggagaatgtaaaattacatccagcgtggttatctgattataacctgagtaaagctaattagaagctgcagtagaaagtacatgaattcacagaaactaaacatcacaatactaaatgaaaatagaatcaaggatgaaataagtacagaaagtttaaaagtcaagtacaacaaaatatatgtaacctaacgaagggagttctcagaggaaagtttatatccatgagtgccaccatgaaaaaaaaattgagagactgcaaattgatgtatgatgcatctgaaggccctgtaaaatcaagaacaaataacacccacaaaaccacatgaaactgaaaaggttctgtagaatttctgtaccaaaaggaatggcaaaatcaaaacaaaacataaaacagtcaatgaactgattcctgatgatactcatagatttgtgcctagcccagtagtcatcagagaggcttcatccagcaagtgatggaaatagatgtagaggttcacagccaaacattaggcacagctcagggaatcctgctgaagaggagaaggaaggaatgtagaatccagagaggtcaaggagccacacaaaaacccacagaatcaactaacctgggctcttaggggctcacagaaactgagctgccgaccagggagcctgcatgggtctgatctaggccctgtgcacatatattacagttgtatagcttgatcttcatgtgggactaatgacagtgaaagtaggggctgcctctgactcttttgcctctctctcatctatcactgcctttgtgtctctagttccacctctcttcaaagtgcacttaccacacccttttttctctttcccacctctccatcatatacttgttcattgtagtggtgcctacctcatgaggaagggcagggggcctggctggcttctaccctccatcacctggaatgaaaaaaaatatatatgtgtatatatatatatatatatatatatatatatatatatatatatatgtttttttaatatatgaatactatattatatatacaccagaagaggacatcagatcccattacagatggttgtgagccaccatgtggttgcagggatttgaactcagggcctctggagttcaagtccttagtcagtgctcttaaccactgagccatctctgtagccccttctggatttttttttaaattacacaatgtttgtggaaatagatttttttctcttattgcatcatgttctgattataaaagaaatgcttgactttggaggaaattttagacattgaagaagagcatatttattttgtcattttcactgtcgttttaagcttaatatatgtgcttaatgactgggagtatgtcacagaagaggaggctcctctaacaatgcagagtgctgtgcataagtgtgtgcgttcgtgcatatgtgtttaaacttcacatcacctatgttacatatagacttttttcagtcctctgaaaagcacccttcttttccagtctcttgtggatactcaaatcttcgagtaaaggtggcaacagaaatagaaaggagaaaatgaaactaatagtggttgtcatgtctgctgtaagttgcgagttgttattaatcacctttgccattgggtgaagtttataaaaatacaataaaataaaaagaatacagttttctcttttaaaaagtattttttggcatagaggtatgatttaatactagcaagcttgtgacggtcctgagtttttcatgtgtgtgtgtgtgtgtatgtgtgtgtatacatgtatgtacacatatgtgtatatgtttggcatcatcaaaaaatgttagtcaggaattatgttagtactctttcatctccatacttgggaggatgaggcaagaggatcactccaagctggaagccaggctctagagagtgagtttcaagccagcctaagctataaagagcaatcctgtctcaaaaaaaaaaaaaatgtatgagaaaagaaataaaaatgcctgtcattaatcccagcactgagaaagccactggtaaagtgtttccttttgctattattaacctttctgtctcttgctctctaatgtttatgaagccatgggaataaagaagaattctcctgcaggggaatacaacttgctgtggattggtttctagacaaaggccataaagatatcacggtatttgtaccagcatggagaaaggagcaatcccgccccgatgcaccaattacaggtattattttaaattaaaattaaaaaaaaacttttcctcgagagtcaaagcgaaaaagctagtttggagagaggcagatggtcccaacttagataattgcttttctaagttaagtatgcttaaaatgtcttttataaaaatggtccatatgagaccatccttgttttgtggtatgtgatagttaaataaaatttacatttggaaaactacaaatcataaaaaagaatgttattcttatggaaatttgcacacacctgcaatcccagcactcaatagacttaggcaagatgatagcgagtttgaggctaacctgctgtacatagtgagtaacaaggcagactgatcatagattttagacagggaacaaatagggttataagtataactgatatttttcaagaaattaaaggttacatgatatgcaggcagacttattttatatcagagaaacaactatggagttttcaaggtagggatagcagaggagaaaaaaattcaaagacaggaaaagccaattagtgtctgagacaaagaagcgtcagagcctaggggcgaccccagttcttaaagctccacaaaaatgttttcattttgttctttatttgtttgtttgtttgttttttcgagacagggtttctctgtatatcccttgctgtcctggaacttactctgtagaccaggctggcctcttttcacataaaaaaaaatagagaataacaataaatgtacagtaatacacttcattggattatgtttgactttatatagtgcaattctaaaatgaagatttcaatattcctttctggaagaaagaactcatgaaaataaggatgcctaaccaaaagactggtgctgtgtgcctcatgctggcagctcagtcactgcatttccagtacacataagatgtgctctgtatagcactgaagaacacagagatctcggtctcctgattagcgccatctcattcctgacggaactactcagaaagtacagggagtgggtggttaaggtctgtgttgagctgtctgtgtctgcagtgcaggcccaagctccagcgtgagagtagatctcagaaagtactgttcagtcccagtaagcaagttttctgtcctaaacagttgggtccgaaattgtcagcaagatggctcagcaggtaaaggcacttgctgccaagtctgataacctgactttaatccttgaaaaccaaatggaggaaagagaactaactcccacaaattgccctctgacctttccacacacacacacacacagacacacacacacacacacacagacacacacacacacacacacacacacacacacacacagacacacacacacaccctccctccagatacagcctttgccatttctgaactaaaaagtcaagaagctaggctagggatagggatcagtggtacaatacttgcctactatgctcttgagtttgggtttcaacccccacaccacagaggaaaaaaaaactctgatgcttcagacaaaaggcaaaacaagtatcaagaatgctagactaagctgagtgtgttggcacacaacctgttatcccagctgttgggccattgacttggaagaatctgaagcctcgggctagcctgcgccccatagaaagactgccttaaacaatgttataccaagagttactccttactctttgtgatttttttaaaaaattaaatgtgttggaatctagggttgttttttggttttgttactcgttttactgaaacaaaaactaaagtgtgaaagagaagatgactgatctaaggtcacaattctatttaatatcacagccaggaaagtagcacacttgttctccaagtaaaaataaatcgtttatctagtactaactcttgttttggtaatatggggaaaacacagttaatttccaaagatgatttctactatgtggcataaacatattttgatagatcaagatattctacgtaaactggagaaggaaaagattctcgtcttcacaccatcgcgaagggtccaaggcaggagggtggtctgctatgatgatcggttcatagtcaaattggctttcgattctgatggcatcattgtgtccaatgataactaccgagaccttcaagttgaaaagccagaatggaagaagtttatagaggaacggttgctgatgtattcttttgtgaatgataagtgagtttctttctaaacagttgtgtataaactagtagtagtaatgcattacatctcaataaacatatattagacactg

SEQ ID NO: 559 - DNA, 213081 bp, mus musculus; identical to SEQ ID NO: 558

SEQ ID NO: 560 - DNA, 72565 bp, mus musculus
gagaggcgcggaagcccggccacataaaggagcgagcagcgcaacgggggcggctctttcctgggtggggtttgtaaagtcgtggcccgttagcaggaagcggagcagtcgcccaacgctagagtgggacccaatctgagcacccggttctccggagtccttgccgaagtgtactgcgcgctcagagcagcccgacagtttccagccaaacttcaccaactcctctgcccttgccgccaccatgccgaagacggtgagtgccgacaactagcgcggtcggccctgggggctccaagcttgacccttgccactttatggcttcgggcttggttgctcacaggcctgccggggatgctgggctgtccactaaggccctaggaaggagaagatagtggagccctaatttgagcgctctagagggtgacagggtgtacaaactagaagtgtggataaggaggagccagcctttctcgggttccagttccccgcctctgggatgagacagtggaaactctttgagggactggatcaatcccctattctaaagggtcgttgggaactggggaaacgactttacttttgagaacatttccccggcccaggaattggcgcctttctgtagcaaagctatcactgtctcagaagagcccccaagcttacagagaagcggggaggagagaggaagttgcccagggcggatcccgcacacccatccacctttcccataaccgcccctcttctaccccacttctgctctgtccccttccaccgcgtcttagccccaactgctttccccagggaaatgaagatttgtgaagggtctcatcaactgggttactttacccaggggtacaaacacttcattaggcacaagtctgtggaggggcccacacaacccactggaagacagggcaggtttctcttcctctattaaatccctgtcagacatagtgcctctctatcccctcaggaccgttttgtgaggtataggttttctcctgtgggggccacacctatctagtgtggtggttgatttgagatctggtctccaccccactggctgttgctcgcagaagcctccagggagtgaggcctaggggggccggatgcccagtagggaggggtgggggaggggtatgtgcttgactaatgagctctgcttgcttttgtgcaagtcacgccaggtccttgctcatgaaggccctatgaccaccgtgaattatgtttcttaggtaatggggcttgctgggctcccatgttgtatattgctagcctacccatctctctagtactgcctgagcctggtagaactgagacagtgactaggatgctggagaagggatgagggtgcctcggaagagaggagagtgaatagatacaggaggtctttgtgtctatattgaagtttccttgctacccttactgtattctagctacactgcctaatcgtccttgccttctcagaactctgttcttaagaaataccaaggtggggtttttttttgggggggttcttttcttttttttattttttattttttgagagagtctcctggtcttatataaaagtatactttgtgaaagtatatacatatgtgaaattacaatttgctcccctcctccactgccctcctgtcgcctccttcaccccaagacttccgttcggcaggcaggtttccttcctcccctcagttgtcttcccttctgttttcttatcacatgtattccatttcggggctttttacttgggcaggatcttaccctataacctaggctggcatgggactcccgatgtaatgtaggtggctttcagattttttttttttttttttttgccagtcttcctgcttcagcctccacagtgctgagattacaggcttgagccatcatgcctggcttgttcatttgttttgatagagggtttgattctagccaaggctggtttgaactcacattgtagcctgagatatacttaaaaactcttttggaagtagttcttctcaagtgcagggattgtagccaccactaaacccggcttccactccttctgtaccgtgtactcaaccatttctaaattatgaaagatacgaaatagtagtgtaaaatcagatttcttcgtttgtgttagagaaagtcagtttcgctgttaaagctaatttgttctagcaggcagcctactttaaatatgttgaaatacaccttttttggactgtctctggttgctagttcccaaagtctggtctttgatgtttttcaagacaaggtcctatactgttgtagcagaggttggtctccagctcctagccatctcaacagagccctctgagtgctaagatcacaggctcccctgtgaccagcccatctatcccttctggagagaagagaatttctatttaaaatgcttttcctggtgctggagagattgcccaacaaggcactctcacaagttctgatctcagtgcccacatgacagcttgcaactgtctgtaatgccagttccagggaatctgactctctcttttggtgtccttaagtatcaggcacagttttcgtatacatgcatgctgccaaaacactcatgaacataaaataaaaaaataaataaaccttttttggagaaggtctttccctctcaattccactttcactttttttttgtttaatttcaaagatttaggagatccacttggattacctaaaaaagagattattaatttttcaagattttgagttttttatttcaaactttatgatttattgttacaatttatttatttatttatttaactggtttgatgaaacagggtctcataaatcccaggctaggcttgaacttctaatcctcttgcttccaccacctaaatgctgggatttgttgtcatactaccaagaacgactcttcccgttgtctagattgaaactggctatagaggaggacggacccggccatgagtgatgttgcataccaacaggaaggctacaacttggggttaggtctttttttgagggggaggtatcagtcttggaaaacctgtttggtttactgggatttagcaagtcaggggaaaaagtggtcagtgcttattggatagtatcatccatgatagacagagcccagctcctttgaagtatttgaaaacttctggccccgcattcagctaaactttaacaggggctgtatgaactgttgattttcctgccattcctagcattgcttgagccactgaagtggcactaaagtggtacttgactaatagggggcagaatttcaggcttctaacccttgaaccagccctgtctgtagacttgagggtggggcaaaggatcaggaatgaaggttgtgtgggaggcttctgcctctgtctgctgcgctgccaccccctccatccccccttctctctctactttttggaaacaatttcttgttgtgtagccctcagggccctataaaataccttttttttttttttaaacaaacaaactcacagcaatcctcttgactctgcttcagaatttctggaattacaggtgtgaactacctcctgagggtgttttgttttgtttgttttgagacagagtcatgctgtgcagtgcaaattagccttgattccaggcaatcctatttctgcctcaccaattatgaaattatatagcctctctacacacacacacacacacacacacacacacacacacacacacacaccagtggacatcaaagggcaagtttcaggagtcagttctcttcactatggcatctgtgaataaagtggtcagctttggctggtaagtgggtgaccctctgagccatcttggaagtcacttgatttattgtttgtgactgagtctcatgttgcccaatttggatttgaactagatatataggcaaggatgaccttgaactctgtatctttctacctcagcctccctcatactagcataacagatgagtgttaccttgtctatcttctctccagtcttgattttccaatttgctgaaccctttgtgaaagtgtagatagtagagaacagaaccggtaccatcttggggatttcatttatacttattcatggaaaatctcttgcacagagagggaaaagtcaaggcacaaaatagcctctactttcatcttgggaggaaggttgctctgtcagtcagtgatggggtggtattgactactgcattattctctaagtgcctgtaatggcagcctgtaagggaagtgttgccaggcatggtagctcatgcctgtaattgtagcacttgggaggatagaagattgtagtgagtttgaggccagcttgagctatatagagtaaggctgtctaactccctccccccaaaaaccctaacagtaccccccaaaaagaaaaacaacataaaaataggtggtgccttttctttggactgttactgtaatccaactgctttatgagattgtggaagtggaagggacatttagaggtcatttagtctttccccatgcttccaaatctaattctctatggatgagaagtgatgacagctacaattattctgaactctgttctaatagtgttgcttagcaacagtctttcttaggttccattgtatattcctgggagtctacccctacccccactggaatttctagactcagggtccctggagggggagatctggctcccagcagtactgtcagggttgggcttttcatggccatacaggctctgatcgtccaagatagatcctgactctgtatgatctttgaaagatagaactgagtttatcatttgcttctttcttaacttacaatcttttctgctaccctgcctcattcttctgtccctaaagagggaaaacaaacaaactagcagtacaaaggtggtcttccttggggctgtccgttggtcaggtcatgatgaggatggttttcataattgactggctttgctgttcatcccttttacttcatgcttgatagagctgaaaaacttttcaattccaggttctaatttgtgatagaagatctcttagtttggagttagctcagcattacatgaacgtggatggtggttgttgggaaatagaaagtaaaactcaacttcgactatttgttttcattctatataaggagatgagatgcttgttgttgatttttaaagatttattatgtgttatttatatttgaacaaatgaaatttccttgaagcttggcggtggtggcacacatctttaattccagcattccggatgcagagacaggctgatctctgtgagtttgaggccagcctggtctacagaattagtcccaggacagccagggctacacagaggaactctgtctcaaacaaacaaacaaacaaacaaacaaacaaacaaacaatttccttgaacacgatcctaggaccttttaaggagttctgtgaatatatagatacctgccaatagctgaaattctaagtcttgcttgagtctataaaattaaatagatatcctcctaaattttgtttctggtttttgaaacctaaagtttctgttggtctagattggcctaaaatgcatgataatctcctggctcagcctcctaaaaatatctttagttgtcatattaagcagaagactggggaatattctacgtgtctcaatttccttaatattttgttaaatctacaaatatatacaactgagttagtgtaaattatttgtgctcatcaaattttcacagcagcaaggtttactaaaaataaagaaaataaagttctagctgatgaagaagatctaggcatggtggtataggcctacactcccagtacttgagaagtagaggcagggcaatcaggagtttagtgttattccctacaaaataatgagtttgtatccaggttgggctacatgtcttaaaaaacaatagaaaggttatccaaataaagtatgccattagttaattcctttctgtccgttcagtatttcttcgaggttgtcataagggacctgtgccagtaataggtaaactttagggactcttgtaatactgatattcctgacagccttgatggcacagtggtatatggcactgtatatcttttttcatatgcatactttcagacattctttagtatgtgagcacctttgatgtattggagtatactagagatacagagttaacacagtgcttgcccaagggtatttattttgtctttctatatttctgcactattgtttgttgagtaccagtttagaatgtagagtttctgatacattgcattagatcttgctaataatactggcatgaggactcttggctatttatttctctattgagttttaagcttttggctgttgtgtgttttttattaattatttaatttactttacatcccgattgaagcccccttcctagtcccaccctcattacccttcccccattatcctctctccttctccccagagaagagggtaccttcccctggggtaccacccccaccttgggacataaagtcaaagcaggagtaggcacatccgttctgtattttttttccccaaggaaacaaagaaaataagtgaaactgcattatgaaggtggtaagtttaccgaagagctctcggcaagcaggaaaagctttataagagttgaatgtatgactagcaagattttgctgaaaggaccctgatatagctgtctcttgtgagattacgccggggcctagcaaacacataagtggatgttcacagtcagctattggatggatcacagggcccccaatggaggagctagagaaagtacccaaggagctaaaggggtctgcaaccctataggtggaacaacattatgaactaaccagtaccccggagctcttgactctagctgcatatgtatcaaaagatggcctagttggccatcactggaaagagaggcccattggacttgcaaactttatatgccccagtacaggggaatgccagggccaaaaagtgggagtgggtgggtaggggagttggggggagggtatgggggacttttgggatagcattggaaatgtaaatgaggaaaatacctaattagaaaaaagagttaagtgtatgattaataaaaagagtaaatattcatgacattaaaaaaaaaaagagttaggtgtagtggcttctacctgtaattccagcactctgcaactgaggcaggaagatgttgtgaggttgaggacagtctaggctacatagtgaattcagtgtcagcctgaataatataacaaaaccctgtcttcataaagaaagaaatagtacctttgtagctttctcttcctctcttcttacattgtatagtgcctgtttgacagcatcatatagatttcctctagttttactgaaagggtaggcttcttttagcaggggagagaaagacagagaaggatgaccctactgcttttgtctccaagtgttgggattacaggcatgtgtcatcatcacatctagctggaagttatgaagaactatctctaatttatttctaaatacagttgagtagttagatatatttgtaggtattaaaaaggtggtgaagataaacaaatcttgtacggtgtgtgctaccaatgagcagagggctaggtaccatggggtatagcatttcaaaaaagcatccacacttagagcatcccagagcttcctcagcctcaagatttgattgagctaattgttgttagatagacagggtttctcacaggagtatactgagctatagaacatctgagctggccttctagtttagccttcatgttttagatgagcacactgaatcccacaataagggagaaatttcttgagttaagaatagggccagggcatcttgcctgataccagtatttagagaggatgtttagtgttttctgactcagctgagggtgacttgaccatcctgttagtgactgtacagcaatccccagggagtttgaaagatggagatggttcaaatcttggatgtttctttggaagtctgtagtgcttcctagatgtttttcttgactgtggaaggtggtagagcacagatggttgaagggacatagggagaggatgtttggccattttacttcttgagactaggccttactgtcctaagagtcatacttctctttgcaacaggatttctagcccaggttgaacttgagctagttatgtagctaaggatgaccttgattatcctcatgctttcatgtgcccttcaactgagggaattacaggtgatcactgccatgacagttttctgaatccttcaaagttatttatttgggtactatacatctttgtatgtacatgtgtttgtgtgcatccatccacatgtggcattggctatggcatatatggaagacagaggataacttgcaagagtcagttctctccttctatcatgttgaactcatgtccatcaggcatagtagccagttcctttacctgctgagacatctccatgtccttggtttttgctttgaaatagatctcatgtagctcaggttggccttgaacttgctaggttctacctctttctcctaagtgttgggaatacagacttgacctccatgcctatcaaggtctgacctctttgaattcaagcttgacttgtctggtgtgttagaacactatggtaggacactatggatagaagaacacttgtctttctaatttaatgatagtatttggtgctgtagtaaccattttaatataatcctgagtcaactgatctcgaccctcaactttaggtactttgctagtgggtcaagtcttgggttgctagtggggggatggagagttttcaggcttacatagaaagggtatagtattaaaagatacagaccacagaattagactacttggattcacattctaagcactcacctatgtgaccaatgagttgttcctaacatgtacaagcccctgggttgaatctccagaactaaaagtaaaaggagctaagtaacttacccaaggtataactcactactcacatagctgcaatttgaatccaaactgtctggttctagagtctatgaatatcccctctccagcccccttctccttatcccctttctccagtcccttacatctgttttgttgttatttgtttggttttttgtttggttttgttttgttttttgacaatcttcttttgtagaataagctggccttgaacttgcaatcatccttctgcccctgcttcctgagtgctaccatccatgcctggatttgtgtgtgtgtgtgtgtgtgtgtgtgtgtgtgtgtgtgtgtgtgtgtaaatggagtcatattaggtggctcaagcttgtctctgaactctggtctcaagtggtccccttctgttttggccttctgaatagctaggaccataggtatggaacaaatattcctcagtaggttacttctgagccttcttttcctcaactgtaatttaaagataataactgcttcctagggttgtgccaattaagtgagatgatttacagaaggtgcttataactgtgtctaacaattaatagtctcatataaatgtaaccaccaattattattaatatgttcaacaatctattaagagctcgattttcataatttattgattgttactattactgtaaagaatgtaaatacaatgagtagagaatataattcatgactttaaaattttcccatttaattgaagatttagggctaactcattcttagaaaaaatttgataaaaatgtattgtattttctatagattttaataaggagtttactggtacattaatgggatcttaaagaggtacatacttggggccagtggccattctggcgggggggaattataggatttttatataatggtttaaactaggtagctgtaggccagtgtcccttttaaattgttcttgctttattggtaaaccttctgaaaggtctgtgaatgatactgtatgtaccttaaggttttttgaaaccaggagaattctagtaaaatcttatttttcttgctgaagtaggattctaaatggctccagtagatggttctgtgggtgaagtgaggacctgggtttggcatcccagaacccatgttaaagatacatctgcagttcctgagttcctactgctagatgggaggcagagacaggagaattctggaagcatatgggccacatgacctggaatgaagtaggagaaataagagagatactctccttcataagaggaagtctaggactgataattaaggtcatcctctggttctctacatgcattttgtggcatgtacctatacgcacacgtgatggaaaatggttccttccttcatgtatctttttgaactaaattaagaaatagaactcagtgaagactttctattctgtctattcttgtccattggctgtgctgtggtttggtggaaaaaaaatggaggacggtttctcagagactgcttgtaattgagatggaggagtatgatgctttccaaatgtagcctccctgcagaatgggcaccttgaactgggagacagatattttggtgtaagttttcaagtacagctctttgggtatgcctgacagtggaaatagcagatctaagactgttttcaaatttactttttgcctgtgaaattttgatagaacgtgtgtgtgattatgatactaattgatacaaattatgggaatcactgaggtttgaacatttggtgatacagggcaaagtagagtcccgaacaattatgtcttggttacatatttaggagataataggggccaacacctgtgagagggagtacagcatatgtatggggcatggaacattttattccctttagttctggttgcccttagaaatataggatgggtaatatagcctcattattattatttttctgagacaaggtattagcatatgaccaaggtgacttgaaactcagagatccaccttcctctgcctccttattaagggcatattccacggagcctggaaaagccacactatttttaagatagctgaagtagtttctgattttaccattttgctcttgtctgctccaatccccgggtccagtctttttttttttttttttctcaaaaatctcaggctgggtatttgattaagtacaccaaaaggctctttcttccttgatatactgtttaattaatctgtggtatagggttggaggtatcaagggaacatccagtatgattgccattaattactatacacaagtccttgctatcttcaagggtttaaagtaagctaaactctgtgtctcaaccatcattgtcggtaatggagactgacaagcctataaatgttattttactaaaaccaaaagttatatggccttttcccccttgaatttgctttttttccctccagcatgaaaatatcagcaacatcagaaataataaaaggagaacttccccagattctttatttcccttggtccctggggcatggtgaatctagaatacacttggcaagaatattggctattttgcttcggggttactttatttctctcttatgtgctcggagagctgctcatgaagtgcctgagctgggtctgggaacaatttagcctatttgcctttctgcaataacctaggcattttcctatgattgggagcttgcctctggccaaaggccagttgccagaggaaaccagtgactaaaggcttcctccctgtgatgtcaccttctggaaccattccttatgattcccctcaagtcgagtgaccttatttggctattttcacccccctcaaatactcacctctcctcaaccaatttcctgttcttcataacagggaccaccttcttcaaggtttagctgtgctacctgtaaacttttctccttagggccctgagaggaggaggaggaggaaggggggaggaggaggaggggggggaggaggaggggggagaaggaggggggaggaggaaggaggaggagtggggaggaatgggaagtgagaaggatgagacagggttggggaggagggagggcacaggctctggaatgactgtgatttctccaccctgctttcttatcttttctttcccacttgtccctgcatagttacctgtctttagttttttaccaagctctctgacagcttaagtgttgtcttgcttggcctgaaaaggcataggaggtggggtagggctagtgctctcagcatctgaaagtattttttggagtaggtaaagccttccaagtagaaaggccaagtcttggcatgtccttgttctatgcctaggtgttactaggctttctcagattaggtttgaagaacagagattttgatgcatacagcttcaggcacttgtctcattcattattttttttcctgctttaaaatttttgttttcagatttatttattttattttatgtgttttgcccgcctgtatgtctgggcaacgcttgtatgcctggtgcctgaggggatcagaagagggcatcagatcccctggaattggagttaaggatggttgtaagctgtcatgtgtatgctggacactgaacctgggtcctctaccacaacagcaaatgattgtggagtcatttctctaggcccccccaccccgaagtagaagaagcagtaggctgaatcagggtacctggttttagcctctgtctgggtgaccctgaacaaataattttcacaccttaatttctttacatgtgaaatagatattctgataatgtgtttactcttgtagactaggaagatagttgtgtaacaacagagaacagtaagtgtttgaagttgtcctgtctcctttaaaataacattgacaatgttttctttcctagatatcagtatggaaacagactatatccaagagtcctactgtggggacaatgacttggggaaacagctatttacagtgaaccttgggcaaagcatttcactccactctgaagactagagttgctgactatttttggttattgttgactccagagagaatagaagacccttggaatagccatacttttatctggaaaggggatgaccaagaaacaaaaccaaactgattgcagagatcttatttcccccctcttcatataacagcctttttggggctatgggattacttttattttgagtcttaaattactaaggttttctcttgtctgagtcactgttgtctctgctgcccgtatagagggaaagctatatgtgtggcatcgggtggaacagaggaataatttctagccagggagtttattaccacataatctctatttccatgcttagtgttgggctttcatctgattctgcattatatgaatattgtgttagacctgtagatcaagggtgatgaaattataaacttgttatgaaggtatgttacagtgatacagcataagaacggatatgcttttacttcctccctatcctctctgtctttggtctaggacttgcttatcaatcccactctgtatcccagccttttaaaaagtggccctgaacttgaacttcctggactctgaagtattgatattttcttccttttagaacaattagctaaggcagctaacctaaagatgtcttagttgtatgaagcttgataatattgtttgggacatgtttctttcccagaatcgtgctggaatgtttctgggtcataaaggcagcgtctcctttttttcatggcccccacatggtatctactaattgaagtggtaagtcaaaatggcttttggtaagagagtgtaggcaacaaggtcagtgaaggaaagtaatgtacaattaaacagaaagagaatggggctttatttttgtatttcctctttttttgtaaaatgccccatggcgtatgaggatggttagcacacacagagaacaatctttcaaaaacttactactttaacatattagttcttatttatatttcttgttaggtgttacatttgtaccttagtttttctatggcacagtgatttgtacatacctacttccttataccctagcaaatccattactaaaaaagatgactggataaatgtacatttgagattatttttctcaatattgctgctattccaagctggcttggaacttactgtttagtccacattggcctttaacttggggaaattgtcatatctcaggccctgggaatattccccaatcacttggtgggggggtgcaggccttaggattgagtgcaaggtcattctaaagtgagttgtatgcctgcctaaggtacgtgatacctgacctttaaaaaaaaaaagaatattttaatggccttataaaattccatcaaatgacaatgttttatagacatattgagcttccagactttttattatttagtaaacttgtggattttataacttctagttccccttacctcaagaagtgactatctttagatggccattgttacagacatacaaaatttctttcttgttttatgtgtatttgatataggatctcttatagtcagtccattatatccttaagttcagtatgtagccaaggatccaaggatgaccttgaactcctcattctactgcctccatctaccaagtgcaggattacatgtctgtaccaccttatccataagtctttctgcccaactagttttgagataggatgccactctgtagctcatcatggcctgatacacagtgtagtgtaggttgaccattttattgccttagattcttgagtaataggattccaagtatgtgttatcatacttagcatgggcaaactttttgaagggtatttaattagcaatagacagagtaggagaagcagcaacagtatatgtaaaggatcctgcatgagacatcggaggcactgataataggtaaaagacatggtgagtgtgtgtgtgtgtgtgtgtgtgtgtgtgtgtgtttatatgtgtgtttatgtgtgtggtgtattataatgaaaaacggcccaagccagtgcatagaaacccaagtttttctggtcttgatttataggagcttgttgagtgtaccaccacaccatggtttttgtttgtttgtttgagacaagatttcagtctataacccaggatagtgtggaactcattaggtgaaaaaggagattggcctcatagaagttatcatgttgcctcagcctcccaagtactgggattgtaaatataataccatgttgaattactaaacagcctcttaaaagttctttcacgtatgcatatcccatcatatccctttcagaatgcagagatggtgtggttcctgaggccctcacaggaaccttatagcctagttctttttagaaggaagtatatagagcctggttccaactggcccagcatggccctgctcaagaatagttacaagtagctggggtgggaggtggtcccttcttggctctttagctttaagtgagtggtgctacagaagaggggtacctgaccctcttttagataaatgtagatgtattaatagaaactgcagtaaaaccaggactttcaggtctactggcttcaaatattctatgtattgttagaacacttttatgtctgtcactgattatacagttttcagaggcctgctcatcccatctgttttgggcaaacagcttatgagggaaccatcaaagttcaaaggcattgaggatagatactcttttcttttgtttttttcctttttttttaatagggtgtcatgaatcttagcctgacccatgactctatatgtaccaaggattcaagtcaaccataaggttgtccgtgtcctagcctatatgtagccaaggatttaagcccatcttagcctgtatcttagcctatatattagccaaggattcacgccaaccttagtttgtttcttagccaaggattcaagctaacccagaattcctgatcttcctacctctatcacacaagttttggaatggcagacacatgccaccatgtctggtgtatgcagtgctgggcattgcacctaaggcttttcgcatgctaggcaagtattctaccaattgagccacatccctatccctgtgtagatattcttgatgtagtatgctatttgtattcagcatatactataccatactacacataactttttgctgctgttttggttgtttgcaaaattgtaatctatactagggctttgtgtcctataaagaaacgtttaaactttattttaatctgtagataatatcttggtcaactgtaaagcacaactgtaagggtcttgttcaaagtcttgtagtagatctggggatataactccgtagagtgttgggtttaatcaatagaactctgggtttgatccctagcactgcataaaccatgtgtggtgatacacacacacacacacacacacacacacacacacacactgctagcatgaagatggaaggagcaggaggctcagaagtttaggtcattctcagacacacacacacacacacacacacacacaggcacatacaccggcagacagtcaggcacacacacacactgctagcatgaagacacacaggcacatataccagcagacagtcaggcacacacatacacactgctagcatgaaggtggtagaaacaggagactcagaagtttaggtcattctcagatacacacacacacacacagaggcacacacacacacacacacacacacacacacacagaccaatttgggacatgtgaaaccctgtcacaaagcatatcaaagaaaagtcagaaaagctgcttttgaagttgagaccactttcgggattatgttcttcatattgtattagccagacccacccaccccagtggttctcaacttttctaatgccatgactctgttcctcatattgtggtgaccccaactataaaattagtttttttctacttcgtaactataattttgctacttttatgaattgtaacgtatgttacactatctaatatgccacccaaaggggtcaagacccacaggtaaagaaccactgtactagagtacaagctgaatctactactgtgtcaagaaatagatgttgaatagatacattttgtattcattaaatagatctgccagcaagctgaacaactccatagtctcctggaaagcacctaaggtggatttatttggatcctggcaggttggagtataatggtgccaggaaatggaaaggcattgtttttcttgtgtaccttatagtgtccatttatctgtgagtgttcagcctgatcacagtcaatttctacctcccttttccatgtcttcacacagtagttttcatgccaagggggagtattgaaatcaaagcctttagtggcttctaataggcagctgtgtgagcatttcaatctgcctttgtggagcagcccagaatttggctttagagtacatatttgaggcattacctagtgtattttttttttttttttggtatgtgtagtgctcattatggcactgccagtaggcaggactgaattatgtaatcaaatctggagaggtttgggtagagcccagcatagatggatgggataacaaggaaaccctggagatcatattgttggagtacccaacagttattgctgctatagccacacactccatggctgcctgagagcccagagctgcatatctttgcagatctggacaaattgtagtcaaagcagcattctttttaaaaaatgggaaatggagaggattttcttccattcacttctgagatagagatgtggtttgcattggaagacacagtattaagcttagtaggtaaggttgtatgtcataaaatagagcctaggaaggttaccatgtttttttttttctgttctgttttgtttttgagacaagatctcactatgcagagttgggtggcaggggatttggaacgcagaccagtctggctttgaactcaaagagatttgtctgcctctgtttcccaaatgctgggattaatggtgtgtgtgatcacacccaacagttaccttgttattaaaggacatttggtgttaaaggatttttttccatttgttttaaagtgctgagctagacattgtgccaagaatgttaatagacatagaatgtaggatagatttaaatccagattgttttcatttgacagttttggactttatcttttggcagtacaaggaattcaacctagggccttgactgtgccaggcaagcactctatttctaaaccacattcccagtactcattctactttttatttatattttatcatgtactgtttttgagatagttcatggagctcaggcttgccttaaactttctgtataagttgaggataaccttgaatttaagatctttttgcttctgcttcctgacttctggtattacaggtgtgtactattgtgccttataaattggttttggaagatctctttaaattaaacttcaactctctcagtaggtcaagtaggccttgaccttgaaactctgctgccttagcccacccacagagtagctaggattataggcaaataggcccagatgtggacttgtatagctggaatttgctgctttgtaggttcttctttcttccacatttatctacccttttcctaccctttcaaccacctaatactatatatgagagaaaaaatgttagaaaggaaagggggtgacattatcattaggctacttctaactggttaggagcatcaggttcctttggggcaagtttgatctttgccattaggatatctaatatgtctttttgttctttcttctttgtgcatgactacttaacaaactgcaactaaacaccaaacaccaacctactctgcctctcagggccctagcgtttacataccctctgaaaagtccctggaattcacaatcacagacactgtttgcaactggcaaaatcacaaccctgcaagagcacaaggaaaatcacagtgagcttcggtagacaatctgaagcagccccatgtcccacacatgggattaagatgaaaacataaaatatttctgtgttttccaaagaaaccaaaactccaacattgttactacagagttgcttgtttgtccttttgtccttttgtccttccttccttccttccttccttccttccttccttccttccttccttccttttttctctccttccttttttgattttttgagatagggtccctcgatgtagccctgcctatcctgaaattttcaatgtagaccaagctagtctcagacatacagagagatatatgtgcccctgactcccaagtgctgggattagagatgtgtgccattgttttcattatgaaatgaatacattatttgatttgatgaaaaacatgaacaaaccgcaaacaacatagggctagggatggtgatgtacatctgtaattccagcaatgaagaggcagagagagacagaaggattataaatttgagaacaatacaattctcgtttacacagtgaattctaggacagctagggctacttagtgagactctctgtcttagttaggattttattactatagtgagacaacatgatcatggcaggcaacacttaggaaggaaattagcttacggttcataggtttagtccttatcatcatgtagtatgaaggcagacattgtgcttgagaaggagctgagagttctacatctggatcctcatgcagtaggaagagagtgacactgggcttggcttgagcatctgaaacctcaaagcctgaacccatagtgacacacttcctttaaaaaggccacacctgccccaccaaggccacacctaacagtgccactccctatgaacatatgggaccattttctttcaaaccaccacatcctctaaattaaacaaacaaatgacaagaaatgagacaaaactgaaaaataggaagtctctcttgtgcctgactactcttctgaggagaccacttttaactaatgtgaatgtagactagccctttcctttttactttttcctctctccctccctccctccctctctccctccctcccttcctttctccctcccttcctccctccttcttcttcctcctccttttctttctctcttccctcctttcttccttccttccttccttcctttcttccttccttccttccttccttccttccttccttccttccttccttcctttctttctttctttctttctttctttctttctttctttcttgacaacgttttgtacatgaagccaagattatccttgactttttttcatcctcctgccttagcttctacttacagaattacaggtgtgtgctaccacatcctgctaatgtatagactattttaaatacatttgcacacaggaatctttaagcatgcatgttgcactaatctgcattgttcttcaattggctttgtttccatgtagctaaaggaaacatttcttaggtttagggtagttatcttaaatcacatgttaaattctgaatgggtataaataagcaaatgagtaaataggtagaactctgtacatataaaaagtccatatatttctcttttctttttaaaatatttaatctaaaaaatatgtgtctttttgtgggtatgtgcatgtgaatgcaaatgatcttgtggtccagaagaggccattggagctggagtcacaggtggttatgagctatccagaacttctgccgataagccaactcaggtcctttggaacagtagtacatgcttttaactgcttagctatctccatcccctgccctctttttttctccctgtgtcaaggtctcatgtactccaggtttagcctcttttgtgctatgtaggtgaggatgaccttgaatttagtagctgtttatcttcacctcctccgtgctggcattttaagcttgagttactatgttgtgcatagcccatacactttatcaaatgggaaataaaaagtacatcatgggcatttgcttgcctaggagaaaaggtgtactgatacgggagttttggacctttctactgcaagaaaggatgttgagagttgcttctctttctatgctcatccttggaagagaaattgctatgatttcatgtgtgtttcaaatgatctttgtagagttcatattggtaaggcagcttgcatacctatgcatataatggtctcatcaatgttttgtgactttccagtttggaatagtttgtttctaagcagcacttaaatgaaaggcctgattatctgaagaatgctggaagatgaagctgtgtgagatgaaagaaacaaagctgtgagtgcatccatatgtgcattggtgggcagttgcctttgcagtttctgcaaagaagaccagtgtgaaggcctgtcaacagtgaagcaaagttaaatctcctctcttttctccttttaacatgcatactatgtccataagaatggctctgcagagtgttcacatgtgcttgagtcacccagttgagggaaatggtgacttatgaaatacaaatgtataaataaacacaaacaaacaagtaaacaataagtaaatctagcctatttattgctgctcctagtcttagaaacgtactgagtatattgatcatctgaagatgccaaaccaagagaggaaaagcagaagtaccagaaatgctggtttccttcttcccatttgtggcaagctccacctcactcttgtgtattcatttgtcagacttccatagtgtatagagtagagcttctgcttgctctccttttaatcaagcagcctctatgaccagaggctgaccttggctgtgctgggccactgtaggtatttttgctttccccttatagacaaacagagtagcctacagactgagtattggaactttctgacttgttgtgaagcacagaaagcaaatatctgagatcacttcccagaaaggaaaaggaaagaaaggaaagacatttttctttttacctctcctttgcctgcctgcctgcctgccttcctccctccctccctccctccctccctccctccctctttccctccttcccttcctttctttctgagacggttttagtaagtagctgtggctggcctagaactcaccgacttcaaagtgctaattacatgtggtgtgccaccaagcccagaaagaaaaaatggcttgggatttatgggtgtgtgtgactaagctataaactgtgctagggattaaatctgtgtctttgtggataccaggtaagagagctctctctacttccgagctaaaccctatgtgggagtctgtgtggtttgttatttagcttcataagaatttcatccaaggtaatccctggcatttattgtgggtcagccttgtgggaaggtcagtacttccatagtgtctttataaccttagggtagttctttaacttggttcagctttatattctcctgttagtaaagtaaggatggtcatgctagcctcagagttaatgagcaagttggataaggtcaaattggaaagctctcaactgttagctctgtagaaaatcaagcatataggattcgagtgctcagagaagtttaaatcatgttttaatggcctctgttgacaaaggcagtagagcatgtcagatgaaaacgttcagctcatcattagggatggttattatatttaaaagggtaagcttcagttatcagaaaaaagttcactttggatcagcttattcatagaccatttgggatcaatgaggcattgctgtataatcagctttgatctctctaccacatgtcctaaggcatgtgaccatagggcatgtaaattctgttggttctttcaaaggatagtacaaaaatatgtcattagttgagtaaataatgctcttgaagattttgttagattgctgttgctaccataaccccttgtgtgtgtgcatgtgtgtttatctttaaaatgggttttgtatatccctagctgccttgaaattcactatttaggccaggctgatctccatcttctggcaatcctcccacctgagtcttccaagtactaggattattgacccatcttaaattgatgtgaataactgatcttaatcacaaaggaaatggccaacttcaccatctagaacaaggattatgataggcttttcctttgtagatcatttgtaacctccttgacttgtccctctaggtcttgttggcaaagttatgaggtagaaattagaagggtagaaacctagacctgagtacgtcctgcatgggctgtgttccagggaaggtttgaatgtttcttccctatactttactgggatttaacctttggtacaaagagccaagctcacaaaatctttaaaaccattaagactttcatagcaagatcttttagctgttgagcagctcagaaaggaaaacactaagattaggaagctgaagtgaagttctacttcaaggaggcaactcctacttaaaatagtagttccctttttaaaatggccaagtctgatatgaattagatacctcttttcaggttttctggtcttgctctattaatgttgtcaagtgcccctaactttattgctttcttatcctatgtctgttttctgtgttgtgttattttttgtttttgttttgagatagatagcctagtgctgaaattatcagcttaagctaaaacctggttaatacggtgttggggagtgaagtagccccaggacttcatgggtggtattcaaacattctaccaattgagagatacatccatccctagccttctcactggtggtctagacaagacaacaccagcacaaatggtagtaattctcttcatttgtggtatgctttgtagttgtgaaaccccacctctacccccttactgttcttaatatatacttactaactttttctggttagcaagttaggagttatctcttcatatagggaaatcaaggctcagagtgagtaaagagctgtaagcttatctaatccctcatggggacaggttgcaaaagagaggaagaagatgagtctcggactctgcaggatttgatgtgggaaagggagacaaacattgcttcatagagacctagactttctctctagtcatggctaggccagcgttctgagatttgcaaggaagaatcccttttgaatatttggccctttccccattccagtcgtggctaatctcccccagtctcttaaattttgaatcagaagtgaagtttaaaaagatgaagtttagagaaattcttgccgttaagggcttgtggggttggccagctgctccattgttttctttttcttagggcctggcagttgtcttcccatgtcacccatccagttgctagtgtcagaccattgctctcaaggctaattgccctttccatctggctgtgccagtaacttatttggctttgttatgcacacagttgcttggtatcaagtgagaattgcttggcatttgcttagacctaaccaatatagggtcttataccttactaggaatgtgaacatggattttagtttcctgtcttttagttttctttctttcttttttattttgagacagaatttaatgtagctcagtctggccatgaactcacccaccatatagctaaggatgaccttggactcttggtcctctcgcttctgcttcagttttccaactggcatgggctaacacaaccaggttcttttcacatttttgatctactagttagttctctgaattctttgtaaaagatggtacgtatatgttagtgaaaatatattgtaaaattttccttctggactcaatgaaagatttcaaaagagagagaacttagtgcaagcaaagtagctttgtcatggagtgcttgcctaacacgtgcatgtgtatggatccgaactgctgaagaaatgaaaggagtggaagttttgggtttgttagtatctgtcagaaatctcaaccttaagaaactttccccaatgcttcatttgagggaaagaataagcttgtcttcccagggtcatgaggaaaaggttaatgtggaaaaatatgaacatactttagggtttcttttctctaaacagcttccaagggagctacactcctgtcttagttagggttttactgctgtgaacagacactatgaccaaggcaactcttataaggaccacatttaattagggctggcttacaggatcagaggttcagtccattatcatcaaagtgggagcatggctgcattcaggcagacatggtgtaggaggagctgagagttctatgtcttcatctgaaggtggctagtggaagactggcttccaggcagctaggatgaggttcttaaagcccgggcccacagtgacacacctattccaacaaggcccacacctccaaatagtgccactccctggaccaagcatattcaaaccataattcctcttgctcaaaacaggagcatttctgtgaggtcaaggctgttctggactacatagtgagcagcaggccatccaggactatgtacaaacaatgcaaaacaaaacaaaaataattcaaccaacacccctaccaatggtgatggtgatctaaactcatgaccttagtggctaagaaggtagctggagattacttgttagagcacctcttcttacagtggaatctgagctttgggtggaagaagctagacttgtcttctgaccttgtgctcaagaaactcaatttacctgtgcagtacatattggcgtatttataggcattcatataggctctaggtggtatgggttaagactaggcatagggatttctaactaactgcctaagggatcccaatgttgggtaaaagttaaggtaactgtacctctaataagagcttctctttgttacaaattcttgcaagaaaaataaaccgaggaaggagagttctatcccagtggacatacagcaagaatacagttaagatgaactaaaaatttactctgggttcttcatactatggtacctggaggtggaaatggccctgatagctcaattgggaattccctaaacttggtcatggttagaggaaatgggaattgtagccctcagcccaaaaatgctggggaaggtgtggggttcaaagtaactaagtagccccaagggaaatgagtagctctctttgtagggtgagttcattgtctgggcatgttgcagaattgggctggggtgggggtgggaatagcacagaatgggaggtgagtaatgctgtgggcaccaaggcattcagtaagtaggaacataacacaacaggcagttggtgagtaagagcccaaggacttggtgacttcactcttcagctctatatggaaatgctgggatggtgctctgtcttgtgtccaagacagggcacttgggaattgaacactgtttgtgttctacttcctatttaacccagtagcctttattcctcattagggagtagggccacccatagatccgcctctgctaggtcccagtccctgctgctacagcacattcaaagagcatcaaacccttgcacatattctggtaccattccatagtgttgtctgtgattgtttcctcactgctccacgtgagtgaccctgattaaagaataagcttgtcttcccagggtcatgagaagatggttaatgtggaaaaaaatcaaggatactttagggtttcttttctctaaacagcttccaagggagctcctcttccctgtatccctttctcctcctcttactttcttcacacaaataccattatgtagttaacctagtcttgaactcccattgtaatttctctgacttctgaatgctaggattacagacctgtgataccatgcttgtccccacccccctctcttacccatagaaggaaagttgtgaagaaccacagtgagacacataatatgggcatgtctcagtgatgagtttcttctctctagtcctgtgagggaaattcctaaccagatcatgagtatcctacgcctagtcacaggagggaaacttgtcggagctggttctcgccttctactacgtgggttcaatcctggagattgaactaagattgccgggcatagttgtcgctacctcttgcatgctgaactatctcactagcccaccaataaattaaaaaaaatatgttcactatccttagctatcaatgaaatgcaaatttaaattatttagagattcaactttaccacagtcagaatggttattttatataaaaatgtcaaatgacaaataagtggtggtcaagatgtgggtaaagtggaacccttattcttttattgttgggagtgtaaactggtaccgtaactatggaaatcagtgtggcagtttctcataaaactaaaaatagaactgccatatgactaagcaatattacccaaatcacttttaagtactaccacagagatactttccatccattataaggatttgttttaatcctttgacattttagtacatttatacagtgtccatctttcatatccactcaccactttccctgcttcacatctgtgagtttgtgtgcacaccagccataccattctagaagtcagcattttacagctcttcccctcaaccatcagttcctacgttctgtttacctccactttcagcaatgttttctgagacttgaattggaggagactgataatgataattaatacctaactgagcactcagagatccttgttttggccacttggaccagtctctgcatgttaccatgcatgaccatttagcaaaacaccatttagtaggttctcctttcgggcctacgatctcaggcatggacttttgaccaggttacagtaccagacatggaacccttgctgtggaggaggcctcatctaatcaggaagcagttggttatccctataagtgtcatgctactatttttataattgggcacatctggccagcatgtcaatactcttaacatatgggagtctagtactgggcaagaccattatttttgatgcttgttttttgtttttggttttcttttgagacagagccctggctatcctggaattcactatgtagaccaggctgaccttgaactcacagaaataatccaacatctgccttcctagtgctgggattaatggcttgcagcaccatgcatggcagaagacaattgttttagatccatatttattgctatgccattcatgatagccaagaaagaatcagttgaatggaaaaagtaaatagtatatataaaaaaattttattcagctgtaagaaaaaaaaagaaatcatgaaataatgcaggaaaatgggtagaactggaaatcctactaagcagagtactcatacttacatgttttctctcatgtgaatcctgggttttaagtcatacatacatgtatatgagcaagtgcagatatatagagcgactttagcggatgggcagaaggggaaaaggataatagaacacatgtaacatgaaagcagaagggagttagtggagcagggttcagcaggagcaggacaggttaggggagtaaggaggaatttagtgaggggcaaaagcagtgtggatacaaatgccatagtgaaacatcacttcgtatggtaattaaaaaataataagaaggaattgtcagcaggagggatgatggttcagtggttataacacttgttgcattttcagaagacttgagttctattctcaacactcacactaggctgctcacaactggctgtagttccagttttaggggatctaagactatacccatggcacctgctttcatatacacattcccacatacagacatatacacctacacatgattagaaataaatctttttttaaggtattgttaagaaaaaacagagaggctgtatgtggcctaaagaaacagttgccaatcatcaatatagactgtgtcaattggattgccaatttattagatatccagtttttttcccctgggaaaagttctccctgtgttgctcaggctggttgctcctgctacctcagcagctaagatggtaggattatatgccatgctcagccttatagctatttcttagatattcagaaatcctttttcttgaaccagatacattctaggtcttttaattctgagttacaatttggctgcttgttgcaaattagaaaccatgttggttgccaactaactaaactactatgtctccttctggggtacagttggaggtcataattacctaagattagaattaaaattgaatctttggagtaggaaaaatcccctatagatgctcttccttcacctcactcttcctttgtatatacaccgttgctttccattacagatggcccgaaatctggtaagtaggcagctgctgttgatagatagtaattagagagatttgaaagcaaacacaaaaacgcaaagctgcattcagtgtagaattctaggattgcagccagctcgtcttgcttgtcctccatactccatccttggctcttgttgagtcacctaaaaatctaacctgtctttttgagaaggtacctccttgtgttgttgttgacagaaagaatcctgaatccttttggaggaagacagactgtggagttgtgaggttataccctggtgtgtctgtagtagtaggcctacatgtcaagggaggcattctcacttctttatagtccttttactcattgctctgttacccgttgtatggctctttgggtacatgcctgtttgagcagttataccatactttattttgggaattttgttgtagagtgagtatggttccaaggccatgtcactcagtcccctgtaaatgtgagaattgtagcaggagttgatttaggaatgccttctcttctcctggctgctttatctgccttttccagacagacctagaattataggtgctcacttagttttatgctattaattctaggagacaaaaccactggaatttctgccaatggttacctccagggcacaaatgaatgagcagttctcatccaggcttcttagtcttgtccttactctttttccaagtcttctacctctaccccagggacagagtagttgcaaggaatatgtaaagatccttctgctcttcaggactgacatgtgatttgtgagtagtgagtgagtgaggttgatgtaaatgattttctagtgacaatggcgatcacttcttcaagatcagggtttgggatctggtcagcattaaggtgatttgagggaagggaaagttgtagccatagataaatgaagtagacccatttgtagactaaccctcaacaattacttacagctgtaagtccttgggtgtagtacattaacctttgacacacactgttttccagttgcagattagtagggatcttcattgaaatttatgcgaaaagtacatgagtatgagagtatacatgactacatgcttaataatgtcatctttccctaaatatcatattttaccctctaaatatttaagataaaactgttttttttactattttatttatttgtgtgtaagagagaggaagagagagagagagagagagagagagagagagagagacagacagacagacagacagacagcgacagacagactgattcacatgctcatgatttggacctggagttatagatgtttgtgagtcatctgatgtgtactgggaactgaactcaggtctttctctggcagtgagtactcttaacccctgagccacctctccagcccctctgcctggaagttgtaggtgtgtccccctggagagcagtagttctgcttgattttctcttaatagatgaggaaactgacatttgagctagtgatgaccatgactgatctgttttgtaggagacacacctctctttaggtcctccactactactttttgggtagatgggtggacagattgagaatctgtgggtatttattgttttgtgaagaggaacctcatgtataaacttaaagtctcaggttgaaggagttgggggaaagaagtatgtgagatccaggctagaatgggtggttatggtatgagggagatagagaatgtgcataagagacgatgattagaggaacccttacacaagaggccaaaaatagtttgtgaaatcagtgaatccttgctcttctgaagaaggtcaggcagccttggctggggcccacacccaggtcctttctgtgtcggtagatttcatttccttttttctctgtgtggttgggggtgaattgggtgagggttgagcattttgtcatgattgcccctctcgatctatccataagaaaatagattctctgtaagaggtatattgtagtagctccttaactttgatgacttagttcctgtgagatctgtaggtgttaggctacactggtatcttagtaaagcagtagagcttcctctctgtcttgtacattcatccaatttgtcaggtttttctttactatttccttttctgcctgtgacacacctcgctcctacatctgataaattggcatagaaaaccaacatggtgagaaggtctaatttattctcttctgataaattctgccaaggtctgggagacgggatcggaggccttaacatttaacttgatgccctttgtaaggttttcatttattatatgtatctttgtgacatttggaagacatgaattgtttttctttgtcctggctcctcgttttggtttctgcataacattttaagtaccccacccccttcatttattttgtgtgatagctttatctttcatccttcagaactccttagctttttagaaatgtgcttagatgggtcagggagataaaggcgctggttgccaagcctcatgacttgattttgatccccagaacccacatggtagaaggagaaaactgactctcaaaggttgcccttgcatggtttggcagattcctgcacttgggtgcgcgcgcacacacacacacacacacacacacacacacacacacacacacacagagaaagagagacagaaagagagagacagagagagaaagagagaaagagacagagcgagagtgacagagagagagagacttatgtacacattgtaaaaagttatctgtctagatagtttccttatctagaaatctcccttgtattttcatcttgctctccattgtttggattctttttgttttctccattgcttttgattatttttacctctgcccttactacgtagaaggacagtttccccattcactaatctacatattatctccatccaacaaaaatttctttcagtaaggtgtggtgaaaagtaccttgtactttctgaacttgagcgttctgcaccctctatcatgcatgtgcatgcacatgcacatgtacatgcacatgttcacacacacacacacacacacacacacacacactattatgtgtggttcctttttaaaatgttcatagtagattgagaggtagccttagttgattatccaagtctgttagagttatagatagatgtatagagttgtatttgattgtatgccatgtctctttatggcctccagggacagacctgactagggcagccaggaaatgaagaaaagacaaatacgcagagatacagaaatagttggggtctgttggtttgggatctctgctggagaaatgacagcactctggaagctcagtgtatgtattatatagatttgaatagaaaggtggtattactgcatccagctgaagatggttgaggcagggttgttacatacacatgaacagggagtcagggtttatggcatacaactggatcaaggcttctggtttagctagtctcagcgggagcggcctctgtaggggagtgatcttcaggccatgaatgtggggttggcggtgctatggtggatgtttgttcaaactgtcaacacttgcactcagttccccagagagcaggttttgtacttttgctctgagcctcatcctgcagggaaggctttatcattcctgcacgagtctgagttggtgcccatgtcaacagcacactcaagacttcactcagtcagggcttcttctgcttcctaaaaattacacgatgatatttgttgcttaggccatttgagaaactgttggttatttctggagagtctggtggacctgttttctgtttggctctgaaaacactagatgaaagttaagatgatggagaagaatgttcttgttctacacggagaactaaatatatcaatatatttatattgtaaatttagctgagtgtgttttgtgcattcactttagtgcttcagtgtgaagatattgatatgtggtgggtggggtgctaaaaatgttgatattgttgcgtaggctgaaaagttttcactggcttcagtgaattggtggatgagcttgtaagtttagagggcataacaacaacacaattttagaaaggttatctcaagctatggattgaccaaaactagtaagttggatgttctgtattgtctaacaagcttccacccaccctttatgtttgacctaagtccttttccaaaagtaatcctggctttccaaggtagtatgacactctgctggaggatttttgagactcttccttttctccaggcctatgtgattaactttatgcagccaagagttgagctgagctgcaagatgaggtgtgggtacgagcaggttgtctgagagttaggaacaacctgtttaggcacgggaagctggaattcctcttagaagcccagtgaggctcctgttgcactgaagaatggtgcgttcagtcaggcatcactgaaggttgacatctgacttctgacttctgaccttggatcagctgggaggacctccctaaacatggaatgttcagccacattcttcactatatttataggctaggaagggaaaacagaggggagccagggaacgagctgattagcgagaagtgaagacattagcagtgagtagggctgtggcactccttcacaactctaaatttgtttggttgctgctcttacagattggaagtcattttcttttcctaagttgggtaatgccactctaggcccattaactcactgctgtcatagcagaaatgccagtgttggtatttaggattactgtatgagacttgtgtgacacttttgaaaacacaattttcctgtgtttttgtatcttctggttcactgatcaaggaaggacactggcattgtccttccactggcattgtcttacaatcttgaaatgtaaaagaagttggccttttaccccataaaataaatttatttatttatttatttatttatttattctggaagcaatgtgatctgtcatcctctgtctttaggtatgtatccttcactgtatcaggtgatctcaagattatctagtcactcttcctgtccgtccctctgtgaaactcggagatttacttcagattatttagcctgttgaggcagagaactctggctccctctccagtcaatcagatcctcctccaccgaggggaagtgtggtaatgacattatctttccctaggcagccacgtgttctctgagaacaggatgtggggagggctggggcccagtcacagggtgtaggggatggccctggaaagtgggctggcatgtagccacgaaggttgatgtgggcttccttggctttgagatactttgagattcattaaaagcccctatactcattcacaaatgttcactcatgtgtataccttactcctacctatgacatggctgcattcttaacccaagaaaaatatactggtgaaacacctgtgtatatgaggtcctgatgtttggcctgcagttcagtggatcggccaggtctgctaactgtactagcccattcctaattgttcctgtcaggctagcaaggtgaggttgaatagcttagccctagtagacattggggatgcctccctgctctttctcatggccctagttcatttccgaccctcagatggctccttagtacattgggggtgatttgcatgtttagtttctttttaggcctcatcttccccctgcccccacagcttctgcttggtatgtctggagatgtactgctgagggtggggaaaagaggatgtagctagcttcctgttcaaaggagggtggggctgccgccttcctgcttgtctgcccgcccccctcccccagctgtcagtcacccggcacttaactgcctaaagggttcagctcggaatgacccgaggctgaaggaatatgcaggcatattaaaaaggggatttactcactttagctcctcttttcaatgaggatagatggaccctctgaaaacaccttcggaagccagctagtttgacccccgtatttcaggccgagagacaaagggtccagagaatactataaggaatttatggcagagctaagatgagtagaattctaggagaccagactggaactctccatttccccatgttattctagagggtttcaaactggccaagctgtctggtgagctatagcaccctatgtgagagcttatggctagaggccactagattacttggataaagttaaatgataactgtcaaaataacttgtaactaaaagaaattgcgaagagcaaataatagtcagtgtactggtagctttgaaaacccatactgtagttttacctctgaatttgcattagatgcttttttgtcctcctgagaaatgtatgtagcccaaactagtcttgaacagtctgctgtagtatggtgctgggatattacaattgtctccataaagcctaactaagcaaattgcttttccctcagtgaccctcccatttcttctttcatgaagagttgcatctctgctttacttttgatgtttgttctttgtcccttagttctcagagaatccaagaaggggaggttggtgtttaaggtctgctcattgccagaaaattcccctgagaatgagtaagtgtggaatgcttatgaggcagagaactcaggaagactcttgacagaggccttaaattagagcattttgatcaatatgttttggctgctgagttatctgtacctcccactgtctggttcttaactagatggaaagatggttgaatactctggacaatagctcaaaggtttggcacaattttctgtttaggctttcaaaatctcctcctcctgcctgtagcacctgttctgtcacatcttatcttcaaggtccctgaatgaagatttccgagccagaaaacatcttggacatctaggttactgatcctgtgctctgatgtcaccagcatctgtgccagagtatgtttctttaagctcaggtagtgagtatctcagggtatttgttgaaatacagattcccaagcctcttctctggagaatatattatagtaatcttgcgttggcaactaggaatctgggttgttgactaatgtcagaaatggtgtttgcaatcagttaagggcaccatctcatcagtaccaaacaacatgtttgctacactggcattgctatgctcactttattaagggcttttggctcattgttggtagagctagatcttgtattgatgtttttaggatattattccatgctctccctgctattgagatactactttagtttatgggtataggtagtggtgcttcttggtagggaagaataggcattattgtcatcatactttataaacaaggatactagaaaatagagggatgtagtggctatagaaagactatggcatccttgatctctgtggtggatgtgggttatatgtttaatcttggagagcttttcctaaaccacttgctcaatgtcttctagttaacctgtgctttctgtgtttccctcaatcagatagtttccaagccattttatcatcatgaggtttacaaactcggaagggccttgaaaagtagttcttactttctgatggccagtccccttctgacccaagaagccagaatctgtgtggatcggcaagggactcttctaaaaatttacctcaggtgatagattgtattgagtcattttgaggcctattgtatgatctttgtgataccagctgtgagaatttgggagtcttggtaagttttactgagtggtaagggttagtaataaaagactgcaggaaaaaatagtcaggcagagttcagaacaaggaaggaagacatgacagcctttgaagagaataaaacactgtaactgctctgctgtgttcactcatcctttatgattctgttttttttttttttttgaggaaaatttctcatctctcctaagagagagaacatttaaaaatgctgtgccaggctttgtggtgcatgtatgtaattccagcatcaggggtgtgaagggcaggaaaattaggagttaaagatcatctttaactactattaaacaactactttcataccgaagtagatagaagtcaaccttagcctagccctggggttgaaagcagttctttttgatgaggcctgtaagccttctcctggcccctgaatagtttactgatcctggctttagcagttttaacacccagacctcagctggtgcctggatcaactgcattgttcttcagagacagacatgacatcgaaggttgatgtgttgtgctcctaagcagggggaatagagccctcttctggtgccctgggcagagcctgcgtcttcaggctgccaaaaatgctctgtctccagtctacaaataacttcctgtggaacttgctggcaggagcctgggtcaagcaggaagctgactggagagagtgaagcccagctgggtgtggctccaaataacagtttctcacatttggatgcttattttattaatgatgggcttacttccttttcatttcagcaccttcaaagttttatgggaattgttattcttggctacctaggtatggacccattccttttattctttatgtctttgcttccatgttgttatgaaatattgtgtctccctagaatgggtggtagtggttatctcagcatgaaagttagatctatgccctgttgaaaactagacttccaaatagtgtcacttttgtgtttttaattgaaacctactggtacagccagcctccttcacatagtatctccagattcaaagtagcatgtataaagggtctactaactacttctactatctagggtggcatgagggcatagtaaatgtgctatggaatcaagagctagtttttaaaaactagatattatttgtggtgttggagcactgagccactctcatagcccaagcgcccaggttttaatccctgttctcaaacttcctagtagctgtgtgaccctgggacagtgcctctctttctcatccctcagttttcctatctgtgaactggtgaatttgagtcaaatgctcactgaggtcctttcaggtttaagggtttgggaattcacactgcttatcgtttctggataaccatattaaggacatcgtggggcaacctatgtgcctgaaggaagatccgacctggggttgggcattgtttgtttctagggtatgttttgactgataagctgcttttgacagtgagaccataattaattcaacacacacacacacacaaacacgagtagtttcttgctgataaggtggctgtatcctcattgctgagaaggttcagtacctcaaacatggtaactgaaagagtagcactcaagtctctagtgtactctgtcagttgaaatgcttcttggaatttttagagggcagggctgagccaaaacaaatgaaagagactcttgtctcctgtgtcttttcgagcagctggagtggctggagaactaatgttgagtcatgaaggtatgggtgtgggtcaggattgctgcggttttcttctgtagaaagtacagagaacagacacagacataggaaaagtgaagcccaggcaggtctggaaaggtctggaaatagaggtcaaaagggagggaaggggataatcatgccaggtgctgtttccaaatcattaaggacaaagacgaatgagttgtgggaaagttgatgtgtgtgtatatatgttgggggcaagaggccgggtgaaggggttctccacctccggggatagaagatcaaggcagtgcttgctttcttcttagggaaaagaagtgcttgaggcttctctgttcccctaagaatcaagatagtccaggccctgccgcaggaaatgctggctgaaggttatttgagtgactctggtgattactctctgcctgaggaagagattggagttctggggttgctctagtaaggcctgtacttcctcttgctcctctgctccaattataactgtcttcctcccattatcagccccctggaaagctcagaaagaaaggccactccctcagaattcagaaatggcaggtagtcagtaaggttgttgaggtcagacccaactgggcttccacaggttctgccccagggagacaagggaatcctatccaagcagtgtttcccagatgtacccaggcttcccatgctacagtgtgtgggctttggcaaaatagttaccaagacagtgtctgaagagagcagtgaaattaccatgactagagaggtgggtggagttatggaaggagctccaagaatgtccagaagacccgcctccaccaactgctagcagaggaaatttggcttaagtgactgagctgaggctgtgggtgactcggctggcaccgagttggcatacaataagtgttctgtcacctgtgcctatgtacttgagtgttttcacttatgaactgacaaaagttatgttcagttgttccagcaagttacttgtgattatttcttctccccatccccccccccagacaaaaagattttattgttaagaacacataacaggtgggggtgagttatggctagactactttgctgtggagtactcctgcttacctgggtgatcctggctctaaggaaagggagggcctctttgaagccactgggtcatagactaaagcactccagctactgctgccaagtccgagtcagcatctggcctggttatgtttcaggctatccaacttgaggtgtaagagtgatcccagttgaagcctttggatggtggaccaccaagaagagttaattgtcagagaggtttcctgtgggaagtatctatgtatgttcagtaagcatcagtggccagtgtacgtgcgaggatgacacgctcttgaaatgcatgcccatcatttttgttgtcatgttccttaaagccttctgttctacatagatatagtctttgacctcagtctatgtctgcatactcaggcccagcttaggcaaggatttagctgtgtaaacaattctctctgctgcaaattatgcttcaaattgctagtttactcagatcagctcctttatgccctgccagggaaagttatgctgaatttggaagcttcaatttcagggtttaaaaagaaatttctgtgtgtacttatgtgtgcacttaccatagtatacagaggtcagaggacatcttatggtagttggttctttcctctcaacattcagatttagggcttgcgctcaggttgtaaggcttagtggtgggttctctctggacacctttttttcaacctttccaaacaggacttcgttctcctttctccccatctctgtctctgtttctctctgtctctctgtctctctgtctctctgcccctccctccctccctccctccctccctccctccctccctccctccccccctcccccctccctccttccctcccttcctccaatgaaagagtgaggtcaatttcaaaaggaggaaagtggtacctagtagggtaaatgtccagagggcctcatgtgacatgggtctgggctatagcttgttttgtgtaatttgcaccccagattatcaaagaacaagccaacctttaatcagtactaactcctaccattcccatcaatttttaggctccatttattttactcaaatccccttgttttgttttgttttttctattttgagtccctttcccaaaatcaatcctgtccttagaggtctatggaaaaagcaccttaatatgattcttaatttgcacaaaagtttttttttttctgttctgcttttcagggacttccctgtgtattaccattacagttctttggtaattcagtaattgcctcaaggtcagaataattctacagttctcctacactcattattctttaaacaatgtgctccatctgtattaggtgaattgaaatacatttctagaaagttccttaaccagacatttttctatccatgaatagcatttgaaacaggaaagacctatgaatgtggatatagttggctttcaaccagctgtgggttgaaaatatttgggggaaaattgcatctatactgaacatgtgcagactttatcttattattccgcaaacaaaaaagaacagtggcttatttttataacattacattgtattaaaacatttgtttattttgtgagcaactaaacccttacatatgctaagccatggctgtaccacaaagctacattcccagcccttgtgtttggtattagaaattatttaggcatgatttagagaacacatgatgtaggctatatgcaaatattatgatatttttaagggacttgaacatttgtgggattttgtgcccatggaggtcctggaagcagtcctttatagatataatgggatggcagcatttgttttcactgagttacaactaaagatttagccttttaatcataaatataagcataaatttgtagtagcagcagtgcctatgatattgtcatcagcggaagtctgggacacttagttattatagatctctcaaatatcatttatactaaattgaaattacaatagtgtagtggctatgttgtatccagaaaaaaatatcactttcctctctcagggactattgacaattaatgcttattggaggagtgttgtcactttttaaagtgacattgccacagataagttgtccttgctgtgttgacaaacttccagtctatgcttgggcaaggaaatcaaattaaactcagtggagcagacagaaagaagaagacatagaaacaaggagagagacacattgtaaagagtgacaatgggagatggaggggatgcaggctgtgtaagatgactaaaattcattgtataaatgtatggatctgttgcaaaatcaaaagattttaaaaaaccacagtaataattattaagacccaatattaggtgattaacttaatatagtatataagtacacattattaaatttgacatctattctaaactaaacggtcttgttttatttgttttatgatgtaaaaatatcctgacaagtgttccattgactttgcgagattggcaagaatggtacctcccataaaaaggtgaaaaagtaaaatggccttttctctctctgtatgtactatcttcagtctgcctttgtctccacccctgtaccatactagataactgctcagttactgaagtacatccttatctctctagtcatctattttatagcttcttacttgatggctattcatgtagccagcattttccttatgtctacttagccttgtgttccagacacctaattctaaattagaaataaatattgatatgagaataaaccaatgtattagaaagaccactgtccccattccactttctctatattgttttttgttttttttttgtttgtttgcgattctttggtgggtatatgagagagagggggcaggcatatggaggtcaaaggacaatctacagaagctggctctcttcctccaccatgtgtgccttaaggattcaactcagatgatcagggtagtagaaagcaccatcttgatagccccaaagcatgaaattttatgtctatatcacaagccatcttttggctatattgttgagcaaaacagcaagtagtataaatttatctttgattttttttttggaaaaattatttatttattatatgtaagtacactggagctgtcttcagacactccagaagagggcgccagatattgttacggattgttatggtggttgtgagccaccatgtggttgctgggatttgaactcaggatctctggaagagcagtcagtgctcttaaacactgagccatctctccagccctttgatttttttttttaatgaaagccttccatattctgtaagagaaaattaacattggtttaaatagtaagatttgcacgtagacctgtattcaaactcccacatactagcattatgattatgtatctgtgatataatatatatgatatctattttctcaccctcaatgtagaaacaatcacagggtgattgttggtgttaagaggggtagtacataggaagtacattgtgacttgtatatctagatacatgaaagctgttgtttttactaaaaaaattccttcagaataaaatctcaattatcattgatgtatatcagggaatctacttctaaggttgtgactatattgtctagtgccaatgaagtcctacgtggttatctgttatacttttttactttaaaaaaagcttgtaaggatttatttaattcaacttccttccatgtggcagtattttgagaaagtgtgaccttctgtctctccatatcagtgactgcacacttgtctgcagttctagagttcttcccattcccttttatcttcaggccaaatatatgctggtgaatgatctaatggcttgtggttttcaatactcatatgatatatcaggaattgtgcgaggtaccaagactaccaaagacagcagaaaagaatatcatctttgctttctggcttgcatctactgagaagcaatagagtctgtgaggttgctttgggttgaacttttgtctcaatctgtagacagcataaatccaacttgctactagtgtatatctgggatgggaagagacagttcagacccttgaggaaaatgataggctgggttgtgctaaaatttagtgactaaactcttttcctctgagattatatgaaagctttgatttggttgctgggtggtggtggtggtgtgtctcgctgttcttctctaataaactattgccactcgatctttttctattttcatttaaaaatagaatatgttattattttttcacttaaagtatttttggattaaaatataattatatcatttcacccctcccttttccttcctgcctggtagttcgtcagtatgtgtctggatccctctttgtccttccattaacttggtttggacagcagctttatattgtacatattcacctctactgatgccccctttctctcctgcatgagacacaaatataggaagtgctagcagaccaaggcagtggatagaacaaccaacttcattattggaatgatccttagacattgctttgattagttgttcccgcaactcaacccatgtctgtctgcccttgtgttgatgagggaaactaaggcccaagaaaaggataagtgatattcaggttggtaaattgagcccattatagtggtgttaaccttgaacccaattttcttaaaattatttatgttcttacacaatttcaaatatatatgtatgtatagatattgtatatacatgtgcacacaacacaatttgatcatattcttcatgatgtcctttcttatcctcttttcaatagttttttgtaaatccgccgctgtatttaattactgttgttttcatgagcatgtgtgggagattacttacaaggacaacttaccagtggctacacaaaaatgacctctctcctgcaacaataaattggcttttgctccttaggataggatgaagtgtcattagcccttaccctatccatgttgatgtgccccatattgtgcagatcttttgaaaatacccaccattgctgtgagttcatggttgtaactgctgtgacataagcagaagactgttggcagccctcctctctgtcctccagcacttacagtctttctattccatcttctatagttttctctggaccttgggtaggagtgggtccatgaagattccttgtttaggaccaactactcaacaatcacttattctcagaactttgaccagttatgagtctgaattagctgaaagccattgcaaaaaaaacacatctttaagcttcagagcaaaactaatctgtggatattaatacatactaagaggccaatgtgactgcatttctattgagtcaaacaacagtagtcccactagggcatatgaccttccaagccatgggcttttgagcaggtttacagtactgggcatcaattccctcctggggagttgacctcaaattcaatcagaaatggttagttactcccatttaccatcatgcctttattgcagtggttctcaaccttcctaaggctacaaccttttactacagttttttatggtgtgaaccctagccgtaaaattattttctacttgataactgtaatttttctactgttatggattgcagtgtaaatctgtgtttttcaatggtcttagaaaacctctatgaaagggtaattcaactcccctaaaggggtcatgactcacaggatgagggcctgtgctctgttatatcaggagtacatttcacttagaaggttggtgttgtagcttggaaaatttatagtggagaatccagtgttctttattttaccttgcttctgcagagatctactcgtgccatagataagccaggctataggtctggggtaagaagagaatgctgtgggatggaactggctgttgttaaagggtgaataccttttggaagaaatatagtcaatacttcctatttgtagtaggatggtttacattctttgcctcttggtagaacattgtccatggctgtgttttagtcttcagcaatctgggtgtgaatatagttaagttatgacttaggtcagtattttacctttcttcataccaatttcttatttactcactttagtgtttgggtttcttccaagttgaatgtagacattttccccaaatctactgagcacgaagccaaacaattaatctgcttgcttttatctcattctagatcagtgtgcgtgtcaccaccatggatgcagagctggagtttgccattcagcccaacaccactggcaagcagctgtttgaccaggtaaaggaggaccttgttccttaactactttttctgttaataggtctcctcacaatgcaggccactcattccttctatgctttggaaaaggtctcttttccacttgcctatctgaggatggtgaacacaaaggctgactgcagacttaattaaaaaggaggcaaagtttaaatgttggcaacctgaaatctcaatcttattgccctaacacatcctatccttgatctcgaacaagggagaaaagagaccgggagcatgattgtatggtagatttactgaaactatcaatatatggagcctcaaactgtaaaggatgttgtttgtttgtttgtctgtttatctatgtatagacaagtctcttttcaaaagtccaggctgtccttgaacttactgtgcatctgaggctgacttctaactcacaattctcattcctctgcttcccaagtgctaggattctaggtgtgtgtgcctccagacttgtaagttgtcctttcacttccatgtgcagactgtgtgtgacatgagcatcagcacacatatacaaatgtgaaagaaaggggggcaattaatgcttaccatatagatcttttgggttttttgttttgttttttgttttttcgagacagggtttctctgtgtagccctgactgtcctggaactcactctgtagaccaggctggcctcgaagtcagaaatccacctgcctctgcctcccaagtgctaggattaaaggcgtgcgccaccacgcccggcagatcttttgtttttataaaaatgtattttttatatcttaactattatccaaatactggttactgtgacatatatgtttgcataaaattccagaccagaactggacaagacaataaaaaaaaaaccctaaacccaaatagcttagaaggcagtattatgtacatgcatgtggtagagtagtaaatgacggcttcctttcaaataccatgatgctttttgtttcattatgaactagaatagggagataagcgccatcatcttattttggatttagttggaacttctcctcttgagtttgttttgtgtttttgttttgaataggcaatcactgtaatttgtaaggtaatcactgatggttaatttgtgaaaatacaagttagtctgaggaatttttaaacacaaaaataatgtgttgacattcccctagctcacaagtgattacagtactagtctgcaatgactgaatgcattttgattatattaaggttttgcattccctctttgcatgtgggttttatattggagagattttaaagggacagacttatgaagtgactggatactagatagaaaattctggtctctagagctggttttgccagctaattttttgttgtttcatgcaaacatttcccctatttcccttctttgggcttcagtttccctatctcaaaatgatttctcaaattaggttatccctcaaaaatttatccctgacatcttttctatacaatttcttctccttcttctgtatttccattgtttagagttcagacaacccttttttgtaaaagaaggaaaatgcttcacttgaattggatggagacaggcagctggtgcagaatatctcttctggattagcttctaacagcctatgagacaaacataggatacatctactataccacataaatccctgggtcccttgatttcaggaagaggtgcagaagggagcatatcagtcgtggtggatcttactttggcctcttcttagactccttccagcgttctcattctacttagttctctcccaaaccaaatgatcagtatactcttccttccctgctcttggtgctggggctttgttcttttgtattggagggggatggctgctgaaggcaaagaagacatgacttagagaccggagcaataaaaaaatccttgggcaaagttttattaacttaaaaaagcctcaactcaggaattgattgttggtgttggttcactttctgtactgtacgtggagttccatgggaggcctctctggctgtgagccctgtgcagattggaatggtaaatttgtgtgtgctatataactctggctgacctggtatttattatgtagtccatgctgcctagaatttgggacaatcttcttgtcttagcctgctgattcctggaattacaaacacgtactaggttcctggctggtatgctactcttaagactattgcctcccagagtactcaagagactttaatctttcataatcatcaaagaaaggactgagagagaaaaccagataatttctcatttgtataagcaatgtcttaggaattatatttattgagcacctactataaactacgcttggctaggtgctttagatgcaatttcattcagattagagtgagtcagaaattgggtatgatagcctgtaatctctgaagatagaggcagacggatctggagttcaaggtcattcccaagagcatagagagctttaattgaggctagcctgagcaagcaacatgaaatcctgtctcaacatagatacaaatgaaaaagtgacttggagttctattgtacaacatggtgactcctgttgctaacggtacattgtattcttttgtttgtttgtttgttttgttttgttttttgagacagggtttctctgtatagccctggctgtcctggaactcactttgtagaccaggctggccttgaactcagaaatccgcctgcctctgcctcccgagtgctgggattaaaggcgagcaccaccatgcccggcaggtacattgtattcttgaaaaatagtgagttggctttgaagtgatagctggattctttaatcatcacagcgattctgtccctaagaggacaaagaacataccttggtaggtcacatcaccagcaagttgtgatatggagtttcaaatacagatctgaacaaacatattattttcccattgcactgcactttgttgggcgaatgagggtgttacaggttggacatgtctcctagatgtgtcttaggtcattgagaggtagccatagaacagagaatacagtcatcctctgtgagggcagacgggtctgagctgttatattgtaggtaaaaaccactggagaagagatttgaacttcctcttttttttttaaacttcctttctggtcaaggaacatatttcttggcacccagtgataaataacatgcaacaatgggaaaccgtagcttgaggagacgcagagcctggtgggaaatggaagtggggcccacaattgctaccccttacttctgtttctttctgtgagtgtgttccttgacaggaaagaggaagaacacattttgctgcaggcatgttgtacttggcttactttaatctcttaaagcagatttgccaaatgatttcatcctgagttatatacatgccactaggtggcagagctaccactatgaataacattatttttttgagagtatagtatgattacatctctcccttctttttcctccccacctctcctatacccctcctcactctccttcagattcaaggcctcttttcctactaattgctagtgcatgcatatatgcacacgaatatagagatcctgtctggcttctcagccatcatgtgagttcagttgagggatccataaaaataacaaagcttttctgacttcagtgaagtacttattgctggcagattttgcattaggatttctaaattctgattttattttgtagcatgactaacacttaattatgacagtcatattagttgtattactatcctatggattagaaactgaggttttgtgaggagaaaagttctggtcaagctcacacagctattgggagtgttatgactcgaccttgaatcttgatagattctattttcccagtgccttctgtcaactatgccctgtgtgaacttcctttgcctagcctactccccaagcagaaactgggctgagtgttgtctgttatgtggagaagatgctcactgtggtccaggctatgtggagcgtaagaagcagatgtggtagcatcttgcagatttttccagttaaccatcaatttgcttttaggtgagtgataatgcagatgctgccagcttgtgagggaatctcagcatacctcagatgtttgggcattgatgcaatacagttttgcacataattcctcatgcagatttttttcttaaggctctggccttacttatgatgtagttctgggctgctaagatggctcatgatgtcgctagcttgttacacaagtagtgcaggtagtatacaaggcaggccgcactgattcttgaattgacttctgcgagttataaaaacgaaagaggtaaatggggagttgtcttataccccaaagctcctagaagttagcaatgattttttttaaaggcaaatctcttcctttcattggatttcagttttctttgtagttttttaattaccatgtgttaaatacatataataataattggttttctttcttttttgttgttactttttgagacaggatttttctgtatagtattagtcctcattgtagaccaggctagcctcagattcacctgtctttccctcctaagtgctgggattagaggtgagcactaccatgcctcacttggtataacattttaaataaatgaacttaatgaattttgatatattcatcccttccttcttccccctagtcccaattcacactcctgctgatctcttttcaatttcaactagtccttttttcactttcatgtctaccctttcctcagtgagtttccttaggctcattcacagaagtatgattaccaaccagtaacagatcttcagggatgggtgtgacttcacgtgccctttccgtgataagatgttaactcaagtcttatgcaggtctcatgtgtgtaatcacaggtgctgggagctcatgactgcaatgaagcaatgaccatcctggatggcatcatttcacagctctcctccacatcgtcctgctcttatgatctttctgccctctctttttgatgttcttggtgccttggaggagatgatatagatgtttcaattaaggctgaacagccaacagtcacttattcttggcactttggccagttaaaagtccacagttactgccgagcacagcataaagaagctcctctgaccaaagctgagagcagtgcttatatgtgggggtgtacacttcatttgaaggcaacttgataggcccatcactggacttcagtttaatagcttgtgttgtgttagccctgttttctctctacagtctactagggatagtagggtatagtacagaacagaattcacagcctctagaaaattttttttttttatccaaaatgtgtttattgggataatttcccagttatcttgattcataatgtttttagtgtacctcagttctaccatactctcagacctcttgggtgtagccaataactgtgttcttctgcttaagggtttcttaaggtcagctttgaggaatactagcttaagtcttataagaaggatgtctagtaccaaacgaaacacatttttccccctcagggagggagccatttctcagctttataaggaatctactcactggagccacagaggtttattcctagaacaaagagctagatacttttcttctttaacttggaaagcacggtctttcctctctccagtccggcaccacctgaaatagacttcttggtgactataaacattggaagtgagtaatttctcgtgctgtttctttgttcttagaattggaaacggggccaagtgttgcctgaacaaatgcctcccatcactgcatagaccttaattggagatttctttgtagcctttagtcacaggccttctcttttgccctttattcttttttcagtatcagttctgacttcagactgcatttccttcctcccatatctgtactttggaacttcagcataggctgagagactgctcatctctccaagctcaagagcttaaaggaagtggaaaattcataccctttttatttccttctgcttacaaaagaagaagcagtgctcataacaaaatctccttcagtcctaggttttctgagccgccacaactggcctcttggtttaggtaaaagccagttgttgctttcccagttctgttcctttcatgctccactccttcggtacctagatacgttagtcctgtagcttatcctatcttcagtgggtttttttctttctctaggatatgaacagtttgtaactctttctcttcccaccggtggcatttcaatcataactctgaaaatgtgttgaaaatcagagttattacttgggtcctatgttaagtataggacaagaacttcccatacacaacccttcatgtgagatcatttgacaactttcctcccaattagataatgaggaagttgtgaccagcaaaacgaagtatactggctgcaagttacagataaaagatttttgttcagatttcctgatatgtgacatctataaagagaaagtgtgatatcttaggaatgtggcctctcctcagagtggttattatatgagatagtcccaggaaggtattggcttgtttactagaaggaatgttggcaactctgggttcttgtttatgtctctagttaagtctcttagatttcatacttatcccaccataaacttgtatttccatccttttatacctaaaagaaaagatgaggactctgcgatgtcattctgacatcatcaggatatggcttagctttaacgtggccatccctagtcttgggcatgttggtgtggagcctacaactggaccatcaatctgctagtgtcagggcccctgaacagactccatcttgacttggggtctggaagcaacattgatctgtgtgttatcagcaagatcaagctggactttcttcgtccattctcagtgcccaacaagaaagggactaggcttggccggtacagatgtgagaaaggcactaccgctgtcctcaccgagaaagttacccctctggagattgaggtgctagaagagactgttcagacaatggatacttcgtgaatggtgctgtgggtggttggataactctagatgacttggggtgcataccatccctaccccggggtgcataccacccctaccccaaccccattctaccccaaccagaaaacatgcctttggcaattgctcaattaaaataaataaataaataaataaataaataaataaataaataaaagacaaaaaaaagtccccaagtccttgctgagttccttttctgccttctattcattcaaagggtgctgggcaatacagggccctttagcttcttcacaagacaaatgttggccccaaacatattggtatctatatctttgggctatgagctgtctgtatagtatgctttctgctttgtctttcttggagtattacaagtgagacttggtcttagatgttgatataatcctcactttctaaagattgggacagctgtgaagtttgacttgatgtcatcaatgattgtcaatacagtcaattataatgatgtaattcttccctagaaacctaaagggctaggttgggaagcttctagagagctaaacatgtggaagtacctgaagggacatgtgcttgaggacatagaaactttgcacatctccgtttgcatctctgcaccttttctgtttgttcatctgtgtcctttttaaatgtgcctcctttgttaattttagacagacattccacatgtagccctggctggcctagtagagcttgacgtgactgaggtctccaattcagagagcagcctgcctctgccctctaagtgctgacattaagcatctcacccctcttagacacaagatctcatgtagcccagactgggtttagattctgtgtaaccaaggatgatgatattgaacttctgatccacctgccttcaccttctctagagtgctggtattataggcaggtattactatgccaatgtaatattctttatgttttaaaatgctgaaggacaatatatgagagttcccccggagaatatgatacaggagttaacctaagaaacttagtttatagtctctaatccattctgggaggagacagctatatagcattgtagaagggagacattgatggaacatatgagaactggcttgatttggaaatatgacataagctaaatcttgactctgccacttacctgcatgttgggcatgtcatttctttcctggactttaaactttaccttctataaaatgagccgcattgtacttctgccatagagctcttatgagaattaaagatgaccatggatgtaaggttcttggtgtgcaccggggttcacagtagtacttggtaggcaaagaaactgatagcaatgtttttctttttacattatatactaaacatgttaattgtgcaaaaaaatggatttgtgacactttcatgcacatatatttgattataagggcattcctttcatccattggtccttgtctttttcctaaatagtttgttccccttctactttcatgttattttttttaaaaaaagactagcagtaccttaagccctttaaaggtagattaagtttgttccacctttatgttctttaattcctggtagatattaaaccagttattgtgttgttttttttttccaggtggtgaaaactattggtttgagggaagtttggttctttggtctgcagtaccaggacacaaaagctttctctacttggctgaaactcaataagaaggtaatcacttactacttagaaaaattttctaggtaataacatatgcttgctagcaaacctgtgataatcaagctatgtattgagcaaaacaacaaagggactgatattcagagtgttaaaagttgtattgaagggaatgactagacttggctgtctgaagtcggacaaagatttccaggtttatgcaggattgctgccttctgtagagaaaagattgcttctcatttgtctgcatggctagttctacagcttagagaacaaccaccctctcttttttattttgagaaaagagttcatattctaggctggtctcaagctccgcatgcaggagacagtgactttgaacatctgatcttcttgattccactttcagagttttgtgattacaggaagaccctcactatagtcctatttattactttcatcaaagtacaggcagaggacttctgagcaagatggtaaagccaaaggaagtggagactcttctttactttagatttgttttggagcaaagcttttaaaatgttgaggtacctttctttcaaatgtgagatctgtagacttgccagagagagccccaaatcgtatctctggagacacctggcacactcccctcttcagatcctcaaaccggaggactcaatactgtgctctagctaagtttgctaattgtatctggaggtgggtatctcactttctgctttaaagagtcttgttttattaaagaataaaaacttggtaaattatatttatttactatattatattgatatttactatgcctgtccatgtgaatgtgtgcacacatacattcatgccatggtatacataccaattttctcttccactttgtcagtccccaggatctaaatgagttgtggaagcaaacgcctatgccctctgagtcatgttgctgaccccaaaagtagcacacttgctggataaattaggagccattttcgggtttagaaggtcatctggtttatggtctaacctagccaattctgagctttcaaccagacttgctattctctgatagtttgtagggttggaggacacttgaaagaggagcctcaggggccggagaggtggattagccgtcaagagcactgactgttctagaagatcagggttcagttcctagcactggcatagcagtcacgcctgcctgtgactctaattccagggaatctgatgccctcatctggccaacgtaggtgccatgcatgcatgcatgtccacacacagaaaaaaatataaaataaaagttttacaagagaaacttaaaaaaaaaagaacattcttaaatctaccctcagaatttgagatcagtaagctatattgtcagatagtggtggcttctgtcatcagtgtgatttataaaatttttaagaagaacattctcaagaggaagaaatgtttataagattccccaatgaaagtgatacttttgattttatttgtttatttgcttttttaaaaatttagttatagttgggcgtggtggtgcacacctttaatcccggcccttgggaggcagaggcaggcggatttctgagttcgaggccagcctggtctacaaagtgagttccaggacagccagggctatacagagaaaccctgtctcgaaaaacaaacaaataaacaaacaaacaaagaaacaagttttagttatgagagttgcctcccagccttggacgataacccatactttcagcctttccgagtcctctgactgccttacagacactctcccatcatcagcatctattttgagggagcctttgtaacctccttgctcctcccaggtgactgcacaggatgtgcggaaggaaagtccattgctcttcaagttccgggccaagttctacccagaggatgtatctgaagaactgatccaggatatcacccagcgcctgttctttctgcaagtgaaggagggcattctcaatgacgacatttactgtccacctgaaactgcggtcctgttggcttcttatgccgtccagtctaagtatggtgacttcaataaggaagtgcacaagtctggctacctggctggagataagttgcttccccaaaggtgaggtagagccctgccctcctttgacctggctgacaaagctgaataatccccactccacgggggctgccagataagggtttttttttcccccattgagttctgtctaaagaccgtgttgtgctgctgagacacatttgcacatactattgtatcctattctatttccggtcttcaaaaggctcttttcccctttgctccttgatatcaaagctccattaccctggggataggtgctgacgtagaaggaaagatgagttgatttgttttgtcctctcccatggttccatttctctttcactgatgagattttattatagaaattcacaggagagagagaaaatatgcaaaccacgggcaccattgtatagttttctgattttgtaaacttcgaaggtgaaagcttttaaacacttgatatttttattttaatatcatgacaatgctaaataaacaaggcaagcgttgtccttgttttctggctcaggaaattaagatgcagagctactgactctgatttgccctgtctcccatagcagattttttttttggcagtactgatctgaacccccaatttctttatttatttcttttaatgcacgaggggtttgtttcattttgtatcggatggccatttgtttccacaggcttttagattagaataggagaagaaaaattaagcttgagctgtggtgtgtacacactccacagatggtgttagggatggtaattgtgccctgggactctttcctcgtcagtggcatgaagtctgagatggcatatttaaagcatcttgtttaacaatctagtagagctgtggactgggcctcttgttttccctcagagtattttgtgactacttccctgatctgtatgcaaagctgtcttataaacaccaactgttggctccaagaggatctaggagagaatatttttgcctctctttactgttagttcctcatcacagacgcctgtatattcctgttgagtttggagatgcaacacattattagcattgtagttaatggtataaagaggatctggactgttttgtttttgttttttgttttgttttgttttgttttttaattccagcacttgggttgctgaggcagtaaagctaagagagtttgagtctagcctggtctacatagtgagtccaggacaggagagctgtatataatagagagaacccatatcaaacaaacagacaaacaaacaaacagaccctgcctcaaaccaaaaaaaaaaaaaaaaaaaagccatataggtgactaaagaggataattccattgttctgtttagtcatctgttcttggagttcttcctttaggaagttcgttatgcctgcttcagtgtgttcagttctaattttcagtatgaatccagcaatacttcagtgggctaacttctcatttgcatcaactctatagagagctaagtgagccttcctcccttcctgcctatacgttattgaccactcactgtctttctagagtcttggagcagcacaaactcaacaaggaccagtgggaagagaggatccaggtgtggcatgaggagcaccggggcatgctcaggtaagcctcccctgatagccatgagcttcaccgtccttgtaaggagaatgatgatggtgtctacaaagaagacaaattattaggtgaattggtggattttaagaaagagagactagggattattttgatatttaaatataaaaggcaaccttgaatcattgtaagactgtgatttattttaggcatttttttaaaattcttaagagcaaagttttgatgcaaaggactgtaacttgaaaagatcattaactataacatcaggactttatttctattatttttatttttatgccctctctgtcagtatctctctctctctctctctctctctgtgtgtgtgtgtgtgtgtgtgtgtgtgtgtgtgtatgtgtgtgtgtccacacgtcgtgcatacctctgctttatgccagggtgcacatgtggaggtcagaccaacttttgggagtctgtttttgtctactctaccatataggtcccagtatctgaactcaggttgtcaggcttgctggtctatgaccaactgacccaactttccagccctaggaattctttaaagaaatgatctcattatgcagcataggttggtcttgaacacacagtatggctgattataggattacgggcatgttccaccactccttacatcctaaacagttttgagtacaatgaaaaggaaggaagatcagggtctccaggaagtttctggtcactgctcccctaaaaataaatgggaaaggagctctctaaatagagcattttatagctgtctatttgagaaacaaatcttatttttaagaggatgtcgaaatgcagaggagggagaatatactttctgtaacagctaatattgcagaggtcaacaagggacagactgttcttactctttaggttcctgtcagaagtttttagttaacagaaatactgtgttttcttgttactaatcacttgcttaagtcctttccatttcctaatcctgctaccaagaccattgccagaaacagagaaagctggctttctctgttgctgggtctgctatggaagctctactttgtgacaatacccctctcctattctgtatcatatagggaggatgctgtcctggaatatctcaagattgctcaagacctggaaatgtatggtgtgaactatttcagcatcaagaacaagaaaggctcagagctatggctgggcgtggatgccttgggtctcaacatctatgagcagaatgacaggtgtgtttcggacttctctcacttatttggatcactcttttttgtaaagttatatgaaaatattttatttctgtctaactcaattatgaataaaaatatagcagaacaaacattggcatttaaatatcttcagttaagattacacaaaatagacatcagagtttcagtgccctgatagcactctgggatattgtggtatatttaagagtcatattttttttagatttgttttttattagatgttttcttcatttacatttcacatgttatcccatttcctagtttcctctccgaaaatcccctataccctttccagtcgccctaccttccaatctacccactcccacttcctggccctggcattcccctatactggggcctagaatcttaacaagaccaaggggctctcctatttggatcactcttaaacataggtgtcatcccttaccacagagcaagactatgtcacttgagtcctacctgttatttttctacccaattaagtccagccaagatgattgtacaccttccttcatcctatattgactaaggttgtactgtctattatgatagtcactagctatatgtgactattgaacatttgaaataccattacaactgatatatgtcataaacaaaacttgcataccacactttcaagaacaattgtgagaaaaaagtgcgaatcatctttctgtacctatgacagaatacctgggagaagccaacttaaaggaggaaagatagattttggcttgtactttcagagttttcagtctgcatttacttgatgctgctgcattgggcctgtattaaggtagaatttcatggtgtagagcatataattgctcacctcctggtgtctgggaaatagacagtaaatgagcaagggagtggaattccaatgtcttctttgagggcatgttcccaataatctttctccaaccaggccctgctcaaaaagttatgccaccactaataacaccattttctggggacctagccttcaacaaatggccttttgggagtcatttaatatgtaaaccatgctgagtatggtgatacccatctgttatcctagcactcagaagagtcaggtagcaaaaatcaggagttcaaagtcagctttagcttcatagttaattcatggctgtcttagtttagagttatcattgctgtgatgaaacatcatgaccaacagcaacttggggaggaaagggtttattttcctcacacttttgtattcatcattaaaagcaatgagggcaaaaactcaagcacagcaggaacccaggggcaggagctgaggcaaaggccatgaagtcatactgcttaggcttgcttctcatggcttgctcagactgctttcttagaacccaataccaacagcccagggattgtaccacccacaaagtggtcggtcatccatcaatcactaaattaaaacaatgccctacagcattgaggttctgtcctttcagatgactgtagcttgtgtcaagatgacataaaactagtcagcacaatggctatcctgggctatgtgagaccttgtcccattccctttcccagtcaaatataattcaaaccacagtaatgtaaaatatatgtataatatatttttaaaatgttgacttatatgcttaaatgatagtatttatatttattgagttagttaaaccttcataattaggtcattatatttccttcttatccatttttatatagctactaaaatttataaatgttaccctgataatttttgaagagtgctgacctagaatctatcttgtcagggttcacaaagtccaagtcccgtgttataatgaagtgacttttagcctataagccttgctatcatattgtcttcttttcccctcggtctgctcttggtaaggatgaaatcatcagattgttgtttcatccactacctgagttttagggcacattatttatctttccaagtttaacaattttgtataggttttctgttaagtagggccacagatgctctggaaggttcttacaaggtaattgcttcaaccccaagtggaacaaaacaactggcactaagggataacagtagctgagtttgacaataggtctatctcctcaagggagaggtttgtgttaggggatagagtggggtgggtggtggtgagggcaaggcactaaggctgtttccttcttgctttgcctttgtcatgatgttgttggcctctgtttctttctacagactgactcctaagattggcttcccgtggagtgaaatcaggaatatctctttcaatgataagaaatttgtcatcaagcccattgacaaaaaggccccggtgagtgacttctccttctgactcttcgcagcagctttccccccccctcccccaaggtttaggtaatattaagagcaaacatgtcattggatttatctgtctctccattttctgttgtgtgtcacatgtacaaatgaacaggaagcacaaatggaaagtaaaatataagaggaagttgatgttgagaagtggccaggtgatattctatacttggtaccactctagtaccaaactccctctgggggagggcaagctacaggcaagtcctaaatgctgtgctttgcccattgcctcaccttcctgagcctcccgaatgtactctttgtgtagttggcttatatctaattgtggaaaatggcagagccaggacttcaaacccaaagatttaccttacattacaaatttaccttttaagactatttatttatttatttatttatttatttatttatttattttggtttttcaagacagggtttctctgtatagccttggctgtcctggaactcactctgtagaccaggctggcctcaaactcagaaatccgcctgcctctgcctcccaagtgctgggattaaaggtgtgtgcaccactgcctctggccttaatttaaagtgacctttctgcctttggcctctgagtgctgggatgacgtgcatgtacttctagatcctctaaattttgtctttttattattatatttagtttattaatttatatagtttgtgacaataataattaaagaagagataatgaattttggggaaaacacaaggaagttggagtgatgtattagtgttcacgtagtagttctgaataaaataaataaaaggccagcagaaatgaaaggcttttaaacaaataataatcaagataattgaagtttaagaaatttagatatttgtgtacttaatagcctgtttccccataactagagctcacttagcagagattacagagatggtttagaatcctgtggtggacctgttgatgagaatatcaattatcttatagaagaggccctttgagattcagtagttagatctctaggtagagagatatgacattgtatgttcccataagagttaatccagttgggtcagtcagtcacctggctaagggagcgctggtcagaaacgtgtaagttccttaccgctgccttctgagaataagtaagtaggagaaataagtatctctctaatgaggtggtgtactttttcttcccaaagtttctcctccatagtttaggccctatgagctgccatggggttctgttggatctgctcatcttattgtatcctgacataggaaaacaacctttcctttccttctcttctgcagttttgttgtgatttcggactagatcctataaatactttctatggggcttttggctttttcatactttctgtaacaatctcccggccatgcagttactttcccaccatgtggctaacttctatactgacttaatgcaaaggtcctggcctcttaagctccaatctgtgaatcagtaatgaacttattttgaaaactaaaacaaaatactattgcagaaaaagacacttccaagaaagtgttttagggtgttttttctttagatttatttttccgttttctgtatttatttatttttttgtgtgtagagggagtataaagtgtacaagtggaggtcagaggacaacttgctagatagaggtcttttcctttcactgtgttgtttttggggatcaaactcttattattaagcctgagagcttaactttctgagccatcttgctggccccagggtgtttttcgtgagcagagttggagaaaaactgtggtttggaggtaagaggactggtgtcaaagaaaagaatcatgggttctactcttaagtctaccactactctgatacctgactctgcaaaaaatatttcccttactctggtaattaatactcccaactggaatacaaatgggttaaactatatcatctttccaatacttttgaacttagctttatagaaagctttcctcaaaattttatttttaaagtttattattattattattattggtacgtgtgggcatgcatgtgcctgctcaagggcacatgtcagccatcctgctagccctaaaacctttggttttcccttcaggactttgtgttctatgctccccggcttcggattaacaagcggatcttggccctgtgcatgggaaatcatgagctgtacatgcgtcggcgcaagcctgacaccattgaggtgcagcagatgaaggcccaggctcgggaagagaagcaccagaagcagatggagcggtaggtgctatatagagtgctggaattaggacgagtgcagtggtaaggaagctttggaaggttcctggcttgcttagggagtggaatcatcccaggacaagggacttgtgaattggaagggaggacaccccagatattcagtctcagcacagaaacaggcatcagaaatcttggatttcagaggttgtaagagggaggagcctttcatagtttcctgttgtcaatgactctcgtgccattactgtgccaggtacattatgggttgctattggttaactggcaagtagtatggtagtagctgaagagtctgtacacagttgtacttgggttgagcagaaacaagcagagccctcagaatttcccctacaatgcccttagtgtattcagtgtaatctgaaggttaggagcaagagaagtaggaactgagattccagtctctgactttctgatcagtatcttaggattgtaggttattatttatccaaagaagatagacaaacagtcaataacataaaaatatccttaatcattacagaaatgcaaatgaaaaccgtaatcaattaccattttatgcttattagtgcggatataagaaataaaattgaaatataagtactggtgatgttctgaaaaattaggaattcatgcatattactggtgggagtataaagtggtagaagctagttcctcaaaaagataaaatatagaattactatataatcttgtaatcccattcctaggtaaagtaaccctcaaaagaaaagaaaaatggatgtgcaaacttgtatgtacacacgtgttcacaataccactatatagacacttaaatggtagaaaataatctagttagtaccaagagataaatatataagttctaattatacacaatagaatgtatcttctaataagtattttggttttaattgtgtgcttgtgaatgcacgtgcctgaatgagcacattcctggagtacaggtgtatgtagagaggccagaagagctcatcaaataccctgaagctgggattaaaggtggttgtgagctactgcatgcagggccttgcaaccaaactttgatcatcttcaagaccagcaattgcttttaaacactaatctatctctctatcccatagaatatatattaatctagtttatgttgttataataaatgacctaacacactgagtacttcaaaaataaagagggtgtttttactcatgtttttttggatgctgagaaatccaagataggatggccagatctgtcaagagccccatattgcgttgtaatacagtgggcatgaggattcagaagagatggtaaagttaattgtgaccacctcttctcagaagaagaaaaaccatcttgtgaaacttaactcctcctgagcatcctttttgaaagtgactacccgaatcatcttccactcatgcccatctaataaaagtttcactgcctttcagtgcctttacactaaggacagggtctctaaaacacgaacttatgtaggagacaaaccatagcagaatagtttttatccatctgtgctgcaatgtgatatactctaaacattatgcttagtgaaaaaagtgtgaagtatgacaagttatatattatatattctatttatataatataatccccaaatgaagtacacacatacacacacacacacacacacacacacacacacacacacacacacaccagtgtgtattggtggcttctaggttctggaagaagtgaaatgtggagaaatgacttcatatatgatgatttagaaggtaagaatagcttagcttgctggcacaaagttgttacaagttcaaggccacccaagcttaaatagtgagaccctgtcttaatgtaaataaaaacaaaatgatcatatatttctttgaacattgaaactggttctaatgcatatatgcacacacatacacacatacacacaaatgcatgcgtgcattcacacatacatacaacacatatgtaactaacattgattttacccccaagcagtagaatttagactcaaaaccctgtgaatatgaggcaagtactctataactgagctattttgacagcccagtgttctcatttattaagaaaaatattatcaagattttgggagtagtttagtgaactaggccaaaccctgttaaacctcacagtagagtaacaacaagagtgagggatgtgcatacatatatatatgctcagagcatctttctcatacagtctgagcagtgaacaatttctcttcttgtgaagttgatattctagtgggagaagacagataaagtaaacaaattatttagcatatgcaattgtgaaaagtgttgaggaaaagtgcgtgccaagcattctgaaaggtctcagagtaaaacatcttgctgcggtgtaagactgcctcctagagggtggagagatggctcaacagttaggaccacttagtgctcttgctgagaacccaggtttgattccctgaacccacatggcagttttcaaccatctgtaactccacttccacatctataactctggcaccttcttctggatgccatgggtactgcatgcatgttatacacttatatatgcatgggaaacacacacacacacacacacacaaataaaataaaataaaaattagtaaagtctttaaaacaaaaagattgcttccttgaatagatagtgaggccagaaaaagtaaatacttattctagatctgcaataaaatctgagaggagggaacccagagctatggttgaaggcagacaaggttagccctagccaatatttggagcacaaaaccaaaacttgcctttctgtgaagctataagacagtgtgcaaagttagtaaatcatgttacatatggaaggtggagaaggagagcaaagccatctagttggttgcttgccttaccagcattcccttttaagccttgtgcgttcaaggtaaatgtactgagcatggaagcctatgtggaactatggtgtgatgactcggttatatgagagtgtggggaggctgaggcctgagagacttattccctggaacccctcaagattgcacgcagccttgctatcctgtttcacccctccttttcttctctagtgctctcctggaaaatgagaagaagaagcgtgagctggctgagaaagagaaggagaagattgagcgggagaaggaagagctgatggagaagctgaagcagattgaggagcagactaagaaggctcagcaaggtgaggcttgtgttcactgtgcaagttgaggctcttcagatcctcacctaaggtggacattctttttccccccggagctgcagaacaacactacatagtctaggtgtggtacagaataataatataaaaaatatcaagaaaaatccttagaaccctcacctactgcaccatgaagtggaaaattcccaggaagcaggttactgtgccatcttcatctctgagcccttcatcagtttcctgtttttctaccagagctggaagagcagacccgcagggccctagaacttgagcaggaacggaagcgtgcccagagtgaggccgaaaagctagccaaggagcgtcaagaagctgaagaagccaaagaggccctgctgcaggcttctcgggaccagaagaagacccaggaacagctggtaaagttgaatcctgggctgggttgtgtgcatgcatttttcttgcttgacccctataccctgcttactggtttataaatccctttgcctgcatacctgtgtctttctagtttgtatcccaaagataatagtacattcaaaagcaagctgcggcatcactggtatggcccacactctttcataggccttggctttcatttaatttttttacatatagatctcaacctgtaacccaagaaaggaaaagagaaagtacctactggtgtttctttagcatcatttcttcttcccttcccttcccttcccttcccttcccttcccttcccttcccttcccttcccttcccttcccttcccttccctcccctcccctcccctcccctcccctcccctccactttcctcctctccccttctttctttctttctttctttctttctttctttctttctttctttctttctttctttctttctttctttctttctttcttcctttctctctctctctctctctctctctctctctctctctctctttctttctttctttctttgccttatggaattaaatcccatacagaataatgtgaccaaataagcaaattggcaatcatggaggcctagagactggtcaaaggtcacagctatgtttgatgaaggtctacaaacatttctgtctccattggaaagattccctccctgaaatcatgtgttaagctagggatctgtgacttgaaagttaagaatcaatggcttaaaatagtcccttcccttgtagtactggtgtgctggtatctctcaggaagaagatgtcatgagaaatttgcctgagggataagggtgtgcagaaacttttccatattgtagaggttttctatgatattagtatttattaattctggtagcagtcttggtggaagcctaggataacagtgaagggtttgctacttcaagcagtggcttccaagctttgctgaggccccgctgcatgcatatttggcaacattaaaaggggaagaaggaaagaagagagacagaggggctggagagatgtctcagcagttaagagcgctgactgctcttccagaggtcccgagttcaaatcccagcaaccacatgatggttcacaaccatctgtaatgagatctgatgctctctactggtatgtctgaagacagtgactgtgtactcaaataaataaaataaataaatcttaggagagagagagggagagagagagggggggggagagaaccaattgtctgccaggaggcctgtagtataggaggggatctctgacctatgaaggagtaaagggtggagtaatttggttaaaagtcactaggtcagcaagaaatggagcagccggtttcctaccagtttatcagaggaactggggttacaggcatctggacccagaaaacccaaaggtcaagctctcaaggcttctaatatgcctgtaggcttcagaaatggcagagctgacggcacggatctcccagttggaaatggctcgaaagaagaaggaaagtgaggctgtggaatggcagcaaaaggtaagatacagaatccaggccaaagcactgtgggagatactatgctatatgtgtatattctagtttcttacatttcttagatttagactccccattttttgatgcaaaccattttttattagatattttctttatttacatttcagatgttatcccctttcctcatttcccctttaaaaaccccctatccccttcccgcaccccctgctcaccaacccacccactcccgcttcctgatcctggcagtcctggggcatagagccttcacaggaccaaggacctctcctcccattgatgactgactaggccatcctctgctacatatgcatctagagccatgtcctaactattcgtcctaactggcatctacctcttactagacgtgtctttcaaggtatgattgggttgccacaagatacctgatctgactgccagtcctctttctgtcactgaacaggcccagatggtacaggaagacttggagaagactcgtgctgagctgaagactgccatgagtacacctcatgtggcagagcctgctgagaatgaacatgatgagcaggatgagaatggagcagaggccagtgccgagctgcgggctgatgctatggccaaggaccgcagtgaggaggaacgtaccactgaggcagagaagaatgagcgtgtgcagaagcatctgaaggtaagcaggcagggccaacaacagtcagggagactgtgagtcactagcctattactctccactcgtacaatcagaaaatttatagctagccaaactacttactacttcaatatttggaatgttattctgatctactctcaagagataaccatcgtttaatttatcttataatgtatttatgcggtgcatgttcacacgtgcataaggattatatggccagcaaagagggaaaacacttaacaaacacaaactctgctcaaaaaagtggaattaaaatgagaggaagccattgacccctgactcatcttgcatcctcacaggcccttacttcagagctggccaatgcccgagatgagtccaagaagactgccaatgacatgatccatgctgagaacatgcgactgggacgagacaaatacaagaccctgcgccagatccggcagggcaacaccaaacaacgcattgatgagtttgagtccatgtagtgggcgtccagccttcagggacccctcctccttcttccttgtccccacactcccatagttttgcctaactaacactgtgctggagccactaactagaaaagccttggagccatgccaaacgttcagtatagccatgggaccaaacttaatctccccactcataccctcgggcaaacaaatggcccactgtggtgccaatggaatctccttttccttctttgtcacactcattcaacctagctctctagaatagagcatttctccccgccccagctcagagacacgcattccttttggtttgacaagcaccccctccccatatacacttactgttgtcctctgggactcatgtgtgaagtaggttaacagctagctcccatcccttgccagtcctgtgatttgcaaagatggaatattgtgttgtttagggacagaaggagggaattggctttatcatttagtatgtcagatgacctaggatttagcctcttaattaagtctatcccttttacagttacttaggctttgtaccgattggaggataaaagagatgtttagccattcttatttcttctacctcccatattggacctattacaaatctagtcccagtgggccttgtctctgtgtttagggatttagtttctaatcaagatgggatgaagagataaaggaaatagtgcattcaagagattcactaacaacctagaaaggcccctgccccagcacatctttggagcctttcttctcttgagtgaggtctgtggtcagggctacccctgcccatgatagtccaggttcttggttccttttctaaatctgtccctaccctctccaatcctcagatctcttccagctaggacagagaggatgagtaccctcaaacctagccagttgcatctaaacttgttgccacaaaggaagaaacttttttgtacctggctttagtatttttcctgccaggacttctaaactacttcccccagagctaatttgaccactgttcctgtttcacagatacaaaatatgatgagtaagagtagcccttgtctgtcagtcacccagcaatcctccctcatcttacccagtgcaaagtggtgagtaggccctgcttctgacaaatctctaactcaggcctcatcactcattgtgctgtcccttggagatacagaaagctgctgggtattctggccttgtcccttcacacccccacacccttttctccactttggagcagctgctcccccttttttgtcacatgtgtgctcttttaatttttaccagtattatatattctagtgatatctaacaatattggtttctaccttttttgctaatgcactattagagatattagtcttgggaaaggatcattttagcttcattattttttactactgtcaccccacatctgagaagaatatactatattaaaaatgatattttgccaaaaacattatgtaagaagatttcagtattagcgacttacctgtcactataggtcatacaatacatttaaaatgtacttagtatttggttttattgttcctgtttgctttttccccagggttcagtccccaaaaggctgtcttgtccctctatgcagtatccttagtccagagcatccctcagcccatgccccttttacttaatcttggggaatcttatatgcattgctgtgaattatattgacagttggtgagctgtcttatattggctaaattcaaacctggaattgtgggggcaatctagctgcattaagggcaataacccacccccccatagaggctggggagaagggtaggatttatattgaggttttttttttgtgtatttttgttttttaaataattgttttggaggggtttatgctcaatctgtgttctatttcagtgccaataaaatttaggaagacttcact

SEQ ID NO: 561 - DNA, 72565 bp, mus musculus; identical to SEQ ID NO: 560

SEQ ID NO: 562 - DNA, 12920 bp, mus musculus
tggccttgtgctcgcctgagcaggagagtagaaagctcagcggcagcggagggagtctatgcgcgctggacagcagtggggggtgtgtgtgattcgcactgactgcagacactcgggctcaatcgccggggattaaggacttggcgaccgggctgccgggctacccggccgaggcttcagaggtgcaaatcgacgggactgatttgctcggcagggccgtactagccttttaagtatactgagaagggccggtgctaaagtagaagctgtcgtgggacgcgccggcgcggagtcccactgtggcccggaggaacggagtccgtgttagggggacccagtcgggagcctggggaccgagctcgcattgttgggagacaacccgcctcttcttcccagaggcgtcaatcccaggacggtcgaggcgtcggggcagccactgagcgctcttcagggagacccgatcggggagaggacttgcagtctcaaacaatctgggagagccgagcggaatccggcgggatcactcgggggcggcgagcccccgtcgcgcctcgtgcggcggagaggccagggaagaaagtcctcggaggccgcagcccatgcgcgggttggggacgcctgcccagtgagtcctcctggccagccgggcgaaggagagcgaccccgaggccagcgggaggggagtgcttcaaggccggcggctgcggaggatgggcgcctgagtggctccgagcgctgcgcggcacgggcaggcgaggcgagctttgctgaggaggcgctaggggatcctgaagtgcattctgccccggggaaaatggcccggcctgggcagcgttggctcagcaagtggcttgtggctatggtcgtgctgacgctgtgccggcttgccacgccgttggccaagaacctggagcccgtgtcctggagctctcttaaccctaagtgagtaacttatctactctggtccctgggggtgggaggcacttcttcggggtgaggtcgtgcacccccaagtgcgtggggggggttgtccgtaggaggtgcggcgccctattttatatctggccttttctagtgttttcttgcgggcagtcggggtagggtgcggaagggtggggtgggggcacttagctgcgtttcgatccttcggtttggccctactctcaagtccggatcgcgtctgttggtcacaccaggcagatatagaatgtctgggcgctccagagcgcacccgagagctgggtgggggcgagtaagcagcccactccagggcctctgggaacgtggtggttttcactcacagccactccaggggtgagatcgacctgagcaagggaccaggccagaacacaggttcctcatttgcttaggtgtcagggcggctcaggacctagcgccccggggcgagtggcagcatctgtatatcttctccagcttctcccattttcatttgtctttcttccctgtctgtttgcctccctgtctttctctttgccgtctcttcttgcacactccccccccccccccatttctctctgccggggaggtagaaaggcgggcgctgcttccaggctcacaaaggcggcgggtggagaagggcggagtggaagagggtttgtttgagaagggggttcgatccagtgcccgtcgggggtccagttgagctaggcaccagagcttctagagctatcagggctgagaatggtagtggagccagcgagggaggtgggtggggaacgtgtgattcctgtccaggcaggtccaacccccccccccccaaggactggagagccatgcttagatttctcctatggttgggggtagtgatataaaggaggcccttttctttcttctccttctccttcctaactctgccccctcccatctctaaacaacacacacctttcagggcggtggctcagtggtttctgggctgttggtggggagtagcttaggctgttgtgacctctggacctttttctcttttggcatctaggactcaccgtggaactcagggttgtaatctctcttctcattttctggcagtccagttgtggacaacacagttagtggaaacctgggagggggagggggaggcgcttgacctgttcccagattcctgtttctggaatttcctcctgtccactcttgtgggctctctgctaacttcctaggttcttgcctgccttagcccctcgagtcccagggatgaaagtgagagaagaggtcttcttgttttctccttgggttaaggtaggatcccattactgatccttggctaaagtagggtcaggatagaggtttttgcctctgtacaaggaaaggggctgactggccaggatttctaccttactcagaagcctgtttggtcaccgtgccttcactgctggggctcaaatggtttgggggaaccctctagactgttaagcccatgggaagagcttgtgaagtgcccagttcttcgatgtaagggtgaaggctggaagtgctctttagctaggggacttgcaatccccctagggtagcctgtcccaggagctcatgggagtgacctaattgctctcttgggtctagataccgtgcagctccgcagctggagaagagccctcctgcagagttgaggttgctgggagaaacaggatccctgggagcgcccctctttatgtgttctctgcctttagagtcacagagcagtttccaagcttgagggctgtgtcccctctgctctctatccagtccacgtcaagctgaggacaggtgtcctggggatttggagaggactgactttggactcaagtagaacctgcctagattctatcccataattgagcagattctgggaacagtttagactgatcctggtggttcccagaccccatttcaccgatgctcaggggtctggaatgcagtctatgtctgtgtttgttggcacagggtgcagggcaggaggacaggaccaaggcactgccctcagctccaggggctgcctgtgccaccgcacccaaccctcaggctgccccggctttttaaataaatactgtctctctctgcttccgtgtgtcctgtcgagttctccctctcaggccgacattgttgcctgctcacaccctgtgagtggaactcacctctctctctctctctctctctctctctctctctctctctctctctccagccaggctcgcctgctctccctctttctcacactccctctcactcttagtcactctctgcctctttttctcaagtccttttgtttctcgcacatgcccgtgctctccctcgcaggctcattttctcttatccctcccctcttcctctcctggcttttggtcccctctcctcagccctgtcaggagctggcacccctccctctaaaaatctcccagtgcctataaaccctgcttaattgcttcctcctagggaaaaaaaatcaaaataaagaagtgatggggtctgcttctaggttccagggcgcacgcagccccggctctagggagctggaagggccggctgaagactgcccgtcttacctatctcctgaactgctgctaaggggctgtctgggtggtagtccctgggcgataagaacttctgcttcctgggcccctcctgtcagatttgccccaagagtagagggtgggaagatgggtttggtccttttggggtttggtggaaagcagagtgagcatgttgggggggcctggggaggggccatgggcagccacttcccccagctgcctccccttggggaacttggggcagccagtgtgagcttcacacttgagtcctcagccaagtccagctgctgcacctcagcctctcagtcccattctgaccctatactgctccccactcaggttccccccccacctccaaggagcaggaatgtgtttcagatcacattacaaaccttccctacaaggagggtgggctgggggctcagtttggcattcaggacccttgacccccatccagcttgggtggggcagctgcagaccccaacccatgcttgcctgttacaagctaaagggttggccccagcccctcacagctgttctagctcagtcctggggaggccagcccaagggacttctttccagaggggctggggacctggctattctattttatgtctaattggccacaggtgaaagaaagcctgggcgccctaaaggttcctgttctctgaccccacccaggggagcaaggcaaaggccagaagagcctgcgagggagctgaggtggggactgagttggggttctctttcttctttggggctcttggagccctcacttgccatactagcttaggtgcatgagggtgcccaggccttggatcctgcttgctgggaagcactgatttctggggttagggctatgtatggggtcactgggccaacaaggagactgctgattgtcatgggaacaacaggtttgggggatagttcacatgattataagggcatgtgaagtgggggtcttctgagactatgaaagtcccttcttcctggtatgatctggtggtggtggtggttggggtcagggtgccagcaagccagaagcatactcattctcagcttgctacttctaaatgataccgtgcttggcatgctaagtaataggcaggtagtaccttgctacttacaatgcattctcatatatgatctcatcgggtgctcccaacagccctgggaagtaggcaatggccccattttccagaggaggaggcatatgtgcagaaaggggaaatgtcttgtctaaggtcagccggttacttattgagtcgggcagaggcacaactgtgccgtgtgccattctttccataccatcctgctgcaggggacaggaattcaaagtagggtttgaaccagacctctgctgtccctgggttctcccctctcacctcccaggcgggcctgcatcggcctgatgactcaggtcctgcctgtttgggataagtagtgttccagcttcttcattcaactctccgaggcttagctctgagggcaccctgcacaggtgacctagcctaactcactgactggcactctgcccctcccagctctgagtagctcctttggttcctctctgggccaggaatgtcttcctcttaggaactctagggaaaacatggcagggggtgtggttaagccccagtagactagctctggtcaggtgggacgaagaggcgggcagagtttgtgtaggtgaggagagtgacttcctctaggactcttctggcttgcctgcctccgacagagctgtgtgtgtgccagggcccagctgctgttcctgcccacccacgcctgggcgggcactgctgggacacgccaggcctgctcctgctgcctcgggggctgggtggagctgggggagtgaaagaggagcctttaatttcggggctccccaccctagctgggatgagagcagacttgagttctggcttggggtctgtccctcactagtattgccatcctggggtgagaacaggcctggtagtggtggggtcaccaaaccaaaccaaaattgtggctggagtcttctaccacatttagacttgcatggctggaaagcaggctccccccttaaacctctggtagagcccgaggaaaaggttgaagggaaggaagacaatgggcctggtgggacaagaagagctttctaagcagaagtgtcccactgtaagctcttccctgtaggcgacatacagaaaggtagagaggggctcatctggactaaggagcagatggaagagctatttctagtctttctgggccgtggaggctactgtccccagaccctatgggctttctgaacttcagagtggtaactctaatgagaaagtctatggggaaagacaagctagggaagatgggagaggccaggccacaagactggagctgaaatagttctagctgccttctgaaagtctttttactccctggggtggctccctggggtcccagggctatcagaggctagggagggaaggcctcaggttgccatggtgacctgctttaggcttcctgcagggccatgtcaatccccttattttctagaaaagggctttgtctgggggtggccctaggaaggaaagcttggcttgatggggtggggacagtcctttctgaaaggtggtgcctaaagactttaagttagaagcttcctcctcctctcctcccactcataacttggtgagaaaggaaggagataggtatggtgcccctaaaaggatcactaacactgtgcctggttttggggcttcactttcactggctatacccccaaccctagtgatcccatatactttcttggacttcctcatggtacttctgaggaagttttcctgagtgaaaatttaccagttaggggaagatgctaagaaagcgtgggattggggtcagggatgcaggcctcattatactcctttcccttccacactttaggagaaggtgagttttcttctgccggctgctatgcaaatgagctgatgaatatttatgaagtctgttcactgaggttggagacactctgaggggtgttgggggcaatagtcctttcttctccccctccccccaccatgcagacatctgtttcctcaatgtgtctgggttcaaactagaaccccaagtagctaaaagccgtgttcagtcctggggctctggagtctgggtgggtggtggcaatggaagagtatactcgagcagacatatttctctggtgaggaagttggggcccagtggttaggaagtaaaccagtctgtctcccatgttcatgtcctctatgtagctacagctctatgttgttgtggggtgcaacggtctaagtagcagacactgttgaggctctgttaaagcccaaggggtttgagaagccttcctcaatgggaatagatctctgatcactcatttcttcacattaagggcctgggttcctttgagctctgaaatgttagaaatgctctgctctcgctacctggggaggaccaggggaaagtgaaaaaaagtgccgtgagaattatacaacctttggtgaaacttgtgggctttgtatggccaaagggatgagggtatttcatctgtaatgtttccttggacccccatgccctgtttgcttactttctgtctgctgcagagctgtagagttagagtccaaacgacaaagcacccctttctggctttgagcctctggtacatcaagatggcacctctgagcttggagcgtcacagtgacacggaagaaaggctgttttgttttgttctttttttttctatctgcttcagctacttagattctctcctctgctaggaagatgtcagaacaagggcacatatttgacagtgtgaaggaaggcttcagcccggagctttgagtgcgccttcactgattgtccctactgtgttgggggcctcagcaaatggaacgacattgcggtagcctgtgacctgggattctataccaacacccagaatggcactcttcattttatccttcctgtgggttacctttagtccctcatggttcctcctgtcggaggacccaccaccaggcagaagaatcccacgctgctagttatggccttggggaatttacctgtagccctagatctctttcccacctcctctgatactttctactcttgcctgcgcaggctgtttgagtcatcagccagcctgggttttgtcttccccactgctgtccacagttgctgactcggccctgacatttttctcgttcacctggtatccaccctcattctgagctttgaagccattttagaacatcacagtatcctcgtccgatgagccatcttttccctcttgatgtctctcatcgtatgaagtagcatcctcacctgtaacctacagatagcctggaggtgtctgtggctgaagtgtgggctgtttacttttttgggaccaaaccagacaatcaagtccatggcagtcaagttgtatcttctctttctagagcttgcctaagaaaccacagaacttaatgtcggtgtctgatcgcctgcctcttggcagactgtttcaaaggattcaatcttattgagtgcctactgtcttctaggtgcttatcccacccaatcctagggttatgggcactagtttataagtgaagaaacggaagtttagagagcttgtcccagactatggagctaggaagcgcctagctttggaatgtgagtccaccatgtgctctttctcctggctctcagcttctgcctgagcaagctgagaaatggccggcggagcttcatgtctttactctgcttgccaggttagccggtgaagcctggctcaaggtatttagtcatctcctcttgggatctgtagtagctgcagtggaggagcaagaggtcagattccagccgcatgggattcctgaggtcttgtcttacacgagtttgtgctcttctggtaggagcaccctttccttccttcccggagtcaaagtgaaagacagctcaagtttggggatttcagctcttgttctgggatgggtacattattcaccagaataagactgtagagctgtccctaaccacagatggtggccatcggctcctggctccattgcctgtttctatctccccataatgcccaagattagcaagatggggggcaggctccaggcaggttgagctcccctagcctttggctgggagctgcgggggtggtggctaagacatgtgtgggcttgcgctctctctctctctctctctcgctctctctctctctctctctctctgtgtgtgtgtgtgtgtgtgtgtgtgtgtgtgtgtgtgtgtgtgtgtgtcagtcagtagcagtggcctttgaaggaatgtgaatgtgttggggagtatggggaacagggcaccacctccaggtagcctgggcctgacacatgggtacctggcccatttggccacgtcagcccccctgcggaaatgccccattaggacaaagggctcccctagccaggcattgccccaccctgccaagcaccgaaagcctggcagccttgcctatgggccaccccttccacaccctgctggcagtatggttctctctccccacccccagcccaaggatagaggaagggcagaaggtcgatttgatagctccacccggtaggactagcctggccttcactgtcatagcacctggtcctgagatagccagagctcccaaccttgacattgaccattttctttcttctgggcaggttcctaagtgggaagggcttggtgatctacccgaagattggagacaagctggacatcatctgcccccgagcagaagcagggcggccctacgagtactacaagctgtacctggtgcggccagagcaggcggctgcttgcagcactgtgcttgatcccaatgtactggtcacttgcaacaagccacaccaggaaatccgcttcaccatcaagttccaagagttcagccccaactacatgggcctggaattcaaaaagtaccacgattactacattacatgtgagtccacacccagctgtcaccagctctttcgctgggcttcgctctgccttcctgcagcctccctgcttctgagtgatgccgtgctagcacgtgcacaccttacagtgctgcctgatctgattccagcctgcccttagaattctgtccccagcattcagaacccggcagcttgcctcgactccagggcacagatgggaaaggctgcctatccatgtggctttctcttcctttcttgagaatggcagagttggcggaatccttggagcccagccagctttactgccttattttccccctgtagagggtgggatagggtggtgggtctaaggccccaggaagtgaatagggctcagtgatagtgtgtgactaacatccatgaggccctggctcactctctttagccactaaccctcctcctctggtccctcaaagaagtgcatgggcaccttgcctccgatcacacaaggagttgatgggttttagcctggcttgcctcacacttctgtaggattcctcccagtctaggacaaaggccttctaatggtaccagttccatttgttttggtctgagcagcatctcccattaagaaggtatacctcagtgttgtccccaagaccaaggcctggccacaaggagtgccataagcagaggggctcagtatgggcctggctggctttcttacttcctatggggagggaggtagaagggcttggggaaaggaggtgcagagctcgactgctgatcgtttgatcattgttcttggctctctcttgattctgtcaaagaaagaaagagagaaagagagagagagggagaaagggagggagggaggaagggaggaaaagagaaaagaaaaagtaaactgaaaactccagtttctgatttctctggccttttcctacagcaacgtccaatgggagcttggagggactggagaaccgggagggaggtgtgtgtcgcacccgcactatgaagatcgttatgaaggttgggcaaggtgagtgcctgcccaatagccatggtggcagttgcctggggtatgttggtagtggggaagtagtcacagcgttagaggggctgagctctaatattcaggccattcttagcccacctaagggagttgaggacacccatgctggcagagtcctccctctgatctgtcttctcttggccctcagatccaaatgctgtgacacccgagcagttgactaccagccggccaagcaaggagtcagacaacactgtcaagacagccacacaggctcctggtcggggatcccagggtgactctgacggcaagcatggtaagggaatatcgctattctgcagagggtatttctcaggcgtcccctccatcctgtatctgaagaagtccctgctgcctgcctcctgcctgagacatgatgtatctctctggggaatgtggggcgccaggcaggaacccagagagtttctttggatccaaggtggcattgtttgctgccacaatgttgactgcaatggtctcctgactgaccgttgcttccctcccctttcctcagagactgtgaaccaggaagagaagagtggcccaggtgcaggtggcggtggcagcggggactctgacagcttcttcaactccaaggtagcattgttcgcagccgtcggcgccggctgtgtcatcttcctgctcatcatcatcttcttgacagtcctactactcaagctccgcaagcgccatcgcaagcatacacagcagcgggcggctgccctctcgctcagtaccctagccagccccaaagggggtagtggtacagcgggcaccgagcccagcgacatcatcatccccttacggactacagagaacaactactgcccccactatgagaaggtgagtggggactacgggcatcctgtctacatcgtccaggagatgccccctcagagcccggcgaacatctactacaaggtttgaaggcccagcatggcctcaggccccacaggacacatggcctggatcggccgctctcttctcccccacacccctgcccttgccagctgtgcccacctttgtatttagttttgtagtttcttggcttttataatcccctttttcttgccccctgggcttcggaggggggtgcttgtgcccccaatccccatgctcttgtgccttccccctctggccaggcctctgggctccgtgggggtgccctttctaggagggcagggttggacactgacggactgcaggcagggaggtagccccctggccctgccccctcctcatcccttcacccatccccaggactgctcgtccactatcatcactgtttttaatgcttttgtgttgattttttttaaagctgtcaactcattttcatctgtttttttttttttgagaaaaaaaaatgggaaaatgtacaaggcagccccttcccaggctttctgagcctggcctgacccagtctaagagggcctggggcaggatgtggccagccaggaaacataggatggcatttcttttatagactccttagtagttcaggggagtgggggagggtaggccagggctatttctgcccaccgaggagagaagagcgccaccctcctttttggaccctcatgagacaatgctgttcctagcagtggggtagtgactaccacccttctaccaaaaaaaaaaaaaaatcccttccttgtgggattcttgggcatctcctgcctccttcactctcacggtaattaatgtcttaattggctgttgcctggggaacaggagagctgctgcaggcagatgacctcatggggggtggagggaggtgaggtgcccaggtggctatttgccctgcagagctgggagttccccccaccaccaccaccctgttctctccttatctttggcatctttggttcaaggtggagatcttaagcgggtgtaaggccaggcggcctgctccttccctgggttctagtacaaagcacacacaccccccactcactcaatatggctcccactgtccccccaccccaccccccgccccgagtttggagctggggcctggaaagaggaagaggctgcttggggctgggccagcctgcagtgcactttgaccccagctccttggcagcacggctgctaacagactgccactcaactgtgcctcgcaggcactcccagggctgccatggaaggagctgggccttacaccacccacctccacactgcctcctggccagctgcccaccccggtgccaggtgggagagggagcaaaacagccagccccttccaggtggcagtcggaagggatttttgtttttgattctgttgccatttgtgtaaatactagtcttttttggaagaaataatgtaaagatgttttgtataaactctgaattattttcttgttgcttttttcttagaaaaaaaatgagaac

SEQ ID NO: 563 - DNA, 12920 bp, mus musculus; identical to SEQ ID NO: 562

SEQ ID NO: 564 - DNA, 125 bp, mus musculus
ggaacttccttctcatcatgcaccatgaatgcccttcaagagtcacaaatgtacacagccataagcccatgcactgtgtactgcaggcaagactgcagacaatgttctcactaagggcatggcta

SEQ ID NO: 565 - DNA, 38467 bp, mus musculus
agaccacaaggctcggggattgcaccgcaacagtcctgcctgcgtgtcagcaccgtgtgggagcagcagcctgggtaagaggagctgcgaggcgtcctaccagacttgagggtttagacagacctggcctggcgtttaggcccagctctgtgatttttgctagagaaaccccgcctcctcaaagcgccctctgctcaacgcctttgcgaattgataatgatggacggtagcccctcgagtttctgcaaggcccactggcccggtggatgtgcaaaagctttgcaagctttcaactgccactcactctggtctggcaaagctgcatatgcacacacgacctctgggtaaccagaggaggtaactctggccgggttttggggggtgaggggagacaggttgctcggggtggggggcagtggcaactgcgggcgtccgcagcaacctttcctgctctgctgacctgcaggttctgaggcctgtgggcaggaatgcggttccacaaagccgcccacctcgcccggccggccgaaccacgaagacgctagaagggcggtggacagagggacgggggtgggggggggtggggggggtgggggggcaggcctctggccttttctctgggaagaatctccttccaaaagtgtcccgcctagaacccaggatttccatttcaatgctccctggcaagctgccctcctccaaactcggctaaaggctcgcggaaaagcctttaaaaacacactaattacaaacaattcctgggcctctccccatttccctccacgcggctggggggggcggggcgggccgagcgcccaggggtcatttacatgcgcctgtcaccgcgccgcagtgaaagcccgcgccagcagccacacgctgaccccagtaggccaggggcttgagctcttgtttccttccgggtccttgaaagcctcccgggaccgccatggcggtggtggccactgtggtgggtggagctgcgggagtctagggcaggcacctggacaaatgcatcctgactcccgggggcctgttgtaggtaaatgactccagaacaggtcctcaggcatcacctgccttcagtggcctggattccagctgtgggccctcaaccctggtctccttgccttggaggctccaggaagtaggccactctgccttggtgcaacagagctgtgggtgaggatggattctgcgcagcctcttacctctgactctacagggatacaatgaggcttctttctctgagctggccaagaccaacaaaaccctttctgaaaggttctggattgttctagcctaatctggaggagtctcgggggcgcgggagagggggagatcttggataaagtcatgcttgctcacagtaacccctctaggcagggcccctcaggacgggtatggaggataaatgctagcttattgttcatgaaaggaatgtgagaccttgggagaagaacactagctcaggcctctcaagcctttggctgatagaatgatgctcagactatatatactctgtgcctggagccagttaaatattcactcatgtaatcttttaatcagcctcatgctgaagaaacatatgctcagagaagtcaagtcccttgtcaaagattacaaactggtaggttaagaaaccaagtttgcatctcaaacgaataggcagagatgaataagtggaggacattcaatgtccccttctagcctccatacctgggaaagaaagatggggagaggggtggaaatatttaaaataaacaaccttggaacccagatggcttcagagtctttatcactgtgcccccaagatcaaatctaagagattaatgactgtcatttattagtgcctactgattcatgtgtccgccattttacacacatactctcatgtttacatcgattctacaaggcagaccagattgtctcagtctgatagaagaggatcatagaggtatggagggatattcgacttttttcaaggccttctagttaataagcaacagagatgtctgatgttggctctgcattgagtaactctactaaatgaagcatcaagcactccacttctaccatctcttgtgaggcttgagctagatgtaaaagtgagtggagtgtctctctctgcagagctcatggccaaccttacctcatttccatccctctttctctggggaacaacccccccccccagtcctcatctcatcaggctcctagctggaaggaagggagtggggtcttgtcaaagactttctgtgctgagtaagggttggattttcagctctgatagtgtcactgtcctagctgagccatggttactccgtcccaggtgcacacaactgatcaaagaacaaaataaagatggaagagcaccttggaaaccctggaggactacacagaggtgaatgggtactctggagatgaaggcttccatccctagcattctggcatgacctcattacacatgtgtctgccacatgcgttggcaccactactgaaatacacataccagcattggtaggcttcaaacagatgggtgggagggcattgtccttgcccctgagttgtgtctcctctagccagccagcccatacaaagctcctctactccttcctttcagggcaatgtttccaaacttgctccccacctaggcagttaggagaaggagaaacatcacctggttggaatcctgtagacttcgttacctttgttaaactgttgtttcctttcaagtgctgggaagaaggtacatcttgagaggtactgccccactgagctattgggcagttccaaatttggatttagttaagtttaagcatcatgcagatttctagcttgtgtgatcttaaggaaattccttcatctctcaaatgacagcaacaatggtgtcattttacctggctagttggagagtcagatgaaaaaaaatcacaatatgagatgcagatgcaaaagtaagaaaaccaatactccccatttctcagagtaggggagctgggactggaactcagtcccttgtgcacactaagcactttatcactgagctgcacacctagctgagcagttatcttgatatcaagtagcaagagaagagaggcaaacaataggcagagggtgtcagctgtgacaagtcagtcagccctctggacccccagaacagaggcactgctcataatctcagaggttgaggtaccttcacaaagatggtgcttcaagcaagaattgtagctgatacatatacagcatttcttaaattgattttttaaaaaaaaggtttctttattattatatctaagtacactgtagctgtcttcagatgcaccaaaagagggcgtcatatctcattacggatggttgtgagccaccatgtggttgctggcatttgaactcaggaccttcggaagagcagttggtgctcttaaccactgagccatctctccaggccttaaattgatttttaaatttatatttagtcgtgtgtatgcatgtatgtctctgtgtgggtatatgcacatgtgcgactgcctatagacagcagagatatcagaccccagggagctggagatataggcagttgtaagccacatgatgtgggtgctggaaactgaactcgagtcttctgcatgagtaacccatgttcttaaactctgaggcatctctctagaacccttctgttaatattcatcatttgctgttccaatgcttcaaaacttgatcaaatttagtctcgtataagagaaacttggtattatgggataactggttctagccccattttacagatacaaagcactgaagtcatcatcctagctacttaatcaggcccctaagaacacattcttccccccccacctctctctttacacatttatttattgtgtgtgcaatgcatgcacatgtgtgccacactatatgtggaagtgagaagacaacttgcaggcattagttctttccttcttggtgataaaattcaagttgtcaggtttggctgtgaatgtctttacccactgagccctttcatcagcccagcacactcttttgttggtaggtcagactggtctcaaattcatgttcctcctgttttagctgccagagttttggggctataattgtgtattaccctgccatctaggaactcagagaaaatttacctataatttgtcttcttcttcttcttcttcttcttcttcttcttcttcttcttcttcttcttcttcttcttcttcttcttttcttctccttctccttctcctcctcctccttcctcttccttcttcctcttccttcttcctcttcctcttcctctttttctcctcctccttctcttcctctcctcttcttcttcttcttcttcttcttcttcttcttcttcttcttcttcttcttcttcttcctttttgcatcactgagagaggaactcagaactagagccttgcagcatctagacaaaggaagacccctttaaccattgagctgcatccatccccagcccagacttttaaccatcctctgatcccagatgcctgtgtttgtagatgtttaccaatggaagtggatgccaagtgtggcatgtgacttgagctcaggagtcttgctggggttaggggatgagccaggtgagttgggggttggaacctaatggccaatctgccaggcttgggaacttggctatgactctagaggcaatggagagtcaccagcaggttttcagtggggaagagcacacagaaaaggtcttaactgcctgtggtgtggaggctgctcagcagaggacgcactctggtggcagagaaatgataaaggcagcatttgtatggaatgcttgggatggattccagagctattaaggaggattgcattggcaggacatggtaattaattagatgggagaggcaagagaaagggaagagagaaggtttctagctagaagcctgggtggattggtggggtgagatcctgcccctaagagaaatgaaactagtatgttcaaatggtactgttggttcgatttgaggagaggcaagtttaacgcacctcaatacatgtctatgcaggctgaagcttagaggagtgagtccaggttgaggtgacacaggagtcagtggctgaggaggtggtggaagccacgggcatggttgagagtatcaagcaggggaacatcgatagggtggcacattttgaaaaggtacttggaggaccccagccttggaggagcttgctgaggaagggcctgcgaatgtgagagaaagattatgtaaagtagggagccgtaagtagagaggtaaggattcggaaatggagtgccatgaagcaggagccagtcaggcataccaaatgtagctgagaattttctggtttgcttgctataattaggtctctgcatcctcagagagaagagggggtgctgatgtagtcagggagactgacggtaatggtctggggaagccaacagcaagtagaaaagcctacaagtccaatgagaccctaggaaaaggagaacaaaatgccagctagggggagacactaggtcacaggggaagctgagcttggctaatggaaaccttagtctcttcctcctggctattttttttctccctgcctctcctcctaacccctaaacttgggtctctgccctgggcatgctggggtttgttaatgcctttcaaagtgccgggttctccacctctcctccggctccctcatgtcttccagcagaaacctcccttccttggctctggactaagcccctcagagagctgatgagatagcaattaggccagttgcaacggccatgcgttcacatctctgtgccagggcaggcctgctggcactctgccaaactcttctggggccagcctcattgcatggtctctttcctgcatgacccccaccgccactgccatccatgaaggggcatccacaggaataaaggctaggcagcccaccctaacccccaacccccaactcctgcccccagccccgagacaagagttgagtggctagccattcacaaaagacaggtataaactctccaggcctgaggaccaagccagtacccaccagctaaagggcattgagggaaaggactagggtaggggtgagcccacgttcttgccctttgcatcttatgtgactcaagatgctttccctttcccaggctgctgtgtttccccctccacaaagcttctaggggatgccaggccctcaggagaaatctacctttgttgggctgagtctttggggcttgcctgctgagttctgtggttgcaagggcctgattttccataggcttttagaccttggtcacaaagatttcatagtcctgctagtcctccatctcacatctctacccaaactatagcacattctctcttccactttcacgtgtgtacttgctgtgaccagtccctggctttgatctcagcctctccaagcttgatggatcctggagctaccataaaatgttcatctatcacaacagtgcttggcagaagaaagaacacaaatactggagttgactcttaattttacagtgaaccatctcccatctttcccctaggactgcatggccgcttgtgtgtgaggagacgcgaaggagggacagagatgccggagatcagccccactctcccacagcaccaccatctgggggaagtcccagtgtcaacctggaagactggttgaagtagcaggaggagggggaagggaaaggaagcagaaccagagatgtaccactgtgggtaagagatggtaacaggctttaggagtggaaaggaggaagcactgggagaagcacatagaatgactcagtgtttttgagaaaagggactgggcacctgtcctggcacagatgggactgtagaagtatgggaaagacatccttggggtgggagtagaaaagcagggatgtgtgtgtgtgtgtgtgtgtgtgtgtgcgcgcgcgtgcgcgctgcagctggagggcaggaatcaacagttgcttgtggcttacctggcagagatggaatttgaagtgggttgggcagagctaggctattaactggtaccagaggtttgaaactgtcttcgcttctgtaaactgggtataataacatgtgctttataggcttgctgtgtgggagaaatggcagcatgcctatacaagggccttgaacataccaaggtctatgcccatgggaaagattgctgttaggacccttggtctggtcccagattcaaagctaccaccattaggttccactagccagcagtccttgcccagcttctaaccactacttgtttaccatctcccagggaatgcctggcaggcagaactcaggcctgacttctttctgtatgttcaggtgtggggatcaggaaagctccaacgatcaacattcaagtgtattcacatatgcaggtaaaaaagggcaccaaagaatcatggacaaaagtcccaagagccatgcttagagatttgtggaaagcagatatgtcctcaagtaggcctcattcatgaaggcccctaatatatcttcttctcttgtgtgcattcaggtgcatcccttaccacaggaatagcacttttccagtttcttctagcaaagtgttaaactcaatacaacctgatcaagtttacagcccaaataggagtgatgctcagagactccctgcacaggtaggaaactacagtgggcacatgcttttcctagaacatgcccttggctccatagcacacatgagcccccctcggctgggtaacttctgctctacattggacactacaagtcatctgtttaaccttgggaaaggctcacagaactggtcactcactgggaggccaatcatgtgggatgttgggggatgggagatgaggtgggggagttggggcgtgttacatttgaggagcaaggggaaacctgatcaaaaccatgtcacaaagaaaaagggggtgggggaagagagagagagagagagagagagagagagagagagagagagagagagagaggtttccattcacaaagaaatcattatggttaatttaattcattgtagcgtttaatacagaaaagcttttctacagagactgggcatcaggccaacatttatatataaatgggttttattttaaaagggaatgcagtgagggggataggctcaagttggccttctcactccctctctccttccctcctttcctttatctacctttctgtgcctgggtagaccaggaattgggtactacctacttgtcactcctaagttccagcgtttctttttctaagctctttcccctgggaccatgggggacccctggctgagcctagttcagaggatcactgactgttctccacaggacagaacttaagagatcaattctacttttcttgtcctcatgcaggacaggccccacctcttgtatacaagaggacaccaaggcaccgaattgtatgacctacacactgcttgattagtggtaatgggagaacttgaacctgggccttctgattctcattgtgacactgtagatttggtgtctttgacctggcggttcctcagctctggtggcctggctctgttcttctgtgcctgacttgggcccagatcttctctgccaggctgcagaggaaatgactcccctcccataacttgcagtcctccagcaagctaatcagctaattcacactgtggtgtcaatggcaaataataacttactgtaaagtgctaatggtgtaatttcaggctctcctggctggttggaggctggaaaagagctgtggggatagggagacttttttttttaagttcatcatattatgttatgaattcgcttatcccgtgccctcccgtgccctcccgtgccctgtgctatcacataagcatgtgatgtccattggtctggaatcacagcctactgaagaacacagtcccatgggctgtgtgacacctgctctcaaaagcacacttctgaggacacacccagacttacctgacttcattttcttttcaggctctagcttcagcagcaaggactgtttcagccagggtctgcctttggcaggaggaggaggtagcatggacctccaagtgggaggcatgacactccagctacttggcctccttttccttcatgctaccatgtaccatgctccaactcccagggccaaaccccacgtttcctcccaaggcaggatacccacacatacttccattggagggattgtgacaagggaggcccagagaactggaatggcttgctcaaggtcatgccttaagacatggagttggagttgacgttcatgtcttatgacacttggccttgaggctgacaaaaccctgtctcagcagagtagtggattctcaggagaccataaggcttatgactctaaacatatgcaacaacctctccatgggtttcacagctacttactaatcaactctacgaggcaagtggccagtagcccccagcagtcaacattaggaccaagcacggactcagagttcagaggcctcactgcgctcttgcccccacacccacactagaattatcagggctgacacaggcgtccaggccctcaggaaaggtcctgtgtgtccctaggtttccttgtagcctggctggtatttggggtatttggggttcaagcccagcagaatcccacatctggatccccttagctctccgcgttctttcttggctgagaagaatgtattcaatgccggaggagctgctggactgcggacttgctgcccggactggctatcaaagcagagaggcagcgggcctctggggaggggcttcatgggccctccatcatcgagcaggcccgcccgcccgccgccggtagctccagggtggagcaggggcctttcagcaggcactcggcagtgcggctgcaaaagagccagccaaactgtcgggtgcagcccggacaggcccgctgcttctgattagtggctcactctctgctcctgccccaccaacctgcctttcacccccatccctgccagaactgtcgcagccaccgtgtgcccccacgaccaaagtagtggatagggaacaggcttttcgagctgacctctgcagacccttgaaaaaaactcagacatttgatttctctcttctcaatcttcatttgctctgccttcgagttccctctgaagagttccaaccacaactagccttagtgagaagcagttattaaaaaataatactaaggcatgtgcagtcttttatactgcagcgtagtggttaaggggaaaggttttggagccaggcagcctcggtttaaagccagttttgtcacttattaactctgggctccaggtctcccccacatcccattttgaaagtgccaaaacaataggccaccaggtcccagacttgtcttgagacttaagtgagttaatactatagagggtttatgcccagcaccgtgagcacccaataaattcttagtgttccaaaatttgtttccatcccttgactcatttgagcctctagcaaacctggtccgtagaggctgtaatggaaaagaggtcacatagtgaggagaagcaaggttggggcttgtcctcggcaggtctctcttccctgttcccttgcactgtgttgtcctggcactacctaccgcacatcaagcaactgccaaaggcgaagaacttttctccaggctataggttggttttttgttttgtttttttttcttttagtgtggaggccaaatcacagatttcaaagtgggaggccagagaactgataatccttccaggctggagcttcaccatcgtacatcgtgtggcccttgaaggagcagcccagactcccctagggctctcattatggtggcccctaaggtgcgtgcttctcagatttaaaatctccctagtggaggcaagaagccaggcatccacaaagtagcctatagcctagaaaaggcttgcttctggtacccgtgcccttacagttgaagggacaccttcattgatcagaaattcctaccaaagaaggagtagtgcaagagaaggtaagggccagccctttaggctaaaggcacttccatgtcctaggtaccccaactaaccgcctgcagccctcttctactctagtgctgcactgctgcagggctggggcggggcttaggatggcacagaaaagcatgtgtgtgtgagcccctgctctcttcctgcaggctgcagccaagggatctgtgccagcttcacagggagctggcaggaaagcctctagggaatgtgaccacagctcaccctgcctttgccacaggccagctggcccaaaggccacacgcaccctttctaaattgagcccagagattgctgagggttgagttctttagctgggagagaggagacccaaaaaaatgctgctgtggcccagagcagcctactcccggagtggcagtgaggcacagcagtgaggcacggacttctctcactcagtgggtggggaaaggaggagggcagaggctaatccagattcctcctgccacctgggaagtgacaggcaagactccagattccaatctgcgtgcatggaggtgcatacctatgtcttggggctcgaagtggaggcaaaggccgtgccttgtaagagctgttaaaggtgggaactgcactgaacttgcacccgtatttcctagcaggtcctgtgcaaccgttactagatggatggtaagtattaggcactgtggtatgcatggcagcgctgatgtcctgaccaggctgtgtcctttacaagtcagactttgtgcttgtcttctgttccacaaagccttttacattctctggtttctacccaccttcaagtctgagtctgtttgacccactagttccatgagccatgggacaaattcctaggtagctcaagttagttcaagttggggttttgcgtgtgtggttggagccctacatcaaatgctatcagactgtggaagcaggaggcttgccctgtggctcccctattccctcttagggattcacatgtgtgcatagaatgcacatgtgcacatgcgccatatacatgcaaatacatgtacttactattagctcctgacttgtctcactaaagccttcagtgcagaagagaccctgaattgactggcaggaggaaaaaagctggctggtgtggaggcagaggttggaacaggatgaattctggaggctccaattaactgaaagctacccttggcaaacaagtgactagccccagcaagggcctggccccactgggaactcatttttacctcttgcccatagttcttccattgttggaccaagaagactagttcagtatggagccacaggccaaacctgtaggccagggctgacaggacactacaaatacaacacacacacacacacacacacacacacacacacacacacacactgcttttattttcatgaatgggaccttactccatgcataatcatgttttcctgacaatgttaacataacagcaaatgcggaacacccttccacactgcacatgtggctaccttactcctttgaatggccatcttgtattccactgctctgagtcatgttgagacccagccccctcacaaaggctggttaggctgtgtataactacagtgtatgaagaaatgtttcactgttaaaaagagactgccgtgctaaatgtttacatggcatcttcctactctgtccctctacctggacgatcagttctcagagggtgggctctggcttacaggcagagaaagccattgcagatcccagcaccacccttccaaggttttaagcccagagctgccttcctggtcaggcccaccgcagaggggtaagtcctggcatagctgagccaacatatcctgcagcctcaccctctacatccagctggacaggctcctgaaaaggatatttggctaacacctccatatggctctggaacctgtattgcctccagtctggggtccctcttttctacccccatttgcctggcagagaccagggtagcagcttccttctcccagagatgcacaccttcagaaagcacgtctaggcacagataatagaatccccaaagcttgcaaagtccactggcagcaccttttggacacgggtggagtgaggccagaagctggggattttccttaatagcaacttggcgccccaactcattggcagctctgcctgcctgccagcctgccccccacactcctggaggaaccttcatcttcaaagcttttggggaaacagttaattaacactcacagccctactgcctgcctggcctgcctgcctgcccgcccagaaggctatgtttctcttagctccataggattgggggttggcaaagaaaccaatgtctagagcaaaaggcatggagctggaaccagagtgacagcccgtgggaaggccaaagctagcccagactgcatatggactagatgtgcaaaagcttaccttccaatacaagtataaaactgcctgggactcagaggtctcatctttaaaataggagctgcatgtcagaattcctatgagacagaagaggggtgcatgccctgggaactgtgtgttcaaatgtggtgtggatggaattgtgggtgtctggggagctgcttcaggcaggtcactgaaggaaagaggtctgaggggctctgtgcgaagggattgctactggctttggaaaaatggagagaggagggaggtgggcaccttgctccttggtactaactttctgtctgtctgtctgtctgtctgtctgtctgtctcacatgcacagagggaggaagagagagagagagaagaaagaactcatccgtacatgtgtgcatacagacatgttcttgaacaaatacaccaaacttagccaggtgtaccacagctgcctgcatagctgtcctacacgaagatgttcacatttaggtgttcagaatgcagggaacccagggaagtatagctggggattggatggtaagtccagtgccaaatgaagcagcctccttcagtagcctatctttctgctcttttttttttttttttctgaagggctccagtaccctctgtttctaagggcaagcctcacagctcccatctgcctaccatctcatttaatgattcctcatgctctgtgtcttctgtaagcctagatgctcaccgcgtacagcgaaaggatcctgttgtactgtggtccccagccccagccccagctagcatgcactgcgttttgtcatgttgtgggattcccatcttcgcatcaaagaagaaagtcgacgtcgccttccacacagggaaactgaggttgagactgaggaagctatttgcccaatgtcacacagttacagtgaaggtgaaggaaagctaggaagccaaaagaggacaccactcccctgcacactgctttgccgctaggtgctttcaggggtccccctgtgttgctgggcaggggctgggttagggtagagcctattctttgggttctggtagaggtagctacagtctgacttgaaggactccgagaccttcacatgcctacatccatttcagcccatctgtgtgagaacttgagggaagtcaccagtttgcacctcaggagaggcagcactgactagaaagaagaaaggcagaaagcagggggggggggcaggctagactgggagctgttggtgttctaaccaatacactctccagccttctccttaggtgtgggcaggagacggggaagtctggcgcctggtaggaggggcagccaggtgaatagccctcccctagcaggaggaggggctgggagtccagagggggaggcttgtttctctggaagggaaaccttcaaacactaattggtagttgcaagtaattaaagtaatttactaagattataaagaaatttcttaagagtgattaagcaactccggctgtgtatagctgttggtaatcacttccccagggggggttagtgcacttggcagggtgtcacagggatgctcacacccgatgggtcctgattccttggcagggggtgggtcacagaggctgcagggtatgttgagagactgctgagactctccacaggagacagagataggtctgaatgaagatggagttctgcttgttccaggacccctcagaggctcaggcgtacctgggtccattcttgcatgagctctgcattgacttctcattccagacaccacccatatattaagacacagcagagagagactgccaccaccatggccttgccacacagctacttgtatactcctgggcacctacataattcatagaggcatagatattgatacagccctttgtaccacgctcagccatacccagacactggatagatgaactcagatggttccaggcatgcatatacacagttacatatgtacctagacacagacatatttacataaggaagtgtacatccatacacacagtgccacatgtggatagacattcatatctagtcatatatgtccaggggtctatctcgacctctcttaagcacaatggaaacttgacttggatactcaactcagccgtcatgcattcaaactcaaccatatctaaacaaatcttgtacacaccatcgccactatctgcttgtcccgctaacttgaaagctgcctcccaagtcctcagaatcctcaaaggtgaccaagttagagcctgtgtgttctatggaacactgtcctgaggatccctcacgggccactgtgatccaggccagccaggtaaactggaggtgggttgaggggccatgggaaaaggacccaggctggagttaggcatggctgcaacggctctaaggctcctctgtggcagcaggaagcatcgcaggatgaggctctaattctagaacactgttttctaggtatgtgacctttatcacgtccctttgcagttgtgacatttgctttcctagtctgtaaagtgagggtacctctgcctccttcttcccaggcaggattatcacgaggaccagaggcttggcagcagtggatgggcgtttccttcctgtgaccctcagtggatcttttgagctgctctttacctagggacaaatctctttggatagtccctatgttaaaaaaaaaaaatcatgagctgattctgatgtccttctgtggctcacccccagccactcagacccttggtcctcaaagttggcaataaaaaagcaaagttagccagaaccctccatacccccaggagccctggcatcatagctttgtacttgctggctaagcttgagggaatcccctttcccttctctgggcctcagtttccttctttgttctcctaaaggctaggcatagagaaaagggataaccttgttgattactaagcccctgccctgtactggcaaaccagggttcatgtaaatgacccacttgagtctgggcccagttgaatgatgttaatcatgatgcctattattttgccctaagagggtctctgctcccctagggccctattggtgttgatgagaggtgggggtgggagccgatcatgagggtgtcttgctgcggaatacaggagtcgcaagaacatgcataaaagagagagaatgaggttacaagcagtgtccatgaaaccatagaagaaaaggaatctgggaagggcctatgagaatggctgtctcaaccctatttccatttcaatgactaccaagggcaactgggaccctactctcttgaccctttgaggcttgccctccccccactcaccacttgtttttctgtccagagcaaccttaaagtccttaaaacacaaaagggcatgggtctgttgcaggggcagcaggcagaagggatgctgggaacaaacgccccttcccaggtggccaggggaagagcaagtgatagggctgacgggtagagagagagagagagccaagcccgctgcttgtagtttggggaagaaagaaaaatcttgtaggaaggcctgacctatgacaggcccagaccagagacgtctgactgcaaccctagccacccctcactcccccaaagacgagtctactcactatgttgatcttcattggcttatgtagattctaatacagaacacccaggtgccctgtcccatctgagggtaccaggacatctgttcactttgttcaacctgtcagtcgctctgtgagggtagagaccagtctccttgtctctcaggaaccagaccttggcaccgacagagatatccaggtggagctgcacttggaatgaaatcagacccattctcgctgacacctaagagtatagcccgaatccccattctcttcggagtcagaaaggggtctagccttgagactaacccccagccaactctggtgctcaaacctgtgctgttgagcattagaacatctccagtggctattattgcggttaggtgagtctacagcattcttttcctgtttctttctctgctagtgtcagtagcacagcttttcactgctgtgcttggacactaaggtctgtagagtattggaaagaagagttattcaaactctggcctgccgctgctgctgtgtgtgggtgggtgtgtgggtgtgaccctggataactcactccacctttccaaatgagtctcaagttcctaccaataaaatgggctcgagtagctgccttttccacagtgagtaagattaatagatttataagtaaccggtgtatgtcctgttctatacttggccttcagtgaggaataattctttctgtggccccactctatacagtcccaagtctctatcccaggacttcagaaggctcttttgcttcatcctgccttctgttcaggttttgccctgtgttgtttagcatgggattattttattccctgagagtgtctactactgtcttgaatctcaagagaagaagcctttagccagggtgagctagagtagaagataacctgttctaagagttcccacgagaggatgctgcatcttaagcttcaggttgcaggtgcctgaaatcctggcttctctcctctgcagctcccagtttcctgtccactccttcccatcccactgtcagaaaaggaagaacagctggttcccatcctcggaataataagcttgccgtgcaaatcgttttccaaaatcattaggccacaaagatcctattcagctgcagtgtttgcaccggtcccaccctcatttccctgcaagatggccacttaacagagagcgtgcacagacgtacatccaagacccagagacctcagctcagaggtctgtgcagactgtcttagagcaagaaacccaggaaaacagacaccaaggctaagggagcaggagtataggaggcatgtggaatctttgccctttcagaatagccctgagcagtgtctaacaacaggagcaaaaaccagattggcctgaagcatgccaggtgtccagccctgtgcctaggaggaacggattgaataaaaagccttctctttggggaggcttgctgcattgttgtggagacagcacacagccacacacacacacacgggggggggggggagacagagagagagaccgacagagacagaccaaggtaaattacacacgtgttctcaacaatggtgcaggagttgtctccaggcagcacaacctctgagtgcatatggagggctttattaaagaaggcagatgcacacagtgttctctccctggccaaccctgccacaactgtccaagactgcggggaagagccagcttcctatcttggctgctgagattaactgcctttgatagtctcaggacctccctactgaccaatgtctaccctggagattccccagtaaaatggctctgactgcttagcctcccacttaaggatgttttggtgcacacagtgggtaagatgttggggaggctgtcatcactgagcaatgttcaaagggaggtagaggaaccaccgatagtcttgaaatgcctattgggatggttgcaggaacattgtagaatgctttgaaaactagagattatttgaccattttctaggtgaagagccttggtatagtagaagcatgagcaaggggcacaatttcaggaagtgactatactcagtgtcatcaccaacaacttaacaaaagccaccaccactgtttttcccagcaacagtttacacattcatcttaccatgatcaccaacaaccatcaacattgacagccgtgcaattcctacccatcaccatcccctccgctaccgtctctggaatggattgacttacttatagatgtaaagggctaaagttgtagctgagtggccaagccctgggttaaatctttgcagcagggatggggtggggtgggtggggtgaggtggggtggggtgaggtggggtggggtgagggagttggggacgtaagggaaagagtctaatttagctttcccaggtgtgttgatatacctgtaattgcagcagtctgaaggcacgggcagaagagccatgggtttgacttttgaagatcttgtcttaaagaaaaaggacataatatataaaaccaagtataatggcacatatcttaatcccaccacttgggaggcagagacaggcagatctcgaggccagcctggtctattgagtgagtttcaggacagccaaggctacacagagaaagcttatttttttgttttgttttgttttgttttttgtttttcgagacagggtttctctgtatagctgtggctgtcctaggactcactttgtagaccaggctggcctcgaactcagaaatccgcctgcctctgcctcccgagtgctgggattaaaggcgtgcaccaccaccacccagagagaaagcctatcttgaaaagcaagcaagcaagcaaacaaacgatgataatgatgatgactatgatgatgatgatgatgatagtaatataaaacaaaaaatttaaagccaatattacccttgttctccatttgatgagagttggtatatttatcccttacttctagtcaaaggctgatacactaacatagctgtgtgtactggaacccaccctgaacagtctgcatacctgtctagccatggccatgtgtgggaacctctctattcaggttaggtagggccacagctctgccaaggccaagggtgctctgggcctgacatggttcaagttctgattttcttggttggtgtgggaactgcacccatgacatctcttcagcaagctgtccccaccaaagctagccatcccactaaaggccaggagagggctagtgaaaggaggcacacatggaaaggaaatgaagagagtaggcagggcaatgagctgtagctcgggcctgggggtggccatccatgaagccttgaagttttcttgctctcatggctcccaggaagacttgtgcccacatgtccatagagaggaggtgactcatgccaggctccagggcaaggtgtgagaggcggcctaggacatgcccttctgtctctcaaagactaatagggtgtgtgagtatgtgaatgtgtttgatgtgtgtgtgtgtgagagagagagagagagagagagagagagagggagagagagagagagagagagatgagggggatatgtatcttttgttctctgagaacatgttctctgagtgctgggatagggcaagtcagttttggtctgaggagcatatgggctccagcttgccctgcctcacccccccccccagaaagtattgcaacctgaaggcacattttagtactcttctcttcccagatagcagctctggcttctgctccttggcctgcaccccatcgattcagttatgcactaaggcatggccattcactgtttctatgaatggaaaggggcctcggggatgcttcgagccctcgggtacaaagagctcccttcctgtgtctgctggatgccagtgagagctcaggccagggctgactgttaaatccccgaccttactgagaagattcctgtttcaaaagtgggcagaagatgaaatatcattggccacgatttggtactcaaatgaagtatgggtcaagtgtggataggggtggggtgtcatgaaacgaattcgctaataaaatgttaaagtgaaatacacacacacacaccgcaacagcacatatgtgtggagctgaaaccatacttgctagtggtccccacccacagattcctgatatgccttctcagaccatacaaaccacccttgttccccacaccctgtgctcgccttcagctattaggacacaagtagaggttttggcatcaagcaaagctgtgctctggatggattctgccacttcttaggtgtgtgatcacaggcaaggtacctttttagtcaaatgagagtggccccccttccctccgggcttttggggggagggagctgcatgggtaacgccccttccttccatacctggcacaggaggagcactcagtctgcttgtgcagctacagagtgttaagtgttgctcctttgggccaaggctcatgagtctttttggaagagaaaagtgtcccttatttgtcctcctatttctcacaaacagtacttccttaacccaggggacttctccttggctgttcatcaatgtgccttggcaaatgtgggccgatgttctggacgggtggggtacagtaagctattacctcctcgcatctggggacaggatttttatgcagacagctcaggatttcattagtttgcttagctaccacgtcacactgctggcttctgagaagtctgtggtcaacagaaagcccttggtcttttttgacacatagtcttataatgttatactcctgcagcctgtatttgggaagctgggttttgaatcttcaagcaaggtttaacatatgctcctactcagtttgatctggctggctgatttgggctccctggttccagtctatggagatccctcccccctaattttttatttcaacctattagctgtcctttgtgtccagagcatggagtctctggagatttagtggtgatcagactttctgtggcctcttccacatcaccagcaaccttctgtgtaggatggtacagaggcctggggctctctggaagcttccaaccaactctgtcttggttgacatcagtcaagtctctttactttgagctcttcagcaactcaccacatctaagcaatgccagctcacaagaacacagtgatagtccttgtcacaagctgtgctaaactccagacatagccacacaataaaatgtcagtgtagttacaaatgtaaatggggccaagctggcccaaacaagaatccattacttggggctggagagatggctcagtggttaatagcattgactgctcttccagtggtcctgagttcacttctcagcaaccatctgtaataggatccgatgccctcttctggtgtgtctgaagtcagctacagtgcactcctatacataaaataaataaatctacaagccatcttgtcagccctcacattttattttaagtcaaggtttttcctatatagaactcactctgtaacctaggctggcctctaactctctatcttcctgcctcagcctcccaactgctagtatgtgcctttctgaaaccgacattgactccagcatcacccaggtcctgacttactagcctctttttgcaccttggtaccctctttccttagagacagctctatcagggacaaaggtcttgggggaagctttggaccatgctttctttcccatccctgagctaccagccagcttctcctctggcctttcttggaatcatgtgatgctctagcaacctgacagtggctctccctatctgtatattttctttgatacagtctctcctctctctgaagctcaagctgtccacgaatttacatcaatcttcttgcctttgcctggagtcatatgattatgggtatgagcaaccatacctggcctgtctcttgatttcattactgtctgacctctcgcagtaatgataagcagtttgatgaagcttccttttcagtcagggtcttgctatgtaacccaagctggtttttacttctatcctctacctcagttccctcctggcatgtgtgtgccaacactcttgatttcgagacacttttttctttccattttatgtacacatatgtgtacactgagttttgataaaaatgggactatgcacacacacacacacatacacacattgtttttattgtgggttgtaatgcaaaaacaaaatggttcaaagtactattctatagtctagttgttggactttgatccagccccttctgccctttggccctcttttctcttgatggggaagttggattgtaatctttcctcctgcattcaaggggtatttcaggaagccctttgaacatagagatatgctgtgtacacagaagccactgtgcatgctgcacacacagaacttaccccagacggtctgcatagaggaggcatccttttaatggtgcacgtttccccttctttctctttcttccctaggaactcacagccaccgccatccatccggatgacaccatggtgtctccattgtgggaatcacgggctacaaatgggaacactcaatttggaagctcctaacaagtttctagagggcagaaaataaagaatagcattctggataggatgtacatggactgcctcctttttgtccaggggcttggataggtttcccttccctccccttgcctcccctctctctcctctcaccttcttttctttcttcctttcccattcaacagacggatagcttgcagaggtgctgtgctgtagtgagtagagagggcacactgtatggagataccttgcagaggtagttggcccttggatgtggacatactggtatcggggtccttctctcaactttgtatccacctgggtggcagagacttatttctcagtagcgccaacctcaggcacctcatgtgtgaatagacccgatgaactcttcctttgcggaaccattctgaggtacctcttagctgtcacatggaaatgaccagtgcaagaaagagctaactagcctggtgtcacagctattatcagaacactcaaggctttgaggcaggaggattgcaaattttaggctagcctggaataaataatgaagctttgtctcagatacccccacccccatccaaaagaaaagaaaagaaaaaagaaaagaaaaagaaaaaaagagaaaaagaaagagaaaaaggaaagaaaagatgatggcccctctgcgctcctgggagcccctgcccacacattcctagtttagccccagggaagcataggagatctgccaacatgtgtagatgtgcatgcatgtctgcgtgtgtgtgtgtgtgtgtgtgtgtgtgtgtgtgtgtggtttgtttatataaatgaaggacggtgcttaaggggatctgtttctagcttccttaggggagagggccctcatccactttctttttccaggccaacatttcatctcaaaacacaggtacattgtttctatttttgagctttcgtttccacaactgtcttaacaggctcagtgtctggtcttttgtgccaagaccctgggcagagagtagaagtgagtgagcatgaggccacagtactggcccttggcctctggccctctgtgggtgggattcctgtgtggccttgcctctgatctaagcacctgaggctcccagagagacaggaggagacctgcttaggagggtgggctcctgctcccaccccctagctgccaaacaaccttgaggcaatatgtgtggccggacaatcaggcccaggcctgggaatagcagcacaagtttacagactcaatcccattagagatggaagagacccaagttggcccatggccccactgggtggagggcagcaaatggccagtggcttgcctgctccttgggaggggtctgggtaggaggccagtgcctcagcaagatggagctgacactgaggccctctgcagccggacaaggggacaaggcagcgatccagggccctgcttcctggtgtagctagcctgcctcttccagcccagttcccaaggtaggagtctctgcactgactggctaagctctccatttcccaccccatccatccttttttccccctgaccctgggcttcctgctcctcctcttcctcgtccttgaagcctacttggctgtttacacctcaaagatatttgtagattgctatctctggaggctgttggcctgactcatccctgagccaagccctgtctgttggcttctttaatctttctcgctcagccaatccttcctcccctttaatcgtttgttctctctccctctaaaagccctacagcaagtctggctccccacttctccaagcctgcctggtcttttcttgagaattcaagggagcccacatgctactgtctccccacgttggacccagagcaaaatggcaaaggccactgaggcttcttcaagggcttttggtcagtaattgataagtgaagtgacacccaagttgaaagtcccttttgttcttctaggtttcccttaggagaccaggagatgtcagggtggaccttgtcattccatttctgatccttcccagctcagcccatctattcacgcatcctccttgctcttcctcttgcactggctctgctactctgtccatcaaggttcttctctgctcccttcctctgtctctgcctctttcaattgcactactagtttggaaggcaccactcccacccccaccccacccccattcctacatgctatagaagacagtctgatcctgtgggcagggctctccagagaagaaaagagcctaggtacaaggacctggcccaggctttcctccaagtccagagaggcagaggtgcgaatggcttcctgatggtgacaagatgcttaggataggaacgggcctgagagtcgggcagacttgtttgcatgggaggctcattttatatatagaaacaaaaccagtctctggggatttcccactttttaaatgtctctgttccctggagctcacatcttggtgtgtcctggcttcatgcctctctgggccacggtgtctccacctatgcaatgaaaaacacttggattatagggcttcggaggttcttccagctgaacctctgtgtgacctatcagacactatcttggtcatgcctccatggaggtccctgctggggagggggaggtgctcagggtggtatctctgtgaagccttgggtatcaccatccctggccctcaggttttctcatgggtgtcttgttaggaaaggctaaagtctgtctagaaagagagctgtgggccagtggcaggttcaggcctagggactgtggcagcagcatagccccttccccttcctacccatcttctcccctcacttcctttcccttctctcctcccgtgctcctcaggaacactcagtgcctcagcagctagcagctttaaagccacacagagggcagggcagagagcaagggagaaaaggacagagggggaagataggcaagcagagacaccaagggaggtagagacaataaaggacacatagatagggatctagaggacatgctggcagagaggcagacagaaaggggtgtgtagacaagaagaaaggacaacgattacacagagagagggcagggagagacagatgggtttcaaagacccaaaggtgactgagccaggcataaagagagccaaagcaaaaagactgatgaaggaaagttggtggagacctagtctgggaaggaagaagagaacaaaggaaggaaggaaggaaggaaggaaggaaggaaggaaggaaggaaggaaggaaggaaaaaaggaaggagctaaggagggaagggagggagggagggagggagggagggagggaaggagggaaggaagggaggaagggaggaagggaggaaggaaagaaggaaggaaggaaggaaggaaggaaggaaggaaggaaaaaaggaaggagctaaggagggaagggagggagggagggagggaaggagggaaggaagggaggaagggaggaaaggaggaaggaaagaaggaaggaaggaaggaaggaaggaaggaaggaaggaaggaagggaggatcgagctgttagcttagggcttagccagtgctgagcctgtgagcctgcaggctgacacagcacattctcccggcaccccctgcctccattgcttgccttctgctttgctccctgactccttatcactgggccctccctccactgagaaagaggccctgtcctttttgtgtcctgctgtcattctaggctaagcttagctgatgctcctagcactttccccagcccttctttgactcagcaacaaccctggtactcaggtggggaggcagcaggtgcccaccccagggagaaagggcagcttcccaacttctcagcagcccagagagaagtggggggtttgggaggtagccagtgcctgcctcactggcttgcaaactcctgtagattgctgtcatctcctggagagattgccaggatcccaggggcctgaagttctgagctaggacttaggcatgagcccaggattgtggttcactgctgaagtcagcccgacctgagtgtgtggtggctccagggggctggctgctcttaattcctaaatggaagcagatcccctttcccccaaaccatccttgatgatgatggtcagagatggataggctgtcatctgaagaaactgagagggttccagggggacaaggtagaccagcagcgactgtaatgaacaggcttcacagggcgggcttgcttcctggagagccccctgggcagtttgggaagtttggctttggaaggcaagggacaaggcaaaggtgtcacgtggccgctctaggctgcttcctgagactttaggaataagggccatggagcctgtgccaggtcaaaaggaagaggagagaggaaaaaaagagtacagactggcctctgttctgaaaacatttctgagtgagtcacgctgaatttctgctgctcctgcactgagggagttagctgccctgaagaagagaccagctcccaccctgggagggtcagaaggaactagagctgttgatactggatgagaggaaactgggggaaagggtgggaagtatgctctccatcgttagaaatagaaaaggctgtcgcagagcagaaaccttactaaatctttgagctgggtgatttttatccagggccaaccaacctggagatggggcctctgcaagcaaagccaaacccccagatcttatcaagtgctctctcctccattctgattgccccccccccgccccccagcttggagcatttcaaatgcagacttgatggaaggaagaagttacagggaggggggttctgatcaaggaattctctctctgacaagtaggatgggttaagaaactaaaggtgttgagttccacaaagtgggaggggagcaagaagaagtcctctgacaggacagtcggtaacataggatgataccacttttgagattttaatttgatgttaaaaatgatacagactcaagagacagaccaagaatgacagcagttcactgggctgccacatgagggtgtgattgaccccaacacttggaaggcagagacaggaagattgtgtgttcaaggccagtctgggctacaaagaaaggctttgcctctgaataagagggggtgggagagtgggggtgggggcgggggtgggtgcatgctactggtaactccctctcttctctgggcttctctttctattaccttaactcttagctccactccttatgatctgagctacagagtaaattcaaggccagcctgggtagcttaatgagaccctgtctcaaatctttaaaagaaggggggggggggcagcaagatggctcaacaataaaggtgctttctatgcaggccttctaacctgagtgggatctccagaacccatgtacatttggaaggaagaaccagctctacatgcacacatatacatcacacacacacacacacacacacacacacacacacacacacacacactttagaaaagtaacaagagaaagatggctgggcagtagctcagttctatgaggtatcccctcataactggtatgtgtgcagttctatgaggtatccctggtacctggtgtgtgcgcacacttagagcctagacacacatgtgggttgctagctcttcagatctcagcttgctgcctgatttactcggggtcagtgtctgggaatttcacttaaagaggcaaaagatgaagccgacttggtggcacacacctgtaatcccagtaccttggaggctgagacaagaaaataacaagtttgaggtcaacccaggttacataaggataccttgtcttaacaaaacaaaacaaaaatattaatagacaaaagacagtttgatgggcactttctaccctggcagtgcaaatgagagttctggaagcagagggggcaacagtttccagggtggtgctcaggggtagccaagaggatggagtgacatataagttggtctttggtcagaatactttcctggagagatagtgaactgcttgtcctaggttgccttggtaatccctggaaatactgtttgatcccttggtagaatgctatagagggaatcctgatggtctgggattctagaactggaaggcttggcgatctgtctgggccacaccaagcaggtgtctcctgggctgctgccaattgaaaacctgactgggccaggggtgagctctgatctaagggctggcaactgcaggaagcccccaccctaattcacctgcggagactgactcaagtccggagctccgcccacctcttgtctgtccaggtgtgggccgggtggagtagacctgaaatgaagaccatatggttgtgggtgggctcctcctctgaggggtctggaggagtcctgagggctgctcttgtcttatagggaaggaaggagctgcatagtctttcgctaagctggttttctttttctttttccaagccctggcctggtggctcaggctctttctgcctggttggactgatcctcttttacctccaccctcataagcatttctcattccaacttccctatcccaagcccggacacatacctgaagggcagatcaaaggctcacagctgctcttgtgagctcccattagaccccagctgagaaggagagcccaccctggcaggctgccctggcccctcaccctgccttcctcatccgggctttctgagctcaccccagttttatgcctccagatgcaggggtgtgtgggggaacaccctcaaccctgcccattcctcccttcctgtctcctcagaggagaaaagcgtgccttggataccttagtggaaagcaggcctggcggctgacctgggcagacagaaacagctgcctggagagcctaagtcctggtgcctggggaagggccagcccagcctcagctgcctcactcccccagcccacaatgagaactgaaaattcatggatctggcctgagggcctggcgtgccagtgcctgaaggaatcctaggccttcttcccaggcctggcacatacataaaaggagccttcagggccttctgtctctaaatatgcaccacatatttcttccacctttctgcttgtacattcatttccccaccgacttccagtgttgcctccacttgagaaaagcctatcccataggaaggaacagggacaccatgtgacatagatagtgcaggggtgtctggtttttctagaaacaacacacctttgagttgcctgcccatcagaatgaacttttgagtagagcctgattgagcacggaggactcttctagtagtctctgtactcaggcatacaaacagctttttggtgtattaaggtggattgctactcatttgctatctcacctaatccacttaccaaccctaagaatacgtattgtggagactggtgtggtagcacgtgcctgcaatcccagcacttctgagatgcagagaggagaattcaaagttcaaggccagtctcagaaagtaacaataacaccaccaccaccatcacatagacacactctcccaagcctcccccacaagggtattcttttcattccttgtttacgagtgacaaagggaaggtcctcctggctttcacatagcgtgcaggtttctctcatctgagagtatgtatgctccctgctgcattctgtctccagatccatgcatagtgttgaacatttcagatgccctaaatctgtccttgagggtgagtactagggcacccacatcatggataccataatctgtggatgctcaggtctcttacattgtctagaacagctgaatttttgcatgcaacctatgcatatcctcttgccatctgtgaattactcatcatactaatacaatggacaagttttgtgtggttgatatagggaactttcttttgggagtgggagagatctgtgcgtgttcagaatagacacgttcgttgttttgttgtttttttttttttccagaatattttcaacctcggtcgtttgattccactctcactccaggaatgagaggcagtagtgtataagagctcagagccgagagtctggagctaggtgacctagtagtgcaggtaccagttctgttactagctgtgtgtcactgggccagatgttgtacctctgcaggccccggtttcctcctctgtgatggttattggggttgttaggaagctatgaaacacttctgtgaaatctgaaacatactgcactgtgtttactttttgcttttttgtttgtttttgttcttttggagcaaggttatcctgtgtaagcttagatgacattgaacttgccgtgtatcatcggacaacctcaagatcacaatccccctcccttccaaatgctaagatttcaatgggcactggccactctggaactaatttaaaaaaaaaataatggatgacttatattgtttgaagcctttgaggctaatatataaaaattatatataaataaataaatgtgtgtggggggggtgaggggtgttttgcctgcatgtatatctgtgcatcatgtgcatacagtgcccgaggagtccagaagaagacattggatcgtttgaccctgaagttacagatgctaggaagctgggaatcaaagcctgcccctctgaaagattattgagtctcagctgtggagcaatatcttcagcctctctggtacggctttttgaccattgcccctttcccagaacttagtttaggccagacacagaggggtgtcaaaaaagttcttttaacaaatgttcatggaagacctactggtgtgtgtcaatccctggggacatcgctagaaaaggtgctgtccctggtcacagtcccaaggaagttgagggacacagatttgaaatggcacagggagagttggagggccactttcattcaagtgctacataacccttatcaattactcattaactaccacacagcccaaaggaaacataactcaatgtgggggagcttgggaaggagagagggccagtagtgtcatagcaaggggactgtaatgtcccttttgtcccagcatgctcgctaagggcactaaagctggaacttcaacagcagcctcccatatcagcactccaagacagatgtctctgccccctctctctgtgtccttgtgttccaggaaatgggagtaacacatgtggggccaagggtgatgggtgcctggtgaatttctaacattgagtcatccagcagatcccaggtggagtagggaacaacagggaggagggaacaggctggggaggggaacggagactacagtggaggcttgatccaggctacggagaggccccaggaggtttctaagcaagaccatctgatggctgtttctaaaagtccaccaagtgaagatgagctcagcctgggtcgctgcaagatgaagggacctggaggtcactcaagttaggctgaagctcaggggagagaactggggtggagattatcagcgtgtagataggaactggagcccagaaagatgagctcatggaggaagatggaggctgcacaaagtgggaaggattgagccctggggtcttccagcattcaaggcctgggagatgaaggagagctggcaaaggaaacagggagaggagccagagtgcagggagagaaaccaaggaagcagtgggggtgctctgtaaacctttctcaaatgaacttgaactaggagtgagaaaggtcaaccatggaaagtaaccctttaccaggagaagtttataggtgaagaatccagcagcaccttcatgaaagaattgctggcagcaatgcagactcctgagccctaggaattcgaattcagtaagtccaggtgagacctggtatgtgtgtgttgcggggagtgggggtgggggtggggtgttgtaattttctcaagtacccaagtgattgagagacagagcctatggccttgactggaagaacagttttggtggcaggtagtgaaaaaacaggctaagaccagagtaaagtcctggtgaccagcaggactacacacacacacacacacacacacacaagcatcatgcacacacgcacaagcacacacacacacacacacatgcactctcacatagtcccagacctttcccttagaacccaggtgcaggcccggagcccagccaggagtaaactgagcctcagcgtggaaaatatggaaccaagatatccggggaggggggctggcgggaaggggaaaataatgcaaaccatgcagatctgcccgggaaggagcaaggcgtggggcgggggtgtgtgtgtgtgtgtggagctggtgaacagcaaatgagatatgagactgcaatgtgatatggtagcccactaaaggcagcctccctctccctctccctacccccacccccattccatcccgcatgtgtccaggctgctacagcacggagcagaagatcctcttcaagggcttcaggcccagctgtgcctgggcactatcttgaaacatcctcagcacatcctgttcaaaatcacgcagcggtattgcaaaggcatcatcaggactatggggcaagcagcaatccagtgtgctaggatgcagaaaacctagagttcagtgcctcttctaccaccgatgggctatgtgccctcgcaggccacctgctctctcctcggcctctactgctgccttacgaggaaggaaggtctggaaaacataggctttcccgagttcaaatgtatcagagcttcaaagactgctgtattttaatctgttttgtcctgactcctctgcagggaagaaggtgggtgggctggcttagtactgtgctgtgagttctgcatccagtcagctttcaagcagccttctgaggaaggaagcaagcccattttccagcagatgatgttgaatttggggggaatggccagagccctggtatatgcttccttggggtgatggatcctggggctccatagatcctgtgtggcagattaccccactgtacttagaaccagttctaccaagcccatagtgtctgcacttccccataagagttagttagacacctttctctgtctgtctgtctgtctgtctctgtatgggggggaaggtacatcccgataaagggctgaccaagtctttcaaatgtctttttaacagactccttagggagcctgcagccgtgggaggccctcagtgtgcggtctgggcacagtggttcactttgccagcctccccttccccttgatccatcccagagtcttaactctcttgtcagagatcctcggagccaagctgatgattgccagctgggatgagaggatgcagggcagaggccaccaggaccctcctcaccctgactctaattggctctcctgctagctagggttggccgtcagcttcgagttaggcctggcttctctcaaaccaggacacttgcctgctcagccaggcccagctttcccctccctataggtcttccatggaaaaaaaggagaccatcgcctgtttctggatcttccttggtgctcaggctctgacccaggatttggggtgactaagaggaaatctaggggcttaatggctttctgcacccccaccagctgacagtctggatgggtgtagtgaaagatgtggtggttcggtgaaatcggttttcttttctccttcctccctagactctatgcttttgggagcctgcctcctttctttctccctgggtcagtccatggcttctgccaagaaccccaggaagcctggatctcatactcactatctgggggtacagtgtcctttcaaatgcggacataccaagactctagtcctccccttagaatcccttgtgtgtggcttctctttgcaactaaagtgagtgacgtcccttcctgttctctgcagaaatcaagtcccaactccccaacctggtattggagactctgattcttttctgtaaagttcggcatttgctcaggatcactcaccattcccagaatccgtgtgcctttccctccgatagctttcatccaagcagtagttcaagtagtgtccagaaccaaactgtacctttgctctgtactactctgtgatcttgggcaagttatttcacctctttgatctttggggtttttttccccttcagatctgaaaatcaggcatattcatacctgttagtgttgtaaggattcaggtaataaatgtaaaatactcagaactagagtaagtatctacttaagtgctagctgtctgtctatatttaatttagttatctgttttgagacacaatctcactatgtagcactgagtgacaaggggtctcaatgtagaccaggttggcctctgcttctgcctctgtctctgtcttctgaatgctagatttaagtgtgcataccaccagacctggccctacattttttagtgtatttattcatattgtctttaaattttattttggtttgttttggagacagtcttactatgtatgatgtatgtatgtaaaaactcattgctaaggatattagccatcacatggaatccaagatgcgtgggcagatgaatgaaacagggcatagaaggatataagagctcagagaatcctttggatgctatgctacacagtaactattcaagtccttatgtgatcagtgtgaatgttgtttcctttgcaacagagtaggttgggagacagggagaacattggtgggtgcagttggtgtagttgcaagtttgcaatgagcctgcaatgaacttaaaggaattctcaggactggcaatggtaggggccctcaaacactgctgagggactgatagtatctaaagtactttctcagtcttctccatatttgattcccaccatagcctcttcagggcacagcaaagttactgagatccttggccaaccaaaccaaaccaaaccaaaaataaatggaattcataggaatgggaaatgacttgcttagggtcacatagctaaaaatgatcaaggattgcagtccaatttcattgagtctctatgaccagaattagaaggagtagaggctagacctcccttatttctctctctgtattctctggtgagctctgttccagtccataggtatgcctttggcaagtcctatgtagggcactgagatgccgagatgaaactacacggactccatctttgaggtggcttaggacacacaggcatgaaaactcagaaactctggtgcaatcagctaagaacagaggcacaaacaggagcacagaagaggtggggggatagtggtgtgtagtgaaatagagaaggaaataggaatgccgagggagagataatgggaacagaagagagatggtattcaaagggcaagtaaagctcctcccgagctggtagcaaggagtttgatttgaagagcgagtgggccagctgcagatgatgcatcaccctctatggtctgtcactgatgagctggcataatgccaccagcctcatgcttggactccttcattcctatattggctacagccataagcatgacagagggctcttggtgggaccatatccttcctctctttctgcactggaccactgaaaagctaggggacagagtggagcctctattgctacctctgagttcatgggctttcaacaacaaagagtcttaacctagttctgttgttgacttgtgaagcaaagagacaggatgagagagcctgctgaatgggtaggcatcttggaataataggtctgtgccatcagatcttggtgagggagagcaaattcactctcagcctgtgttcttcaccatgccacggcctgttcttgccacttgacatccattagcctaatgcatcctcatactaaccttgtggttttacaactcttactgtagatgcagctcaggagaaagggacctggcccaggtcacatcaaagtaagtggtggtctgtgtcatcccatcgctgcgccaccctccccctgcccaccccacttgtgtacttgcctgaagctaagcggcctcccatttcaaacccagaagtagagcctcctgctgcttttggtgtcaaaaaggaagaaactgacaggtcctccagagacttcaagtttatgctggtgttaaattgggagagaaatacctcggtgggcccttgccccagggcactaagcgtctcagtggacaatatcctggacagtggcttgacaatccaacagacaccgtttacacgtggctgtttgcctctcgtcagataatgtttatttctcttcctgattatgaaaggcacacaggcatgcctgtttcttgaaagggcctttgataagagccgagggcagcacatgaaagagctgttctacaagagccattctgccagcgcctacatgcatgtggccagggcgttttttgttttgttttgtttttgtttttgtttttttaaatttttgttttgttttgtgttttgtttgtttgtttgtttttaggagatgaggggaacaacccaaggagtgggctcctgacatggcccatggctgctccccccttccccaacaagcaaggcagctcacagaggtgcccttgttcccttactcagtgacccaggctctgcctgccactcagggcgtggccctctcctcagccctaggcattctccctttgagagactttaccccacagcatgtcagatatgtgaaaatgcacccacatcccatattaaatgtaatttttgctataaaatatttcaaaggatttttataattccgctttcaaaattatttgcctatgagtaagtcgtttcgttcccacttggctatgatttctttgtaatcatcgggcatacttgggaattcttgcaaagtgaggaaatctaagcaacaaattgttttcaaatgtaatgaaatttttaggaatactaaatttaacaattaacgaggctgatattatattatgttttgtagacatataatggaacatttattaattccaattctgctgttttcttttcatattttagagccaataaatgttctttttcttggg

SEQ ID NO: 566 - DNA, 38467 bp, mus musculus; identical to SEQ ID NO: 565

SEQ ID NO: 567 - DNA, 38467 bp, mus musculus; identical to SEQ ID NO: 565

SEQ ID NO: 568 - DNA, 38467 bp, mus musculus; identical to SEQ ID NO: 565

SEQ ID NO: 569 - DNA, 423 bp, mus musculus
cagtcccgctccctcctcctcccggtgcctctttctccgccctgctcccccccaaacacactcgcacacgggctctcaaggtgttctccgcacagcggaagatggcgacagactgagggggcatggccagcgggagccacggggccatgcctttgggcggccgccacagcggggcgaagcagaggcggaagcgagaggcgcactaagtaaagccgggcgtccgcgtccggcgtctgtggcgctgcggggagccaggtggcccgcccgagccggaactccgggagccgcgggtgcggagccagagcggagccggcccgggaccggccccagcggactgccagagcgcgagggaagcccgaagggccggcggcggaccggccggccggcctaggagggcacgagcgaggcggggagctgcacgga

SEQ ID NO: 570 - DNA, 272 bp, mus musculus
cccgcgctcccctgctggcagccggggcgccgccgcccggcccgctaggcgcagcccggcgtcccggcggggggcggtgcggggcactggggcggtggcggctgcggcggcggcgccgcactcctcatggtgtcgggcccctccgctaccccgggctccgcgccacttcactccgcgcccccggccccctggctcgcactctgctctggccgtccgtctcggctcggcgcggctctgcgcccctcagcgccgccgtgcgggccccgccgcgc

SEQ ID NO: 571 - DNA, 154 bp, mus musculus
tgccccgcaccgccccccgccgggacgccgggctgcgcctagcgggccgggcggcggcgccccggctgccagcaggggagcgcgggaggggcgcggggacggcccgagagcgccccgccacaacggcctgagcggggccccgggccggccggcc

SEQ ID NO: 572 - DNA, 335817 bp, mus musculus
tgggcgtcccggccgccccttgaggcatggggcggggtaggtgaggacctcctccctcattccctctctggccgcgccgcccctctcgcccgcccctcctcctccctttcccacccctcggagtggagctgcacatgcggctgctccctgttctgtcccgcccagccaccgtcgctcaggaacgggtccctgcagcccccagccgatggcaggacagtagtcgcctgtcaggggtcgtgaaggactgaggcagaggcagaggctcccgggcctcagatagtggttgtctctggaggccatgggctacccagaggtagagcgcagggaacccctgcctgcggcagcgccaagggagcggggcagccagggctgcggctgtcgcggggcccctgctcgggcgggcgaagggaacagctgccggctcttcctgggtttctttggcctctcgctggccctccacctgctgacgctgtgctgctacctagagttgcggtccgaattgcggcgggaacggggaaccgagtcccgcctcggtggcccgggtgctcctggcacctctggcaccctaagcagccctgggagcctcgacccggtgggtcccatcacccgccacctggggcagccgtcctttcaacagcagcctttggaaccgggagaagatccactcccccctgactcccaggaccggcaccaggtgagtcacctaggaggggcggcggccttggaggccccctcccctgctcggttgggcgggggcctgggcctcagggctcaggggactctgccactcagagccaagttccagggcaggagctgggagtgggccggagtgctggggagaggttgtccaggtcaggttgttctcggttcctgccttggctcatccagaccctctccggtcccgtggagttggaaagcccagcctgcacgcgccgcccccggggaggtgtgggctgcttagcgaaaagttggcctgccttgcacccatccgggcgcggaggtgcctgcgccgcccccgtggccgtctaacggcgagcagcttggcccctcgtgccccctggtgagtttctctgcccgtggtgcttgtttcttcgtgtcccgagctgatgccagcactagcaggctcctctttggagttggagctgtaaacagctgtactaactgttccacgcccgttgaaacaacttttaaccatactttcagcgctggattcttgtgcgctgaccaggacctgagcttttttcacacttacctgcaacttgagacggattctcttctgcgttctagttaggatcagcgcccctgaggaattctggtagaaatatgccgtcttgctagacaacttctgaacagcaatttaaaaaatctatggaaataaaactcaccctttgcatgccggttctgacactcttgtagatggagttgggtgcagtgggtgtgaagagttttcattattgctgcctttggaacaggaagttggatttttgttttgttttgataatctttagagggtttgtatctcttttagcaaaccattatcgtagttgtttttcttactcgttattccagcaaatttagtgtacttgatattaagtcttcctgtggtttccatagctgtctcacacttgaatcttaggcagaacatccaagaatctttttgaggtggttaaagattaatggtgaatttgtaacttctggagaaaacgacactttgtgtaagtaagctacttgaggtgagacatggaagccttctgtacttggtgctatacccatagttattgtcacaactctttaaacattatttgtgttgctttgactttccaagttgtacactttagaggtgtcacattcataataatactctagtgtcagaacacacactttctcttcttttcctttctctctctgtgtctctcttccttcctttctttcttaacaatgtgctttgtaaaattgcttcagacctaaaatgtctttcaaagacactcaaatttatataactgcgtatcaaagaagagaatcagtagacgggcttctcatacttgaaattttaaacaccggggctaaatgacaatgaattaggactctgggtcttttatttactacccccctccaggatcctagtagaggtacttagcagctgcaccttgatattctctctctctctctctctctctctctctctctctctctgtatgtacacacacacacacacacacacacacacacacacactcactcaaaagaaatcaggaaattactcaaatggtggtcaaggatttttggcaatcaggatggacagagcgctggttagagattgtgggacagcagtatactagagcttctgtgatggcatgggactctcacagctttgcaatggcctttagttgcttacatcagatgtagcaaaaatacttatgtgtttcagcacagcttcttatctgctatcctttagtctattttagtctatggggcagtcaaagcaatgataccagttctttacattcattagcattaattggaatttatgttttccagatttgtaaggtacctcctgaatctattttattgattcctttggagaacatacaggcctcaagggagaagtaagtggcccaagatatcctagcttgagtcaaaactaggatgaaggtgctctgccatcctccagtttagtacacagtcctccataatatagtgtctactgagaaactttgtttttgaggggggcgatgaagggacaacaggttgaaactccatagtaggctttttacaaaatgagaggctcagatctgtgtcactttgttctgctctaactaattttgaccagactaagtttaatcacatattccttattcatcttgaatttcactttcaggagaattttagcccactgaagacattttatcccagattcaactaatttgttttggtgatattagccttagcatatacacaaacaaacaaacaaatatataaatgaatgagtaaataaataaaggaaaagttgattggctaattgatttacattgctgtgctatatcttgggtaacatttctagtgccctgctgcaccctctgctggtttttcggtgacatttaatcgtaggtagtatctgctgacagtcaaaattctaagttgtgctgacagattctgattcataaataaggaagtgaataaccttgtgggacttggccatgtaggtcttattttatattttagtttttcaacataagcagatgttgttacagcaaaccttgtatgcagaggactagaaacaaagccagcatcttccagtgggtactatacttgggtttcctaccaacatatttagaaagagtaaagggaaactgatgcaactaaactgtggtgagcccaacaatcagtggcttttcattatgagtggtcagacatgtatttaggcaaggaaaaaggtattcatacttatgagatggttggactgtgggctcttaatcatgactcaaggaaagactccagaagtcattgaaggtttgtctgtaccatactggaattaaacaaacaaacaaacaaacaaacaaacaaagcaggatatggaaagaattcaggacacaaagtaggaatataagcaattctctgcaagggagattttggaaaggtagggacatggtttcataaaaactgagaggttgacattagcgtttctggaatcaggggctgtctccctcagctgaaggagtagctgcatatggatacttagtgaagataagtttgatggctagagatgcaccagtagtgtctgattttgacaacaaataattcaaaacattgaaaatcactggataacactgtagagaagaaggtctggtcatgattatgtctctcaaatgtcaaaaacatggcggaaaaatctcagcaacgtgtcaacaacaaaacaaaccttttttttccatgaagaagatcagatgtgattttttccctacaatcagaaagaaaattctgatgactgttactaaaaaaaaaaaaaaaatcttatagccaattgataagtctccagaaacccaattgaattgatcaaaagtggggattttctagttgtcatttttccaatctggagaactagagagaagtgggggagggagggggggaggatcaaagatcagagtcttccaaatcaggagagagatgagtaacattgttggtataatttaataatctaagctcaataaataaaaatttctctgtggcagatacagtgttaagtatcagatgctggagagatggctcagaggttaagatcactggttgctcttccagaggacctgggttcaattcccagcacccacatggcagctcagaacttcctacaactccagttccaggggatctaacaacatcacacagacaagtattagatgtcttttaatgttggtaaaagttctgttgagagagatagaggtggtatctcatcaactaaactacaagcagatcaataggaatttattcaggactgtttgagatatttgagatattttcttaattatttgaggtgatatcatagaagacagctttaatgatcaacataaatctttgggtataactagctctgttattagaataccaagttttgatactcctaataactaagaatcattctgggtgattcatggcgaacataagcgatcccacaaattgtgtatatggaatctagataaaaataggctttcatgagtttaaatgcagactttacagtgtcttatttaagtcttctgaagaatggctatcataatatcactctcatttttattcccactaattttactcctggaagtcgccaaccatattctctttgggaattattctgtcgttgttactgaggttcatcttaataatctcctttctttaccttaaagctcctcagaaatctactttcttcatgattcccaacatatcactagttatagctaggtagaaatatagttgttgaattaaattattttgggacttaggtaacgtttatataaaacaaagccattttatagaacaggtctgcttctctctggtcctgctaagtctgtgaactgtcagttatgcttaggtaagtaaatagttggtatgtttcgctggttttgaaaataattgggaagtgaggtggaaatgaggaagcctaactgtgtgatctatctccgagtttcatgcctttcctctaagatggtactaaattgtttttgtaatatattgtttgaagtttcatatgctgttaggtctcatccttctctcttagatcttgtgaagaaaaaacaaaaacaaaaaaaagaactgcaatctatccgtaactatgttatagagaagatctctttataccagagaatttctgaagcaaatttaattcctaagagcggtaccaaaccttgtgcctctgactgcagctgttgtagcgaaccatctttgtctgattcctctgtaaatacccagtgcttagtctctcatttccattctttttctttacattttattgacataaaacacacatacagaaacacatgcacttcatgattgtgccatttggtgaaatattacaaagtaaggacacttatgttgcttgcacctaggtgaaaaaataaaatattttaccattctgcaaatccttaattgtgtccatctttatcgctaaatgatcctcactctccaaagataataactgtcttcacttctattatcagaaataattttgttcatttgaactgtacataaatggaatcagatagatgtatttttttgagtcttgtggttttttgttagcactatatttgtgataaccatactgttgcaaggagaattttaaaaatttatatctttgtgtgttctgttgttgaaatacatcataatttataaattccttatcatgataataactatgtatgatatttccagttcgaagttattatgaataatgtttcagatatttttatacaagtccacttattagaatttccattgactatttatctaggattagtttctgtgtaatggagaatacatattttgaagttattgatgattttctaagttatcgacaatttgtttctcaccagcaatgaatgagaagtactgtcattctggtgagtgggtttgtagtgaaattttctgtttgtatgtgatattgggaatcaaacccaagccttcaggttctctaggcaagtagtctacccgtgacttacatccttaattttatctcaaaggattttaaaggattcttcactgaagactgatgaggttgtactccttatcatgtgctattatcaatttaggcatcttcatgaagtacttatccatctatttatatctgtatctatatctaaatctaatctatgcctgtatgtagatgtttatataatatatatttgcctattttcctgtccacttacactgtttttacaaatttcttatataattaaaaatccgttatttttatttttaattatgtgtatgtgtgcttgtgtctatgtgggagtatgtgagtgcagagaatagaattcccaggagctggagttgtgagccccctgacatgggtgcttccaagtcctcttccgaagcaacaagctctctcaactattgagccatttctctagccctaaaagtctttatatacattggaaattacttcttatgctttgaaaaacagtttcaaatttgtggcctacttttataatatcttttgatgaacagaaggctttaattttaatgtgtcaactttttctttcatggatagtgtttttgtaatccgtttaagaagtatttttccagggctgaagagatgtctcagtgagtttggttccatgcacccactattagacagcccataaccacctaacttcctctctgatgaagctctcttttacacacacacaaacacacacacacacacacacacacacacacacacacacacacaccccacaaacacaaaacaagcctttttttaaaaaaagtattttctcactttgaaatcattagacatgctcttccattatcatttcgaagttttgtatttgtgccatttgcagttagaattgctagccacctgggattgattttgtgtatggtagagatatagaggtcaggccctatatttttccatgtaagtatccaactgatcttgtcctatttattatatggatttttttatacttttctacattcttactttttcatccatccattgtttatatacactcaaaattgttcctgagttgtttattctattctgttgatctgtttctcatcagtctattttctgttgctagaacaaaataattgaggcttggtacttgaaagtgaaagagattacttaggtcattttggagattcaaaaacatccattcagcttgagtgagagtacccttggctagatagcaaaatggtggagaaagacaaagagactacatgcagaaaagggaaaatttgtatgggttggcctcatttcagagcaacttacccctttgagaactaatgtactctgtaagaaaaggatgtgtaccttctgaaggcagtaccctcagtgatgaaattaccttgcatttagccttacctcttaaaagttctaccatatcaacagtgccacacagggttaagcatccctcacatgaatccttggtatacaaaaccacagtagggccatagcataccagtactaacagtgttagttactgaaccctgtaataagctcttgatatctgggaaagcaagtccttccaacttggccttttaaaaccaccttggatactcttagcattaacattttcacatgtattttaggattggctttttatgtacctcaagaaaagggaaacctcttagaattcttattgtgattacattgaatttaaaaattgtattagttaagatttcttttctattgctgagataaaacattatgaccaagagtttaactgagcttccagttccagagggtgtttatgacaaaaggatgaaagcctgaaggggtggctgtagacagagctagaacagcaccaagagctcacatttggatgttacagaacacaataggaatggggaagtcttttgaaacctcaagccctccctacagtgacacaccacctccaagaagtccatagctccaagtccttccccaagagttccagcaactggtgaacagacatgagcccatgggggaacatgctcattcaaataaaaaaaatcaacttaggaaaaaaaatcacagcatccaattcaggaacatcatatattcttccatgtctttaattcttgctcattttcctactgatattttttaatgtttatatagagtttttccaaggtgttttttatgccattgtatatgatagctatgatggaggttgtgtttcaccatgtagattccactttagaaaggcaggatttatgccctccccccacccccccaccccccccccccccgagtaccaagagtaccatcaaaagacagagttcacctgagaattgtcttctgaggcaaacttttcaccaaggaaagacctccttccttgactgcctgcatctaatgactaatcactgtagagctataaatcacttcccctttcttctaaattaggaaaacattgaagagtcatatataagccatactagttcaagagctcaatataaatttagttagggcaatttggggattgactttttccttgtcttgcacatatgtggatccccaaagcactatctataaaaagtcctgcatgttaatataagcctttcagttgacttggtaggaattccaatgtaagtctatataattaaaaaaaattttgtgattataacattattacatcatttccccttcaaaccatccatccaaattctctcatgtagcttcccttgttcattttcttcttttttttgtttaatgttttttttctttttttttaattaggtattttcctcgtttacattttcaatgctatcccaaaagtcccccatacccacccccccaatcccctacccacccactccccctttttggccctggggttcccctgtactggggcatataaagtttgcaagtccaatgggcctctctttgcagtgatggccgactaggccatcttttgatacatatgcagctagagacaagagctctggggtactggttagttcatattgttgttccacctatagagttccctttagctccttgggtaatttctctagctcctccattgggggccctgtgatccatccaatagctgactgtgagcatccacttatgtgtttgctaggccccagcatagtctcacaagagacagctatatctggatcctttcagcaaaatcttgctagtgtatgcaatggtgtcagcgtttgaaagctgattatgggatggatccctgcatatggcaatcactagatggtccatcctttcgtcacagctccaaattttgtctctgtaactccttccatgggtgttttgttcccatttctaagaaggggaaagtgtccacactttggtcttcgttcttcttgaatttcatgcgtttggcaaattgtatcttataccttgggtatcctacgtttctgggctaatatccacttatcagtgagtacatattgtgtgagttcctttgtgattgtgttacctcactcaggatgatgccctccaggtccatccatttggctaggaatttcataaattcattttttaatagctgagtagtactccattgtgtaaatgtaccacattttctgtatccattcctctgttgaggggcatctgggttctttccagcttctggctattaccaataaggctactatgaacatagtggagcatgtgtccttcttaccggttgggacatcttctggatatatgcccaggagaggtattgctggatcctctggtagtactatgtccaattttctgaggaaccgccagactgatttccagagtggttgtacaagcttgcaatcccaccaacaatggaggagtgttcctctttctccacatcctcgccagcatctgctgtcacctgaatttttgatgttagccattctgactggagtgaggtggaatctcagggttgttttgatttgcatttccctgatgattaaggatgttgaacattttttcaggtgcttctcagccattcggtattcctcaggtgagaattctttgttcagctctgagccccatttttaatggggttatttgattttctggagtccaccttcttgagttctttatatatattggatattagtcccctatccgatttgggatagataaagatcctttcccaatctgttggtggcctttttgtcttattgacggtgtcttttgctttgcagaagctttgcaattttatgaggtcccatttatcgattcttgatcttacagcaaaagccattactgttctattcaggaatttttcccctgtacctatatcttcgaggcttttccctactttctcctctataagtttcagtgtctctggttttatgtggagttccttaatccacttagatttgaccttagtatgacctctatttaaaaattgctttaagtttaactttaattgctttttgctaggaggagctagagaaattacccaaggagctaaagggaactgcaaccctataggtggaacaacaatatgaactaaccagtacccgggagctcttgtctttagctgcatatgtatcaaaagatggcctagttggccatcactgcaaagagaggcccattggacttgcaaactttatatgccccagtacaggggaaccccagggccaaaaagggggagtgggtgggtaggggattgggggggtgggtatgggggacctttggaatagcattgaaaatgtaaacgaggaaaatacctaataaaaaaaataaaacaaacaaacaaaaaaacaaatgtagtttaattttgcatatgaagtttgtatccaaagatttgataaactcacttatttatcctaataatttatttgcatgttcttttggatttttcacatgtctactaaagtgttcatggaaaatgttttaaaaatgttatttttttcctttttaatctagatagcttaaaagttttcctctgacctaagagcatgcaccacagcctggacctaggtcttctcacacatatgtagcagatgtacagcttggtcttcatgtgggtccagaacaactggagtgggggctatcccaaaagctgttaccaaaaagctgttatcccaaaagttgagctgccttgtctggcctcggtgggagaggatgcacctagccttatggagacttgaagtgtcagggtgggaggataccctggagggccccacccactcagaggagaaggggaggggggaatggagggaagaattgtgggagggagtgactaggagggggcagtgagcataaggtaaactgaataagaaaaataattaaattaaattttaaaaagttttctttgtgttggtcaattattcctgggtatggggcctgccctggagtgtagttgatatacccaatgactgtccatgggagaaacctgactttccctctgcccccagctttcagttgcaaatagattcttggttggttgaggttgggatccagagttcaccttactctctcattatggggatcctgtctagcttgaacctgttcaggtcttgtgaatgctttcacattcttggagttcattcctgttactgtaccattcctgttttgtctgcaagagacattttttttcttggagtcatctatctatctatcctctctggctcttactatgtttccttttgtttatttgacttgattttctctttttgttgttttcttagttttacacatatggatacacagctcacgagagagagagagagagagagagagagagagagagagagagagagagagagagagagagagaacatgaagtttggggggaaaggtgtggagaatctgggagaagttgggagagggagaaagaatatgatcaaaatatattatataaaaaactttaaaagtaaaaaagtttcctttattataatgtctagaaatttccagataatattgagtggaagtaagtaataggcatcgttgttcactactgatcagagcaaaaattttatttttactgtttgtcataggttatattattattgttagtttaaaagatatcagttttaaacttttagttttcaaaggtttttaaataacatcaggaatgacatcattgtatcacggttttcttttatatgttaaactagtcacaagatttttccctccttattctgttaatgtggtctgaagctaaccgtacacccttaggataaaacctctttagttccagtgtaccattcagttcatatatgtctagaattattttactaacctttcatttaaaatccttgatctttatttatgagcaagatgagcatgtaattttctttcattatcaagtttggatatcaaggttattctatgttgttattataattgtgtttattttatttgttccttacaaccatttatataacattgataatatttttcccttagctgtttggaagaattcatgaagtcattttaccctaggggaggttaaattgtgtttgatatcctaataaacatagggctttcagacaatagctaacaaaataataaaatacttagaaatacatttaatcaagagaatcagagaccagaacattaaaatctataaaacaatgatgaaagaagttgaagactgcagaaataaatgagaataggttccatatatgtgtatcagaagaatcaaaattggtgaaatgtccatactatccaaagaaaactgccaattcaatgaaaaccccaatattccaataacacaagccaggtatgatgtctcataactataattctagctcgtgggaggctaatgcagaagggttgtcagttcaagggtagccttgatggtgagatcttatctcaaaaaacaaaacaaaacaaaataatcagtgacatgttatagaattagcaattgtgaaatttatagggaaccacaagatatctcaatcgatttctattatcaattgtatatcttatttttgtactacatgactgttttgccatatgcttgtttgctttttaatgaatggcataatgtataatgttattaattatgacatatattatataaaatatttgtgctatatgcgtaatataatataatatataatgataatgtgttatttatattgtatttaatattaaaataatattgtataatacatacacacacatatatggcttcagttgcttttatctttattaaaataggatttatgtttctggaaattggcctcagatactaacattcctatgtcatcttaatccaacacgatactgagatcattggaaactggctttctgtccaaatagaagttgatttatcatttatttaaaatattgttatagtttagaacctaaaagttggtaatttttcctgggttctttctagatgggtcataaattacagttttttctttttctccactgactcccaagttcggccttttaatagtatgacatattatgtaaatatcatatgaacttttgtatagttttcttggcaggaaatgtcgttcaaattgctaatttgtccgttactaaaaacataagcaactcatcatatttatagatatttatgcattatcacctttgtaacatgtaccaaggggtacaccaatgtggagatacaactgttgacccagttagagagagttcctgcagtcatggaattctgagtcaggtgaataggctagaacaagtcaacttgatgatgaagcagtagggttaatcttacagcttggagtatctggaacacatggtaatttggaacaaaaaagatgaacacctggctcaaacttttgaaatcaagggacattttcttgatgaagcaccttctgagtttaaaactgaaaaaaaaagtcattagctggataattttatttccagtaataggagctgattatgcaaagtcttggaggtgagagagaacatggcatattcaagggatggaaaatctaatatttataaagccatcgttatgagtccattatggtactggcataaggtagacattatggatcaatggaacagaattgagaacccttatattataaccaactgattttttacaagcataaaagacagttcaccaaagtacaagattccctattgaaattaaggtgctaggaaaatcaggtacccacattttttaaaggggtgaacttaaaaaaataggcttaatgaccttgatagacatttctcaaaaacaaaacaaaacaaatagatgcacaatatctatatgaaagtaactataggaatatcactactaaccatggactgcaaattaaaatcgccatcaaagctacctccccccattacgaatcactaatatcaacaacacagactaaagataagaaatgttggaagatgttgaggagaggggactcatttcacacaccaccaggggactatgtatacatatgccataatatcaaattatgggagtgtttcaaaaattttaaagagttcacatatgattcaggagtcctgcttctgagtatatgttatagtttgaatatgaaatgccccccatagacttatgtgtttgaatacttggtctccagctggtagagctgttttgggaagggttgtggaacctttaagatgtggagacttgctggaagaaaggagtcaccagacaggctttgaggttttacagtccagctctgtccctcacttactctctgcttctgtactgaggattcagtgtgtggagccagcctcctgctgccagcagctgctatgccttccccgccttgttgccttgtgttcccttgaactctaatccgaagtaaacttttccccttctaaacgtgcttcttgtcaggtattttgtcacaccataaagaaaaataccttgtactgcatgtatccaacagaaatgaaatatgtctttggaagaggcatctgggctctggaacattatttgcaggagctaacaaatggaaataacctatgtagtactcggctcaggtgatgatgaacaggtacaaaatgtgttacggccaggtaaggctgtatgagtggtcagagttctcagacacaggaggcagggggatctcaagttcaaggccagcctggagcatagagcaaaaccctacttgaaagcaaacacacaaaacagcccacaaaattaaatagaaaatgaaaaaaaaccccgaaaatcacaaaaatgaaatcctgttatttgtaatagaataaacacagctggaaattattattaaatgaaataaatcaggcagagaacggagatctcactcacatgtagaacaacaagttaattgtatacaaggtaagaataaaaaggtgttactagatggtggggaataggtaggtgagggttgaggaggagtgaggaaaaataattgatcaatgagtattagattacagatatatggaaaaggatgatctgctatgctgttgcagagtagaatgaccatagataaagtatgtttcaaaagctataaaaaaagattttgtgtaggggctcacagacactgaagtggcaattatggagcatgcatggatctgctctaggtcccctgcatatatggtatagttattagcttggtgttttggggggtcctaacagtggaaatggcccttgtctcctgggacctttcattttcctactgggttgacttgtccagctttaatatgacaggaggtgtctagtctttttgtaacttcttatgccatgcttggttcatatccctggaagacttgcttttttctgaagggaaagggacgatgagtggatctgtggaagagggcagataaggggtggggactgggaagagtggagtgaggggagactgcaattgggaagtattgttatgagggagaatcaataaagattttaaagtttttttttcactagaataatccttgcttgattagatagatgtgtttaacctgatttaatcactatgccttagatactctggtttagttttattctcatatatatcttgcctcttagatacagtctacagtgcattcatgtgttaaaacattatacagtgtgctaataatatgtatatgttttatgttttaatctatcaatttaaaaagtttaaaaagccatgagtcaaattaaataaaaaagtgaatgttggtatatgcaacacaccatacccctgaatttacttttaaataaccttagtttaaaatgctagaacaacacttttagaagaaaacagaaaaaaattatgaccttcatattgagcaaatatttcttagacatggaaccaaaaacatagtcaaacaacaacacacagaagtgaattgtatttggaaaaatgtttttctaaagaagcctttgaaaatatgaaaagaaacatgagagtaggggaaaatgtttccaaaataggcctcttgaaatgtgatgaataagaagacaaagtagagaaaagatgcatacatttttatcaaagacgatgcacaaatgtccaaaatacacaaaaatatgctcaacactgttaccatagaaatgcatcattttatacctattagaatggccataatgaaaaaggtaataaacaatggaggtatagagaatgggaacactaatatattgctggtgggcatgttaaatgatatagtagtcttgaaaaatggttttccactcctttaataagttaatatagaattacttattgcataatgacccaattctacttgtatgcttgtgcccaaaagaattgaaaacgtctgttcacacaaaaacctctacaggaatgctcaaagtaagtggtattcataattttcatttcaaaccaaatgtctgatgaataaagaaatgtggcaaaaattctaatagaatgtatttcagccataaagaggaatgaagtttgaatatgttacaacatggtaggatttcaaaaatatggtaagtgaaaagagccagtcacaaaggcccacatcatattgcataattctatttgtatgaaatatccagaataaacaaatatgtggagaaaaactgagattagtgagtatctgtggtgagtagtaggactgaagatccactaactatggacatgagggcacttattgtgggaaagaaaagatttcaaaactgatttttactatgactagggtaggagtagtggtgctttaaagaaaatgaagcaagagatatcatgaaattacacagttcaatacaattcctacaaaaataagtgaattctatggtgcgtgaattatatcttgatgcatttgttattctttaaaaaaatcataaagtaaatgtgtaagagatgttagttgtttcagagtgatatttatcttcatatgaagggaatcttcaagcctgttcattgcaaatgcttaaaactttttccataataggtgacttcaggattctaacccagaattaaactcaaccagaagcatcagggatgtcaggccattcatttttaattggaaggactgtactggccattttgttgtgcacttcagagtaagaatctttaatttgtgggactataaatgagttagtgtagatagatgctagcatgcacaaatagccatctgtggtttgaatatctccctctaagacccacgttgaaatttaattagcattgcaagagtattaagtagtgggacctttaagtggtgattagtcaatgaggccccatgaataaatgctattatagaaatgcatcagcagtcatgggagtagacccccaattaatatccatctgtgttatattctcaatcaatcatctatcttccagtatcatttcagccttcagaattgtgagaaacaaaacaaagttctttcttttctctgtttgtttgtttctttgaaacagggttgcgtgcagcccaggtcggcctcaaacttgtttggtagctgaggagaaagtgttgactactatccaagctatcgcttctattcttacatgctagggttataggcatgtaccaccatgcctggcttaatacatttatttactttatgaattacccaatttctggtattctgttacagcagcacaaaacagactgagataaggcctagctaattacttacactacagtgggcagtaattaattctggctcacaattgttatctcttgtttcctcttctgccctgtccattactcactccctttgcctctatgcctctatgacttttattcttactttttctgatagagataggggaaatattctcagattctgcttagactctttttttttagacttctaggtttaatatatatcattcagatgaatgtgaatgccattttaaccagtgtaaagtgttggagaactttttaaaaacctacctgtgtgtggccacagcttatcccacatcttcagactctttggagtgtatctatggcttcttcgataatactgatgctcatctccatttgggaatcactgctctaaagggagaaaataaaaacgagagtgtgagtgacataagcgttgatcgccttcctagcttcagttcctttattgttggctattacacttttgccacttttgttactagtcctacctttgatgatcactgatgcaagagtttgtgtggtagtgaatgcttaatgagcacaccatttagaaaattagctaatgattgtgtgtcttttgggaagagaggaattagacttcagttgtcatctccgcagccagatgctagggctatgtgcttgcaataactgagggaaagagtagttccctgtcctttgtggcttcctagggattttcctactggtagccgctgaaaccactttaaaataataggccgctgagtaattttccccatgtatatccacttgtcaatgggcctgcacttcagagatgaagagtaatttttattggagtgatagtgtataatatagtttgaaagcagacagccacaaagaaattgattttcaaaaggagattactgctcaattttattttgtggtttacagatctttagtctttcaacctgccacgccattgacctgcaaggacaatcaaagtttaaacagcagtgtgtgcctagaagcattggatggttctagagcacttttaaaaatatttatttataattattgttggggtggtgggctgccataatgccatgcatatgtgtagaccagaagagtatcccataaagtcagttcttttcctgttatcttgctcctggggatcaaactcgggtaatcaggtcttcttgcctagctctttagccagctgagccagctcgctggccctaaagtccttttaatgtataagctaagttattaaggtggtgaaacagagggctttttctggaaggaatgttacatctttattcagactcatggaaaggagagtggcagatttcaggtgggcgtttcctcaatttttcggtgagttactatcaaggataaaaggcaatgcttgtgacagttctagttctcaaaactgatttagctagcagagtcaaccaagaagtataaacttcctttgttcttaatgacatcagacaaccctgttaggtgccattagtttctgcatggatttccagctgccacctcaaatttagttagctaaattgaattcatcttcactcttcccttcccctaccacacacactacattttagaaaattaaactgtggtttcattctttcaataaccgaggcataaaatctcagatgcattttaacctctcctcttccctattctactcagacttagcattccagttgctaaatcaattcatcttttctggtgttgatttacattgtttgtgtcacatgcatctagttgctctgttagaattctgattgtatttggtttagctggtcttcaagttgcctcgtccacatctgtgatccttcctcagcttatttcctgtagtattaattatgaaccagggagttgttttgttctctattgcaacttttcatgtctccccccccccccaactaactacctttgctctctgctctgttgcctatacagaaaacttcagagtcttttttgtaaaccttcctgaactgttctgtcccactggtcattgctcgctatctctgtgagttcagtttcctccagagcaaccccactgtcacacctctctcattcttgcctttattcacctatttccaaaagctgaatgctcaacctcttcgtggagcctcaggctctgagagcttttctcaaatcttatctttctgataaattcatccatctcagcattctaaatccttcatttgccattgtattgaattgtagattatcttgtttccttaattaattgaaaagggttttgaaggcagagactgaaacttttctttataaattacagccggttacactgacttttagcagaaacctctagttacatataaattggttttctccctttgcattcataccttcattgttgcgtcatttctcttgttaaaatttttcttttgatgatagaatactcttatatttaaggtaaaatttaaacatgtaaagccttttctgatcatttagcccttagtaatatttttctttattttgtctcaaattaatttgcatttatgacatgcttgacactctatgtggctttttaagagtttgaagggtaaaattaatccctattattagggacaggctaaaattgggaagggatatttgggtcagaggaagcaacatgatcaaagacttagagacagtagattgtatgcttgggcaaaagcctagaacccatgaattatttatttggtctagaactatgtgccattttacatcagctctgtgatagtgttctattgtataatacaaaatcggggttaatttctcacttgttgactactcagcttctgttttcttttccattttcattgtgggaagaaagttggtgactggggaaatctgggttcctatatttcacaagagaagacaaaactgatgaagacctttggagcagggccacatgaaggtcaaacttgtatgttctctttgaggactagctagacatttactttgctaaattagctcctttaagccactgttgctaaagttcctttccagggggagacataaactacatttacccatcctcccaaggttccaacaagaaagtgaggcaagagtccatcatagtttactctggggaactaatgaatttgttgagcttcagcacagagcccaagtagggggttacttacagggatctagacatgctcccccctacttcccatgcctacaaagtgttaccaagcagggatgaaggctttccatagtcacatagatgattcacctttgccccctccagtcttctttagcctctatatactctagcccttccaccaggccatgtgaaggtgaagaactaccagagtgcttcagtaggatacttaggtgagactctcatgccctattccctccatcctttcccccacctgtgcgtgtgttcgcgtgtgtaaactggccgctagcccatctgggacgatcttttgcattttgcaaaatgatgaaacagccaaagatgggtgtttggcttaaaggacagggcaatcactcaagactccttgttccagtaatcagcaactctccggaccctttatttccaggtccttgtgccttaacaaaacccaggcctaaagtcagctgttctatttgactttctcagttctacaggattggagagaattctagattagtgggactgcaaattcagtgtctagttctttctccctttgtacccccaggtcttcttgtcccctccttatctccctgccccctctccctggcttgctcctttttcacagcagcaattccatgctttcactttggtctatagagcccctgctgtgttatattcactttattttcaactggtaaatttaattcctattacagtaaaaaaaaaaatcaagattggcattaagatcactcacaaatccctttccttccctcactgttaacttctacagatggaacccataccttctgtattcctttctcaatagaggaagtatgttcttcatttcaagaccagacctttcacttgaacttcagattcctttccccccctcatctttccttagtactttttcattgtcagtttcttctgtatctttttggttttcttttgagacaaaatcgtatcatgaatcccaagctgacttccaactttcagtcctcctgcctcagcctctgaaattctgagataatagatatgtgccagaatgctcagcttcccctgtatcttccatctctctcagaagtctttattgtttatacaaccatgcttatgttttatactgtatgtgtgtatgtgtgtgtgtaaactaatttgacccagcatttttcttatttttcaattttgtcatagtctttattttattttaatttagttttatttatgtatcttttcttatctcatttaatcctacaggtcctttgtgtatgtatatagtatggtatccagtttggggctttaatttttattttattttattttttagaagattcctcagtatgagaatgagtgggtctctgtttcttttttaattatgtattttcttcatttacatttccaatgctaccccaaaagtcccccataccctccccccagtcccccacccatcctctcccacttcttggccctagtgttcacctgtactgaggtatataaagtttgcaagaccaatgggcctctctttccactgatggccgactaggccatcttctgatacatatgcagctagagacacgagctctgggggtattggttagttcatgttgttgttctacctatagggttgcagatccctttagatccttgggtaatttctctagctcctccattcggggccctgtgatccatctaatagctgactgtaagcatctacttctgtgtttgctaggccctggcatatcctcacaagagacagctatatcagggtcctttcagcaaaatcttgctagtgtatgcaatggtgtcagcatttggaggctaattatgggatggatccccggatatggcagtttctagatggtccatcctttcgtctcagctccaaactttgtctcagtaactccttccatgggtgttttgttctcaattctaagaaggggcaaagtgtccacactttggtcttcgttcttcttgagtttcatgtgttttgcaaattctatcttatatcttgggtattctaagtttctgggctaatatccacttatcagtgagtacatatcatgtgaggtcttttgtgattgtgttacctcactcaggatgatgccctccaggtccatccatttgtctaggaatttcataaattcattctttttaatagctgagtagtactccattgtgtaaatgtaccacagctaatttgtttccattttcccttaacagttaaactttaggaagtaacaatgtaatcttgctgtcttggcattttaggcactcgttgattcttcatatcctcctagtttgtttctgtgttttctttactactgagtctgtacttactagggtgacttttgagttccatattgtaaaattcagcaggactttttggttttaatttttaaaattattcttattgaaatttttttaatataatatactctggtcatacatttccccttccccaactcctcccagatcctccatacatcctgcaggcatccaattccatatcctttctttctcttcctattttattttaaacaatacactagcaaacaagcaaaataaacaaagcaagccccccaagcccaagaaactctcatatacgcccacaaaaatggaaaccaaaatatacaagcaaatgactaagacaaacaaacaaacaacaacacaaaatgtctataaagataccattgagtttgttttatgttggttatgtactgcctgacatacagcctatcggaagtgtggttaatacactcattgaaactccattgagaaaattaagttttctttttttgcaagtggatgtcagttgcagatagctttttggttttgtttctgtcacaccagataatgtccagtcttttaactttcatttaaaccttcaataacagatgctacaatgtagtggtgataaagttagctcggtgattaatgtttctcagtgaatatttattgaatgtgagagttaaattatattttaaatgttgaaattgagatataattcacacataaaactcatctattataagcatagcatttattgattttagtgtatttacagagctatataactgtcgccactacctgattcaggaacattttcatcaccctcaaaaaaacaaaaaccctgtgtctattaggagtcactacccaattcagccctatcagccacaaatctactttaaccactaatctgcagccttaatgttttgcttattgtggatattttacataaatggaataatatgttctcttttgtgtgtgtgtctcttttcagttttaataattttaaaggttctcccatgttatagcatgcatcaaaatttcattctttttatgcctaaatatttcattattattaatgacaataatatgtatttacaacatttttgtctagctactcatttattgatgggtatttgaatttctttctgatttgggctattgtgagtgaagctgctatggtcagagttgtataactgattaaatactgtttttacttgttttactttatttttcattctttttgagagtttcatgcatgctacgtgattactctgccactgaattatagccccagccctaagtaatgcttaaattctttgaggtatatacctatgagtgaaactctaggtcatattgtaactatatgcttaattctttgaataagcactaaattgttttttcataattgctgaaccatttatattcttaccagtggcatataagggctataacttcctcttttagtttcatttctattattataatgcaaaacagctttaaaggagaaataatttatttgacttacaatttcaagctatagtctatcaaagtgtggaagtcaaagcaagagctaaaagcagctagtcacatcctcagttaagaacagagttaatgcattcacgcctactgctcagcttactttctccactctttttttttctttttttattagatattttcttcatttacatttcaaatgctatccccaaagccccctataccctccccccgccctgctacccaacccccccactcgtgcttcctggccctggcattctcctgtactggggcatctgatcttcacaagacgaagggcctctcctctcaatgatgactgactaggccatcctctgctacatatgcagctagaaacacgagctctggggatactggttagttcatattgttgtttcttctatagggttgcagacccctttagctctttgggtactttctctagccccttcattaggggccctgtgttccatccaatagatgactgtgagcatccacttctgtatttgccaggcactggcatagcctcacaagagacagctatgtcagggtcctgtcagcaaaatctttctggcatatgcaatagtgtctgggtttggtggtactttctccactctttttttttttttttttttttgttttgttttttttttttctaatttccatttctttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgttcttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagacttaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggagtattttacctttgatgagtatgaagtgtccttccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgaatccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttgtctgttattatcctttgaagggctggattcgttgaaagatattgtgtgaacttggttttgtcgtggaatactttggtttctccatctatggtaattgagagtttggccgggtatagtagcctgggctggcatttgtgttcttttagagtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggagtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcccgtgtgggcccttgcgggtgttgggcaagactctgctgtcaaggtagcccggggctcgtgtctcgagtcgagcggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagtggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtcacgagtcgagcggaagggacttgtgccactttctccactcttaacacagttcagggaactctgtccagggaatgatcccactcacagtgggtgagtctttccatcctaattaaagtaatttagattattccccatagaagtacccatgtagacaatattcattaaatctttctttcaggtgattatagattttgtcaagctggcaacttaaactaaccagcatactttcccacatctttgttaacatttgttatgatatatcttttggattacaaccatcctactaggtgtatggtggtatctggctgttttggtttgctttttcctcaagactaatgataccagacatctttacctgtacacagtattatttagaagaacctgttcaaattctttgctcatctctaaattgttacttgtttctatagtgtgaacttttataagttcttaatatattctgtatactaaacacttagatttgcaaatgttcatttaattctctgcacatttcattctttaaatttcttcttcatggtttatttaccaatgagtattatttttttttcctaaatctctggatttttttttctcaagttctcatagaagatccttttcttctaatattgtgaatgtttattatcccacaaccaggttatattgtcttggtatttcatacactgcctgcatgtgtgatctcttaattgaactcatattttaactgttatctctatatgactagctttgaggtcaagatatcttttctgtgccttatgctgactgaactctaggacattttttctttgtctctttttggaattgttcctttgttttgagaatataatataattatgctgtttcctccttcttctgtcttcctcaagtgaccaccccgtataccccttcttgcccctccttcacattcatgaccttttctttcattaatttttgttacatgtacatgtgtgtataaatatatctaagtgtaacctgctcagtgtttagaacgttacttgtatgtatgttttcagggatgaccatttggcatatggttttccattaaaaacatttaagccaggtgcagtggtgcacaccattaatctcagcacttgtagacaaaagaagctggtggatctctgtgcgtttgaagccagtctgatctacatagtgagttccaggtcagcctgtctcaaaacacactaaatttttcatataatatattttggtcatattttcctccttcccaagtcctcctagagcctcctcgcttttctgcacacccaacgttactttttctctttatccctctccatttctctctttcaacccccaaacaccaaaataaaataaaaccacaaaaataaaaatcaggacaaacaaggaaaatgaaaaaaacaaagccaaacaaagccaaaacaaaataaacaagatagaaagaaaaaaacaaaaacaaaaaacctagaacattccgtggagtatgttctgtgttgggcaactactcttggacacagggcctaccttgctgtgtggttgaataatggtgtccttatcttttcagtgtcacgaggccctattcattgttgattttagtgcctgtgctgttggtagagaacaattttatgtgatgcatttttcagggctgggaactgaaaaacagggctttgcacctgctaagcaagcactctgtcacccactaaatattcagtcctcagttcaatttttattggaaatgctctcagaatctaataggaaacttaaaatcaatttatcataaattacattcatgtatcccccaccttaatgctacttctattctgttcatttgagtgagtagcaccccagctacctacttctccaagccagcaatgtgctaattgctttggattatttcttcttgcacttccttacctgcagtataatgtctattagaatagattctacctttttaatgttccctcaatatattatcctattttagtgcccttcacttcagatattaccatgtcagtttgctttttcacctcaagtttcaatctacataatgaaaaaaatccttgactcttcttagccaggtctgaaactgtaatgatttcaatgataacggctcccataggtatatttgaatacttggtccccagttggtagatgtgtttgagaaatattaggagttgtggctgtattggcagaggtatgtcattgggggtatgatttgagatatcaaaataacataccaagcctacttagcttgttctgtttcctgtttatggatttggcttagaagctctcagccactgcttcagaaacatgtctacctgcctgactccatgctccaccatggtggtcatggacttaccctcagaaactgtaagcaccaatgaacccttttctataatttgctttgttatggtgtctcttcacagtgaaaagtaagtaagacataaataggtgcttttgatgtgctcctattgaatccaatgcttaataatggtgttaaattataatacatgctagtctataactgttatttagcttacctgccttctccataaaataaagtatttctgtagtagtccttgttttatatgactttacagttatagtgtctgtggcaaattataaacacagtagttactcaaacttgactatcacttatttctgatattatcttttttgaaagataggagagtaaaataatttattattcatctttggccatactaaaactcaagaaaaatatttttattgctaatataactttgggttatcatagatgtttattgagagaattctgttcttagcaggaccttgacctctgtggacaaatgaagatgaattatatatactcctctggatatgcagtctttcctccttatgctccggtggtgtgttgcaagattttggccttgtaattagtgggacaagaattgaaaaggcaggacagtagacttttaaaatagcaatattttaagcattgtctcaggaagctacataaaagttgagctgaaagagtgtcaagaggtcatcttgtcaagctactttacctttaagcgggcaaattctaaaggattcatggcaaatggtcaggcaggagctcctaattactcattgcaaagaatactcattgtgaaagggaagaaagggcataaagaaatgaaataaaagtttaaggtaatgaatatgctaattcccctgagttgatcattattcaatttgtacttgaatgaaaaaacccacattgcacttgcacttatgttctgtgtggtaataagaaagaatttaaaagaatatacattaaaatgcaactattaatctaggcatttggaaagctgaggcaacagaatggcctaggctaactgggaatacattgaagtttctagtccagtctgaaccattttacaagatcctgtctcaagaaaataggctcatatatttgagtgcttggttaccagttagaagtgtttgggaaagattaggaaatgtagccttgttggaaaaggtatgttactgggagtgggctttgaggtttcaaaagccctgatcaggcccattgtctctctctctgcctgcttctggatcaggatgtaaagctcccagctactgttccagtgccatgcctgtctgcttcctgccatgattatggactaaccctctaaaactgtaccaagcccccaattaagttctttcttttataagagctctcttggtcttggtgtatcttcacagcaatagagcagtgactaagctttatcttcaggtgtgtgtgtgtgtgtgtgtgtgtgtgtgtgtgtgtgtattaaagaaggctatgtaaagaaatgaataaagagaaatgttctctataaaagtgtttaacttactgaaaaattactaaattatttctcataatcattcacttgttagttttaaatgtcactttacacaacctcgaaacccctgtgacaagagcctcaatgtgaaccgtgtagataaggtaacctgtggggaatgtctgcaggtgattattcttggttgacttaattgatgtgaaaagacacagcccattgtgggtgactccagtccctaggcaagaggtcctgagccatataagaagaaagaaaactagttaaacatatataaatgagtaagcacacatgcatttattttctttgcatttggatatcatatgagtatttatttcaagctcctgccaatgtgacttcctttttatggtggactataacttgaaattgtgaactgaaataagctatttccccataaattgtttgttggcagaatatcttattacagcaacagaaatgagtatgtaacacatattctttgtatctcaccagtaatatatgaggattctgatttctctacatatttgccaaaagttattatatctgtcttttttattgttttacttgtcttactgaattgaaagtactagatcattttggttttgatttgtatttccctagagacagaggacattgatcatcttttcatgtttattggctatttgtgtatcttatttggagacatgtatattcaagatttttgtccatgtttgaatcaggttgtttttgttactgttgatttataagagttaaccatgtgttccagacaataaccatctatcaaatatatcatttgtaaatatcctctctcatcctacaggttgctttcttgctctgttcttagaattgttagatgcactaaaaattaattttaatgtagtccactttacccatatcttttgttgcctgtccttttagacatcatgtaaagaagtcattgtaaaatctaaattcaggtaagctgttagtttttgcctaaaattttatagttttatgtctataccattttgagtaatttatttatttatttgttattgtatcactaaaacccagggccttatacatggtagagaactttccctaagctatacccctagtttgtgtcaatttttatgaatggtataaggtaaatgtacagataatttcttttattctggatatctaacttacataatatcatttgtttaaagattttctattccattggcacccttatcaaaatcaagtgaccacatctgtgagggctaatttctgggctttctgttttattcagagacttgcttttgaggctttgttacatacagtgtggcaatctgtgggtagttcaacttctctagtaaaaacctcccaatgatggaaagttttgataaaggcagacatttaaaaatttttttctactatgtcactggtgttgaaatcaatggttgataatacaaatgatagtagtctcttcagatgatgaatgacagtaaactatttctgaaagctactgaaaaaattaaataaaacaacataaagcattcagcatacatcgtgtgtaagaaaggattcttatttaaaatattcctactaatagtacccatgaatgaatagaatgatggatgcttttatctccaaatatgagaaacacggtgttgtagatctagagatacctggacttgagtagctctcagctgtttgtgtgtgtgtgtgtgtgtgtgtgtgtgtgtagaggagggatacacaaggactgggcacaaacaccttacttcctcataaattgttaagactggcttgcttgtttctagcatgctataaacactaaatgagaactagtgttgagatgccaaaggagaaaatgaatttagggtgaagtagaaggaaagcagacatttggcaggcagctttatagttctaaaggagcaacgtctggaacaccatgaagcacatcaccaggccaacctaagagattagaggtatttacatagatttaaatctaatcttcctgatttttctgcaaagtagacattatccccattatatagacaaggaagcagactctgagagattattagagaataggtggtaaatggcagaaccaagatttaaacctaggtttatctggaccccaaggcctgtaatctgaagcaacatagattttatttagtttctttgttaaatgtcatccttattggtaagtgtaagaatagctaagacaaatttcagaatcatttgatggttttttttcattgttatttttctggtctgtaactagtaagcctttaaaaaattaatatcctgtactgctgatttaactggcagattagagtattcaaaactgctggcaaagttactgtaagaatgtaaattttctaagttataagcctgtgtatttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctatgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggatgtgtatttttttataatttgcagtagcaacagtaaaatgtaatagcattcttgctatttgtagtttgttgcatttgacaagatatatggtagagtaggtggatgggtatggtgtgagtctctgtctctgtctcatctccgtctctctctctctctctctctctctctctctctctctctctgtctcatctctgtctctctctgtctctctgtccctgtctctgtctctgtctctgtctctctctctctctctctctctctctctctgtgtgtgtgtgtgtgtgtgtgtgtgtgtgtgtgtgcatatgacaagagtagaaacatctgagtcaagaaaatggaaaggtacattaaaaatggttcccagttaaaatcatgtaattctagtgctaaaagacagctgtttctttcactctgcttctaagttcagccagtcatttttataatcccatgttgttcgttgcaaggtaataagagcagaaaatatagctagtttatccaagttaatacctttgtattacctttgttataacttgccacagggaggtatctttcagtacaactgatgccatcttcatagaaaaagtatggaattgttcggatgtatttgtgggcatgtatagtggttcagaaagaattgtattagtggtcccctgagtacattcggtgaagtctaggagaagagttcagactgtagagctgaaatgtgtggttttgaatccttgttcagatgctggcactgtgaccttgaaagatttacttaagggaacaggcagtagtggttgcttatttcaaaacaaggtcttactcatcatatagtcctgaattccttttcctcctacttttgccttcagagatctgggattacagctgtgtctccctacacctagctaggtttgaggtttatatgaaaagtgtgaataataacaggatgtttaattcagggtggcaataagaataaaataatacatgaaaagctcttagaaatgttcccagatcctaaagttttcagtaaatgccagctattttgtttgtcattgttgattactgttattattgttattattatgtgctgagaaataagcaaagagaatagccaaggttttttctttgtgctcttgcaatgtgaaatatagccttttctttgagcttgaagaaagttgtagtccccatcatagagaaattctttaaaccaaagatctggaattgtatgtgattgcgacatctttatggaaatttgacttcatgatgacgttattggatttgtgttaatacaagaaaaaaaaagtcccttttggtggggcagtctaaactaagagcattgcttttgtagtatggagactggttctacttaaatatatgttttaattgttggacatttctacttcccaatttaggacaaaacaatctctatatatcataagatataggaatatcaaaaggaaatgttggatgtttcttcattcatttcttttttttttttttgagattacgtcacactgtgtaaggatggctgctctggaacttgctgtgtagatcaggttaacttcttctgcattccagctactggaattacaagtgtgcatcacaatacttggtttatttatttaattgtttgtttatttagtaaggtatttattgactaactattttgtgccaggtattgtgtattacgtgctgaatatttttattacaaccaagaaaacaaacagcatttcagatcctgatgtaactaatggtttctcagtagggataccaagtatataagaaaatacatgtttatatgtgagtgaataacagaaaagggtcttatttaattagaatgaatacacaaagacttactaaaggagaattgttataatgagaggtaagataagaaaggcattgaagggatggagagatggattagtggttaagagcactggctgctcttccagaggaccagggttcaattctcaacatctacatggcagctcacaaatgtctttaattccagtttaggagatcgacactctcttccggcttctgagggcaaaaggcacatatggtgtccagacacacatgcaggtaacacattgataacataaaatattatttaaaataacgaatggaattcagacagggaagttctgaaaaagcatgtgtgaaagtctcaaagcaaagaagatctctggacgatggaagagctaccaaaagagcagtgtaagtgtgaagtcataagggggaaagctgtgtcttatgagctcgaaaggtaggaggatcaatgtgctcctgcccacagtggtcaggagactttacctatttttctcagagcagtcctaagacagcaaagagtttggtgtgttgaagggataagaaggtgtcagtgtgaatggagtccaatgtgaataagccaaggctgataatggtgtttacttattgattgtattaaaatgggaagctgagggtttcaagcacaaaagtaattagaaaaatagggatttttaaaagataaaaaagatgtaatagtgtgcatgtgcagaaggaaaattaaagagaagccatgcgcagtagcatatgcctttaacccagcacttgggaggcagaagcagaggcaagtagacttctcaagtttaaagtctaacctgctctacataattagttccaggctgaccaggctttcacagtaagaccttgtctcctatgaacaaataagtgaatgcagatcaacataaaggctcttttatttctggattaaaatcatgttagcattgcactaatgtggtgtgtgtgtgtgtgtgtgtgtgtcagagagagagagagagagagagagagagagagagagagagagagagagagagagagagaatgaataaagggcttattttgcatgtaacacttcaaaacttaggcaaccaggaatgtaaccttccatatactcgcatgagaacagttgtggagtaacagacttggagattggaagggatgtggagattaggtaggatggtgcttgcctttagtccagcactcaggaaactgaggcaggaggatcacaagttcgcagatagtctgtaccacagtcagtgaagcattgactgtaaagtagggactgagggtataattcaatggtagaagctaataaacgccaggctctgggtttgatctctacccccaccctcacaaacaaagggaaaaaagtaaaagaggagttgatggcatcattagttgatgacaaattagaaaacattaaccttactattttccctttaaaaaaatcaatcttgctatctactccagataacttgaactcactgtgcaaccctagttagctttgaacttgctttcagtccttcagcatccacctcctgctgaacactaagcatttcaggcctattgtaccatccctggcttggaagttattaatcttgataagaacagtttcagtggtactgcagggttcaaacagtttagatggacgtatgtgtttgtaagctcctgaagataatctatggagaaggaattgatgatttaggagagagatgatgtgctgattagctttatgtcaacttggcagaagctagagtcattgaaaagaagagagccttaattgagaaaatgcataaaatctggctatcgggtattttcttaattagtgattgatgtgggagagcccagtccattgtgggtggtgccaaactgggatcgatcctggtcctggatgctataagaaagcacgctgagcaagccaggaggagcaaaccagcaagcagcacccctccatcagctcctgcctctaggctcctgccctgtttgagttcatgtcctgactttcatagataataaacagtgatgtagaagtatataaatgaaataaaataaatcccttcctctccaagttgcttttggtcgtaacacttgataacattgatagtaaccataattaagatgaatgggataaccaaaatgatgtttgaatgcaagataaatataatacagagaaaaaggagaaagcttatcctttgagagtggggaatagggatttatgtactataatagaaaataaagatgagaaaagtgtttagattaaactggtagacatagtagtgagaagggagtgtgtctgtgtctgataacaccattcttaatagcataaggggacaggatcatgagggtagagaaggaaaagcagataattttcttgtaaagcattagttgagaaaagtcaatttcagacagacagtatttgatacctatttgtagtctgtgatcacgaatttacataaagcttttcaacaagattatatgattttctacagcaacattaggctgctttggcataaattcaggacagaaaaatctctgaatttattcagtggtgagaggatttgttttattattgacagagaggaagagatgaagaagttgcggaaatgcttataaaggtagatcagtgactatgctgaataaggaaggaggacatggagggatattgtgaaagtggcatctcagtgaaattcatttgttgaatatcagacaaagaattgaaaagagtaaaaattatagaaacaaatataatattaatgttaaataccaatgtgccaatagctataaaattctacataggatagggtgacagacaagcaaatctagaagttatataatatcagctgggaataaaggatgagtagcaaaaaagttagaagaataattagtataacaaagacattgttttagagaagccaaagaatagcttataatattttcactgtcttgaatatggctagacagtcttgtgaatatcatcatttttactacacttcaagcttaaatattcccaatgaaaagtagccttactgttagatcactattcttcaccatcttgtatttgatttttgtttctgactttaatggactccagggaaaaattttaggatcaactgcttatatcttctaactgtcctatcacagctattgtgagtacacaaatctatgagagaaatgagatggaatgtgcccccaaactatgagcaaaataaaccttccttccttaaaaaaaaccaacaacccattatctaaataatgtaaatgtcttcagatatgtgccccttttcccaactgaaataaattttggcacatggagtggagtgatgtgaccaataatccttcaaatttatcacaaagcagtaggacagtgaggaagctggtaacagtacatccatggtcaagaagcagggagagatgaaggctgttgcatctttgccttcttattcactcctggatcctggctcatgggatagtgtcaccagcagttaaggtgggtcctcacaccttgattaactaaatctggaaactccctcacagacatgaacagagagttgcttccatggtgattctagatcctgtcaatatgacagtaaaatctgcattcatgtattcaaggctctgaaaggctctacagtcttgggtgacctttggctacatgtcatcttgtgtttccccaatagctttgcttttgtctcattccacagtatggctttccatttttttccagagaaggcacgctgaggaattctggtttcccaagactgtgcatctttctttttaaaaaatatttttcagatcccatcattaaatcatttcccccccaccttttgcttcctacaaacctttccatgtactcctccaccgctgccttgctctctttcaaattcatgatctctttttaattgttgtcacacacacatatgtatgcacacacacccaaatacataaatataacccattaaatctgtataatgttacttgtaggtatgttttcagggctgaccatttgctattagataaccagttggtgagctcttccctggggaagactatttagccatatgcattttttagttgtctattgttctttgtatagaattcaggcctcttgagcaccctcaaccccaatttacattagtatgtctattgctgtcgtccttgttcagttcatgtttaggctgtcatgtttttgaggctttatggttatagcttctgatgtaactagaagatgcaatgtcaaattctttgttcttctggctcttacagtgtttccccctcttctacaatgacccctgaaccttaggtaagggaattgtattatagatgtatcccttgtagtttttttatagtgatctccatctattgcaaagagacgtttcctctatgaagggtgaggactacacttacctgtgagtataaggataaatatttagaatgtagttagggattatgctgggttagtagggtggtgattgtaggtttttttccccaagatccatgactttagtagtttggggtagtcgtctaagttttcagtattcagaacagttttcctcaggttatttgaatttttagtattaaattacactggaaaccataaggggctaaggaaaagaacaaacagattttgagtgaattcactgataaaaattaggtttatattactttttaaaattctggagtgagttacagttatatgtgtagttacactcattttagatatagtgatgtttttagaactgtcataaaacggaccttatttttcacaggaactatattaccattgtcgtgtgacattgtcagtctatatttaactttgaaagaaaccagtactatgtttctcataatggatgtagtaatctaaaatccaccagtaaatatttcacactttccctttattcccatcttaatctacattatttattattcatttatatcttttgtgctaagctcaagatggcatagaagcccttatgaagtggctttgatctcatgatactcctgcctttgtataaggtacctgccttgactttttgattttccatctgagcatgtgtgtgttgtaagatatgtgttcgttgttttagtgatatctgttctgtgtataatgattatttataataatttttgtttatcattctctgattattattgaacataacttcagattacctgttagtagcctttaaaaacagtttgcttactaagtcagcatctcatgtagttcaggttaatttggaagtcactgtatagatctccattttcaactactgggattagaagtgtgtgccaccatgcccagtttctgttagcaacttttaatgtcttctgtggagaaatgtttcctcaggtcctttactcattttagatcaggttatttgtctaccattaggttatttgtatttttatagtacatgttagataattaaccctcatcaaaatacaatttttgcactttatctcctaatctacagacttccatctcattttcttggtggtaataaagtcaccacacaataatagctttggacctataatgatagaagatgacagtggtccaggctctgtgaaattgagtgcagcagcaaaaaggatgtaatgatggcaaaatgtcaccatggcttggttctaacggtgagagcaatatagcaatgactacccctctgggagtgaggagacctcagtaattcagattggaaagctaatccaaatgctgatagacaaggcactatgtctctttggcctggaacatcaattctggtgggatggcacagtttagctaagatggtagagaggcacaatatttacttggccctggaaaggatgtgtatgcatgttaccagagcctccagatccctagggtataggacatgacataaaccctgcagctagtgagatatatcaaagactcagaggctttagagtccaaggtcatgctttacctatggatttatattaagagaagaactagggtcaattgctctggtgtgctggaggcctgaagtccctcttagggattgagtcctgccttggtggaggatacaaatcatacaatacacagaatgcttgtactgggagaatggagttgggcttcaacttggccctaagggaagcatgcacttgttgtttggaatgaaggaaatgggaaggattcatggtacactggctctacgaattaagaaagagtaccatcttggctggcaatggctaccagatgggtgtatttcagtgatggcaaagcctctagttgagaggcctttatggctacttgcctgcagaacatgtggtcccaagatggtaccatacagtagcagcatgggctatgagaagtagaatacagtgttatctccttctctgggggtagcttagtatcaatactgggtagtttcagaggctgttcttccaaatgattcttgtttgattcctagcacccacacggccactcataactctttgtagctccagttccaggggatctgacacctacttctggcctttatgggcaccaggaacacaagtggtacacaagcatatatgtagccacaacacacatacacaaataaaacaaaggtatgtgtgcttgtttagtatgtatgagtacattcctgagacatatgcacatgaaaaaaacgataaaaccaactaaaaatacttacattgttttcctttccctagtagactgaaaaccacatctgggcaaagattaaattttgaaggaacatggtaaattgaacattgagcattgaacattgagtaaataacgctcctctctattagcaagataagcagaagatggtattgcatgacatgttcacttttgagaaactcatcctctaaataggttgcattcaaagatctcaatatgtgatcctaaacttcattattatagcattaaagctagaagccacttagataatattatatatctactacattttttaaggtgaagaaactggggccttttaaacaattatcatgttgggttattttcttcactgttttctttcctttatatatttattttgtatttcagcatctgtgttccaaagagctaatggtgtttttactctaggacctaagagccaaggtcattttctgaaaagggtggagctgaggaagagtaattctttgaatgtttgaggaacatgagaaacaaatgaaaaatgtggcagaaagtgagaagaaaacacagcaaaattaatgagcaatgctcaatgtctagctgctactgtttgttttgtggctttaccccacaactagctaatggatttaggattggagaaaagatagaagaaatggtcattggtcagaatttaactagatgagttaaaccatcatcactgaagttataaataacaacaacatttgtaatgaaggaagagagcttatgatttcagcaagtctgtaatagaagtaatgtactaggacacttaagctagctaaggaggaagtcagaaaaaatgtaaatggcaaagtagaggaaagatcagtgaactagccttgatatactgaaagaatggttgttagtctggaatattgctattgaggactactgtgcttatattggtgattttggagattgagtggtaaatggtcatctatggttgcttccagttgcgtgaggagtgagtggtagatgcggtatggaaggaagtcactggggatgaggaaattaatgactcagagttcagcatattagataagctacaccatacttctatacgtttatcttctctttcttttttcctttattatttttttttaaatttaatttaatgtgtatggttgttttgcctgcctggtgtatgtctgtgcaccacgtgtgtgtctggtgcccttggaggctagaagaaggctttagatcctctgagattggagtcacagatggttgtaaaacatcatgtgggtcctgggtattgaatctatgtcctctaaaaaagcagttactgctctaaaccactaagacatctttccaacaccaaggacaggatcttattagtgttcattagagacatctaaatgccagctctaggacagctattctaaactattcagagtttatcctccaaggaatttaggagctcttaggatgagtgtattagattagatgttatggtaagaaagatgtatgaattttcagtcttttcctgtctgctattctctttctctctagacatagtcagatttttttcttttaaaagctctttcctctatcttgggatataactcagtaggaaaattaacctttgacccaactttaagctttctttaaaacttctctctcaaatctattattcttttcattgttataaatatttatttattggaaatgcctaattttcactgagcaatattatggggaaaagagtaatcatcatagtatacaacttttgtcacttgggagtatacatacatacatatatacatacatacatcttatttttcttatagtttgaatcataactgataatataagagaacaaaggctttatcacacacatacatgcgtgtaaacacacattaatatttgtgctggggggtagaactcaagggtttatgtatgtaggcaatcactctaccattgagccctatgaccaatacatttttaattttgtatttttaaagtttttagcttacatttcctgttttcttcatattctgtaaaatgttcaaatatttaactttttatgtattataaatttctaatctgttttcttatggtcagacctttcaagtaattcacacgttttgctgttcctgataacaatatattctacttcatcttgtgttcatgctttttttaaactctaattctttaaaaatatttttatgtgtctctatgtgtgcacatggatctttgtatgtgcatcatatttgtgtgtgtgtgtgtgtgtgtgtgtgtgtgtgtgtgtgtgtgtgtgtgtattgaggcctgaagttgatatctgaagtcttcctcaatcactctccaccttattggaggtctcagttgaatgtagaactaatctaactagcaagcctgctttaaggagcttctgtctcctttcttagcactagatttatggggaggtcaccgtactcacccagcatttacatgggttctaactacacaacttcttgtcctcaatcttgaagacaaatatttatctattgaaccatgtttctagcccctaatttttttgttgagctgttttaagagataaattcctagaagtgagattagctggccaaagattatgaacattttccttccgatgaacttactgaaagaactgtataccgtttgccttcatgccctaacactttccttaagtatcttggaatttgtcatcagtcaaacatctttcagagattacaaagtggcttcctatttggaaaatgaatcggctcattctgaattttaagaattcttataatttataagatgtaacactttgttgcaactatcttcttgaagttctcctgtcttggttcatgatatgatatttagttctctttctaccttcgactgattctgtttcttgaatgtctgaaatgaagccttctttaggttgtgttcagtcccttccaacatgaataaactacaaaccactttctctggttccaacttctcccttcttaaattgacaataaagttgttttcatacactatgttctaataatggtttcctgtctcatcttctccttgatcctttccacctcccaacccatccaactccccaccttctttctctctcttaagaacacaaataggcaaacaaaatagacaaagataaaacaaaatgaataaataaaaaaaaagacactaaggaagaacaccagaaatgtatacatacacacaaacaaacatatgaaatccttaaaacctcaaaattgaaaaccatatatacaagcaatagaccagtaaaatgttaaaaagggagaaggcaaacaaaataatataagattttaaaaacctccacaaatacctttgcattcattttatgttggctttgtactgctggccatggggcctcctcttagtgtggtttgtatacccccagtgagattcccttgaagaaagtaagtttttctttgtgagtgatcattggagataatatcttggttgagaatgagaacattctctactgtctaccccggcactgggaccctgtctggttttatctgtgcacattctgtgcatgtgaacacaggctctgttactccatgtgtgcacctgagttctttattgctctaaacatccattgcttgtttttgtaccatgtatcactgtatctacaaatgaaataatttccactcttcaaatctgataatactatttgcatttctagagtttgaagattatgggtagacacatgtcggacccttttgccttattccatctgttctgctggttgtcatattatgttaattctaattattttacaacctctgggtttttttcatatttttatatgattctttcatttaacaaatatttttagagaactgtcatatgcttggccccaagggtacaccaggagcacaacaaaaatcctggacatattgaagatatttttattgcgggaaactatgcaagcatgaaagtaacgcatgcagaatataagataaaaagttacatgttaaagaattggggaaagtcaaaacagggtgtatatgtatgcacaattagtccaggaaagtaaccaagaaagtaacatttggtcaaagacttgtaggtagtcagaagagaagcccacagacgggaagagaatgatggttcattccagatagaagggctagcggtttaaaggttttaagagagagagagagaaaaacaaacaaacaaacaaacaaataaacaaacaagtgctcagaatggacagagtatttagtgtaaatgaatcagaatgagaaaagggaaggtaagtggggtgggcgtcagatgtaaagtgaaagaaccagatcttgtggagattttgatgtgctgtgagtgaaatggaaagtcatttgggcaaaagattgagctgacttgatttcttattgatgtaactgtagcttctgggtcgaagctagattgtatcaagtcaagggtagaggcagaaagcaagtgaggaggcagttagagcaaatgaaatgatgatgatgctttggaccagggatggtagtaatgaaagactgttggattctacattgaatattgttgcaatgtgatatttaagaggaaagaaggctatcaaaaatgacttcaaaattttggcctgaagtgaaagaactaagttcccccctctctttattttgccttttttggagctagggtctttggaattccctttatgtagcccaggctgatcaaagtcatgatgctcctcctacttcagcttccaagtgctagatctacaggtataaggcattttcacccagctgagttattcaattacttttatgtatttactctttttataaatccccggatgcttaattctgttctactctgttctgttgcaattcttaattactttttaccctggctgtgtcaatattcttgataaatgttcagtggtcaatgggatcatcctctcccagcctctctccttaatccagtacatcctcaatacagcgaagcactggtcatatattctttttaaaatcttccacagttttcagttgcacttaactccacaggcagactcttctactttgcatttaaaacctttcataatatgagctcaacctatttaaccggctttatcctttatgatttccatatgtccttcaaattaaaatggcttgctgtctctctgaagttagtgtttatcaacacctccagttataaatcatgcttagttgatataacatggtggttaggagcatagactctagctgaacattccaagtttgaatcatgtctctacatctcattgtgttttgatgcagtttacgtctacctctcaaatttcaatcagacaaacaaagacaatagttgtgtacttcatagaaatgtttgggaaattaaatgggtttatatatacagcatttgaacattgcctgacccatgtttagttctcaaaattgttagctcttactgttattgttattaatatcattttcttttcctagtctcactgtagtgccaggctcatgtaggtaaggactttattctgtatactgctctatttgcaagacctacaatagtgttttgcagataatgaacagttagtaaataaatgattgcagtttccctggcctgagattctagttgctgctgccacttctccacattcttttaagaaccttatgaacctacaaagctcatcatgaatgacgtttattccatagaacgctctggtttttctgattcttattccaaactaaatttaacctctcatttctctgaattcccgaaatatcttgtatatgtttcttttacatcctttactttccattgcctttcatcttagtcatttgtatctaatcttgcttactagatattaaggtcttaaagcacgtactgtgtcttactcattttttttattctctgtggtgttagcataatgccttgaacatggtagatgctcaataaacttttgctgattgaattgaattgaattcattctcctatttatatgcttagctttatatgaatttttagatttctaagtcatgcttccaaagtattaaatctctctgcaatttacttcttaggtatcctaagtagtcaagcttagaaagactatttatatgcaattgcaaaagaagaaactttgtctctgccaagccttcttcagatggcctgaggatttgtgccagatcacaaaattgttctaagtcagtgaaagggaaagtttgttaaatatggtaatatacagctgaaattcagtattctaataaatattcacctaaaaacccagatggagaaaaacagcttttgtgcagatgataaagtgtatggtgtaaaatatatgcacttaagctcatgtacttacaggataagctcctcaaatactaactcataatttatttactaatcattactcttaaatcatcacttttagatttacagctaacagctggggagaggtaaattataaatgctaagaaagttcacagaagatagtaggagggagagactgctgactcccatctaagagacagaaaaattaaaaaccaggtgaagaacctacagcagtgtggaactaatagccccatagagcttaccgacgccttgagggcatcagtgccttatgacaatacagtgattgataaattgacgttcataacgattcataaaagcattaaattgatacccaccacattatattgatgagataagcagtggggattaagtgttcagatttcatccagaagattaaagtacagattatattgtatataaaatagtaaatccttatctagctagctagataactcattcctgagttaagcataagttaaatgtaaaattcctactttttatgcatacctttctgtaccagtccctctaactagaattgaaatgcaatgctaaagcagaacgaggcagtaaatccataaaaatgaattgttcattcacactacatttataacataggaaatacgattatagaacagatgttgactgattgaaatgctgtatgctcaatcatgttagtgtttatttgataaggaatgccatttgtttagctttgctcatttatttagtgactgtggtctggaatttgattagatgctgtctggctgtgtatctctacccaccaaaatcctgagtcagtattagcttacaggagaatggagaagttacagctttttagctttgagaatgaaaataggaagacagttttgtcaatttaaacatctttgtttttctgtatttcacttatgtattggtatcacaacgcagatgtgactaatagtctggcaatagtccttccttgtttaactttacactgaaaattgcatcttcctaaaagtctttttagtgacaaccagggagagagagagaaccaagaatatttcctgaaatgaaatcatttacagatgatgtgtttatgaatcatgggaaagactaaaagttaattgtaaagctactgtgattctaaatagtcctatatttaaaataaactactcaactaatttttgatctcccttggagacagcaaatgtcttttctgtggcagcaagattacagcaaatgatttcatgggaacatttattcagatgctatattttattagctgataattcttatgatatacaatgtagtataataaatatttgaatgaatagatttagaaagcaggtaatttgtagtaagcatttcaaaacatggattaactttcatttctagaagtagtacatcaagctattttgtgatacattgtaaaaatcctgtttcagtgaaataaaaattaagactttacttatataaaacatttcagaaagaattttctttacatttacagaaagataaataagattttaaacacaccactgaatatttctgtgttttttccatctttaaaaatattagaaaaagagtcctttgtttatcatcatcattattttacatctatatatttgtgcttgtatctgtgtgtgcttgtatatgtgagtgtgtgtctgtctgtctctctctctttctctctctgtctctctctctgtctctctctgtggggtgtgtatgtgtgtgtgtgtgtgtgtgtgtgttggtattttgctaaaatggaagtgtggaggtcagagaacaacatgagagttgtttctcttcttccatcatataggttccaaggattaaagtcaggtcattaggcttggtggaaaacacctttactagctaagcactctcactggcctaggaaagagtttttagtggttgccaatacatatcaagtattgttgaacttaagccaggcctgttgaagtgtctgtcatcccagaacttaaaaggctgaggtagaaagattgtggcttccagaccaatctggtctatataagaaaataaatctctggctcaaagaaaacaaaacaaaacaaattagtatattctcttaaaaactacagagtaaaactgaagaaagtgcagaagaatatgaatattatagaaacataatattttaatgcagaattagaagtttcttctataatctctgtcttagggtttccattactgtgaagagatagcataaccaaggcaactcttataaaggctaaaatttaattggagatggtttacagtttcagaggtgtagtccattattatccagacaggaagcatggtagcatgtagccagacatggtgttgaagaaagagctgagagttctatatcttgatccacaggcaacataagggaactatgtgtcacaatcatccataactttagttgcaggaaacccactaccctcttctggcctctatggatagaaaccaggcatgcatatagtgtacgggcataaacacaggcaaaattctcatacatataaaataaagttaaaataataataataatgataataaacaactgcatgttaacacaaataacatcttaatgacaataactatattctattgcacagcaataacattgttaaattcaatgtcatttctttttctgaatgctggtgagactataatgtccatttgtataattttatatctgttaccttattccaattcaaagccccagcacttttctctacacccactttaaaaataacaatgtattaaggtatttagtaccataaaatttattcactaaagcagcattgcttcaactatcagattgttttatagtggcaactatggatatccaattaccccacacccctttcttttctcttgagacatagtgttgctattatacaacccaagctagcatcacattcacagtgtgctggaaactgtcctccattataagttcccaagtgcttgcatcactggcatgcatcgtcataattggctacttccacatttcaaaaaattatatttatcccagtgagtccaaagtgatatttcaattgtgcttttgatttgtattccataaatgatagtgatagaaatcatcttttcatgcaagaatctctttgcttgtgttctttggataaatttatatttaagtcctctacctgttttttcaattgaacatttactttttattattgggctataattttggaacttctaaggatttttttagtttcagctcttacattcagatctcatcatcatcactatcaccaccaccaccaccaccaccaccccttccatcaatcaccactccttccatcaactaccaccaccaccaccaccaccactaccaccaccaccccttccaacaaccaccaccaccaccaccactaccaccattttgagacagtatctggctatgtagtctagggtatcattgagcttctcatcttcctcagcctctcaattgctaaaattataggtgtgtatcattgtgcctagctgcaatccattattaaatttttatgtattatagtgaaggtgtctataatagctaatttttattgtcagcttaatggggtttagaatcaccatggaaatgtctcagagtacatctgtgaaggtgtttccagaaaagtttgacagatcacagaagacttactctacgtgtgcatggcactatcccattggctggggttccagactgaataaaaaagagcaagtgacctaagtaccagcatctgtttctctctatttcctgactgtgactactatatgatgagcacttttggcttctgcctccttgatttcctcactacaagggactgtatcctcaaactataccaaaatgaactcttaagtctttttgtcaggtattttgtcacagcaacaagaaaagtaactaaaatgtgtccacattcattgttttgctacagttgtttgaagattatttttctcctccccagttgacctggtatctttgtaaaaacataattgattgtaaatcatatatgtgtgtatcttttgtggctgatatatacggtccctgtctaaaatgtatttctagttaaaaatagtgtgtgccacgatgtatggatgtgcacatgagtgtaggtatttcaaaatgcagagatattggattccctggagctggagatataggtaattgtgagccaccaatgtaggtgtctaggaaccaaatgtgatcttctgaacaggcattaaacactcccaaacactgagccatctcttcagcccctgtttatggatatggatattgatatatggatatagatatattcttctggcagtagagcactcaattaccttgtagtttctctaaggtttatttttaatcatgtgcatatgtgtatgcttgtgagtatatatcacatgtgactaccccgtagaggccggagctctcagatcctgatgtgagtgcttggaattgaatttggattttctggaagagcaatccactgagcaatctcttgtgcctgtacttcatagttttaaaattaaagtttacatgtatgggtatgtgtgtgcacatatgtcttcactatgtgtgtgcctggtgcccatggagaccagaagagggtgtcagattctctgaaagtggagtgacagacagttctcagccactgtgtgggtgctgggattccaaccctggttctctggaagatcagctggtgctcttaatcactgtgtcacttctctagccctattttttagttttgtactcagttttgatattggaagcgtatattatttgttttgttttgtttgtttgtttcttggcttgttttgttttgttttcaaaattgtttttggagttctgtgcctctgaacttcagtatgagttttaaaattcaacttatataatgattctaactgagattttagttggtagttttgcatttgtagatcaattaaggggttattgccatctagataatattgacttccactctatgaacatgggtatctttatttaatcttattttacttgccttatttaaaaattattttgtacctgctattaaaagcctatacttctgtttgcaaatgtattcttatggattttgttttatgtttgatgttattataagtggggttgattttgatgggactggggattaaacctaggttctattacttgcaaagcaagaagagttccatcacagaatttcatccacagccatataataacctaaatttttcattttctaatagttcattacatgtatagaaatacagataatttttttacattggcatttcggacttgatgaattactttattagcattggtaattaaaaaagaaaaactttttattgattctttgtgagttctgcatcatgcaccccaatctcacccagcctccattccttcatatctatcctctgacttgcaaccttccccacccccgagaaaataataaacaaaagtaaaaaataagcaaaacaaaaaataaaatttcactgtgaaagctgtaatgtcacagtgtgtcccacgctatacccttttgaccacacatctttacttaaaatgtacattgcaatgggtctcgtgcaaggtgtctggttctgctataccatcaatattgggtcctcaccagaactcctcttggatatcccgttgtttctctgtggagcatctacagctttggatctgcaagtccagccccttcatgtgctccagcagttcatggatgaggtagatgttggggtggatcagctcaaagccctggatctgagcctgggcggtagctgagctgattagcctgccagttctcctagacccacaccaccagggtgagccctccagtactgccctaactaggtcacccagcgttgtagtcaggaagcagcagggacagctctcctggtctcatgcccttgggccagagtacctgcccccataccaactgggccagctctactgtgctgtccaggtgagtatgggggctgctctctcaagtgttgcagctggtgaggaataggaccagctttcctgccctcatgatctcagggccagcatccccacctgctgcagatgtgtagagatgaggaagtagggagggcatctcttcaaaggctacaccatctcagggcaggctaacagtggggccagctctcctgtgcttatgccctctggtctggctcacccacaagtgctgctcaggagaggtgctttagctggtgaagagcagggccagttctcccacactcatgaccccagccagctttcctgactgccacaggtggtgagaggtaagggaatgatggtaattttttaaaaaaaaatgaatactcattttttataatactcttgtcatctgaaaatagaggtaatgttatttctttttttccaaagtgggtgcttattacttattgttattcttagtttaatatggagaatagaagtcataagaagacacccttgtaaagggaaatagtatgctcgctctctctctctctctctctctctctctctctccattccaaaagttgctaccctttccagtccccccctctcaagttcttcaccaccttcccttccccccacctctgaaagagtgtcctccaaacctactcacttccaccagcattcctcttccctgggccattaagtttccacaagtttaagtgaatcctctcccactgaggccatgccgtacatgtgcccagggccatgaaccagtccatgtatgctctttggttggtggcttagtctctgggagctctgaggggtcttggttagttgacaccgttgctcttcctatgggatggtcctccccttcagctcctttagtttttcctctaactcttccatataggtctccaacctcagttcaacggttggctgtaagtatctgcatgtgtctcagtcagctgcttgtagagcctctcagaggacagtcatgccagtctcctgtctgcatgcacaatatggcctcagtaatagtatcaggatttggtgtgtgtgaataggatggatcaaaagttgggttagtcactgtgtggcctttctttcattctctgggcatttttgtccctgtatttcctttagacaggatacatatgatgtcaactttgggtctttcctagagttattgttcagctatctgaggaagttcctttctattgttttgttttaaaggtttcattttattttgtgtgtggatgttttgcctgcaagaatatctgtgcaccattttaatttgttaagttttttcttttaactatgagaattttcttacattgtcttgctgtatagcccagattggcttcaaacttatgatcctcctgcttcacctttctaagtgctgggcttgctggtgtgtgtttccatgcccagctaaggatatttcatgttgtcaacattttatgtgattattaagatattgtagtggtttaaataggtttggaaactcatgtgtttgaatgcttgcccctagggagttgcactgctagtaggatgtgcccttgttagaggaagttcatcactgttgggtgggctttgagtttttctatgctcaggttccacccagtgcaagagagaccctcctcctggctgcctgtggaagacagtctcctcctggccacctttcgatcaagatgtagaactctgccaggcatggtggcgcatgcctttaatctcagcacttgggaggcagaggcaggcagatctctgagttcaaggccagcctggtctacaaagtgagttccaggatagccagagctatacagagaaaccctgtctcgaaaaaccaaaaaaaaaaaaaaaaatgtagaactctgggctcttttagcacatctgcctggatgctaccatgcttcccacaatgataataatgaactaaacctctgaaactgtaagccagccccaattaaatgtttgcctttataacatttgccttagttatggtgtctcttcacagcaatagaaccctaactaaggcagaagtttatggatttcttcttttatctatggtacattgcattagctgattttctgatagtaaatgaacattgcaatcctgggataaattctacttggtgatgatatataattattttatgtatggttagattcatttttaaagtattctggtgctgggtatgatgccttacacatgtaagcccagaacttcagaagtggagatcagaattgccaatacgatggggcctgtctgggctatagagtgagaccccatctcaagaaaaacaaacaagccccaagtattttgatgaggaatttttatgaccatattcagaagtagtatttgtttgtgttttttctttattgcttttgtttgatttgggcattatataataatagaataaaataaaaaatgttttaccatcttaatatttcttcaaagcgtttatgagccttaactgtaatcttttactggaattcattaataaatccatggtctgagcctaggattttctttgttagtacattttggattggaattcaatttctttcttaccttcatagctacccttattttgtttttcttcttaaataaacatcactttttgtttttctaggaaaattcctacttcattttggttatgtacatagagttcaagttattccttcatagacctatgtgtggtcagtagcaatgccctcttcttcattccaaattttaataatttgagttttttgctgtatagtttttctgttaaatacacttagaaattatttgtttcttttttcagtgattaatttgtttttgacaattacacacacatatatgtgtgcatacatgtgcacacaatgtattttgattaatctactcccttattattatataattttatgatgtaatatataataaataatatgcattattataatattatctgactattttacctctccacttatcgattgccatctctctataatagcaagtctagcattttagtttagttctgtgatatctgttgtaatcttgtagtagtataataacgactcagatgctctaccaagttaccaaaactcttcacattgtgctatacaatctgtttgagcaaagggggaaaaaggcagcttgatccatctttatcttccttttacaagtttctataccctgctatcaggatttactttcacttattactgagtaacctttggctttattgttttcatttgaggaaatgagaaaactttccttctaaatgtttatcaacaagaagttattccttttggaaatagtaattgaattctgctgtcctgtgtgatgccagagatgagctcaatatttggcctaggcctctttcattttcctggaaggaagaaaatgtggtggtccttcacatgtgcctggccagcaagtgtagcatgaatctgcagtagctccatcactgacttcaccttgtatacaacgtataaagaaggaatcttgaaaagtaaaatgggatcagtgattaggtttcaataggtcatttgtagcccagtctgatgaaagtaggccataaaatgcagttataacactaatgatagcaaaatactctatattccacattccatgcaagtactgtcccctgttacagtcttggatctcactagcattcctaacttcaaccaggatatatgttattttttttctgagtcataggttgtgaaaacttctgaatggatgaaagaatgtattttcaagggatgcgccctagatagctcatctttttcattatcaatatgagcttaaggaaattattcaacctctgaagttcacttttcacatgtaataaaatatgggtagcataaaagagttgtgaaattttaatttgataatgtgtctaatacttaaaaatatacaagttattataaatagtctttgtcaaaatattttctcttctaaggtccatctggatgatgtaaacagatcattaaaacattcttagctgtatttgaaatgtcaagattgaactatctgaacttaaatctgttgacttttagtttattctctgaaactttaaagcatttgtataatgtattttgaacatatctgtccaatgctacttccctcttactatcgctgtgctttcccttgtctccatccctacttcacatcttccttttttactgttattaataacttcctaagtctaagtgctgtccatatgtgtatgccaggtgtagctaactatgtgtgctcagctgtcaatgggtcaccatatcaacctctctgacccaaatctgctgactttttaagatttttttaaaacaagagaagttattattaacaaaccatacttgtttaccccatcctgttattgaaatgtcttctgtcatactttggtttctgcccagcccctggctacacaatcattttatttttctaccatctcatgtaatcctggtatgttccagctaatatttatacttgctggaattggagtagaatctcaactcaaccaaagcatttatcctacctgaaaaatattcacttgattggcatagtactatgataacagaaagtgtctcagaagaggggaagagtgttttagattataataggaaagagatttacacccgctttggtgatattaccaaacttgcttatagacccaaaggctcttataattgaatgtataaaggttatatatctaattcagtaattaggatactagacatttattgagttttcattatatgataggtgcagtgataaatgcttacctgtatcatttagtttaatcctcacaacagctataaaacttgtttctgtttttatctccatctttaaaaatgagtaaatacatgtacagatatcaacacattaaggtttacatagacgacaaatggaagactgaggtttcaaactgacatgattctagcactacattcctaaacatagtatatggtgtttcttatgtattgtgaatgtagcttctacagaattccagaatgtttgttttagtctaccaggatggtctgaaatattgtctgtttattattttcttaaggcagccttttctgttatttgaacaattaaataggagctgagaatgatgttgaaataaaacctgatactgtatatataaactcaaagcaaataattgtctgtaatatgaatacccacttctcacattaaacatgttatccttaccaaaaataaataaataaacatgagagttaaatgacatcataggtcaaagagatgtagcaatcttctaccaaccattccagttaaacactgcaaaatgcattcttcttggtacctcatagaatatctttaaaaatagatcatatattaggatgcagagccagtcctaacaaatacagaggaattgaaacaatttattttattctagctgaccacaatagaacaaaaccagacatcatgaacaagagaaactacaaaagatatacgaactcatgaagtttgaacagcacacgagcaaatgatgaatgtgtcatcgaagaaattaaaaataaatttgaaacatttctagaatcaagttagtcacaggatatagaacagtcaagtttatactgactaggaagctttctccttgctggctagtttcaagagtaccctgtcagaggatggccatgtgggacatcaatgggaggagaggcccttggtcctgtgaattctccatgccccagtgtagggaatgccaggacagggaagagggagtaagtgggttggtaagcatgggggaggggggtggaataggcggttttcagaggagaaaccaggaaaagggataacatttgaaatgtaaatttaaaaatacctaattaaaagaaaagagtaccctgtcaactgtgataatgaccatagtggcaagatatgcacttgggtgcaatagtggcagaaattttatgtgcataacatgtgctttctgattggatttaagggagctccgtgggaggaagcacatgctttatattaaaaatgtggctgtggtagtttgaagaggaatggcctccataggctcatatatttgagtatgttaggtatttgacagggatttttaggaggtatggcctgttggggtaggtgtggccttgttgaatgaagtgtgtcactgggtgtgggctttggagtttgcatgctcaagctaggcacattgcacagtgtcatgctcttcttcctgctgcctgtgaatccagatgtggtactctgagctcctgcagcactgtctctgtagtatgcaattatcctttttgccatgctcataatggactaaacatctgaaactaaaattcatctttattaagtgctttccatcataagaattcccatggtcatagtgtctctttacagtattagaatagaacattgactaagacagtggtcaaaaagccaagttcataggcctcaggaattaacctactactattgttttgctaagttctcatagtatccaactgcctctaaattcttatttccatagctgtagattagtgcaactctaagacctcatcagaaaagtttctttgtgcagtgggtggtagttaatgaagaatatcaaaagtggtcaaagtgcagaaaataactatcaatggaatactcagccacaaatggggcatctaagtcacacaaaatccccagtgtacaatgtacaaggacaattgtagaagagaggacagaaagattataaagcaagagtccagaggagacctgagcaaaacagtgtgttctggataggacaggaccactgtactcatgaactcacaggctctgtagttggttgcacaaaatcaagccagtcaccattcaagcatgaagtgagttcttgagcctgtacccctaactgagtagatggcttctgtgggaggagggtcagttttatttaagtgtgtgtgactctacttaggagacagagacagtgtctacataatgagttttaggccagtcacagctatgcagagaaaacctttctcaaaaacataaataaataaataaataaaaaataagaacacaaagggggagaatttgggtgtagggatgtgtgtggtgggagttaaggggaggagttgtcagtgaatatgatcaaaatacattgcgtaaaaattttaaagaataaaatatgctttaaaaaagcaaaggaacagaaatgatgatttaatgattgagaacacttgctgctcttaaagaagaactgggtttggattctgacaccaacaacgggtggctttcaactcctctgtgggcacatgcatatttgggaacacacgcacgcacgcgcacacacacacacacacacacacactcacacactttgtatatgcccagtgtactggctagttttgtgtcaacttgacacagctggagttatcacagagaaaggagcttcaggtaaggaaatgcctccatgagatacacttgtaaggaattttctcaattagtgatcaagggggaaggccccttgtgggtgggaccatctctgggctggtagtcttggttctataagagagcaggctgagtaagccaggggaagcaagccagtaaggaacatctctccatggcttctgcatcagctcctgctttctgacctgcttgagttccagtcctgacttcctttggtgatgaacagcagtatggaagtgtaagctgaataaaccctttctttcccaattgcttcttggtcatgatgtttgtgcaggaatagaaaccctgactaagacacccagggagtggcactatttggaagtggccttgttggagtaggtgtgtcactgtgtgtgtgggctttaagaccctagctgcctgaaagccatctagctgccttcagatgaaaatatagaactctcagcaactcctgtaccatgcctgcctggatgctgtcatgctcccaccttgatgataacagactgaacttctgaagtcagtcccaattaaatactgtttttataagagttgcctcttataaaaacatggtgtctgttcacagcagtaaaaccctaagacagaagttggtaccagggactggggtattgctgtgataagcctggccatgcttttatttggaagaatgtggatttgggaattttggatttggaaagcaatggaatcatttaagtggggcttacactagtaggaatacggaagactttgttaccgtgagtgatttgaactatgcagacctggcccaagaggtgtcagtggagaacatttgtgtgtgtgtgtgtgtgtgtgtgtgtgtgtgtgtgtgtgtgtgtgtgtgttattttggtgaagaatgtggctgccttttgccattgtccaaagagtctgcctgaggctaaagtgaaagtgaagagatttggattaattgctttgaaaaaaggaagcctggagggtgtgggggacttttgggttagcattggaaatgtaattgaggaaaatacgtaattaaaaaaaaaaaacagcctggtataaagtctgttgtgtggttactaaagttcactcttatgaagagcattttaatgaaatgtagcaaactgagaaaggaaaaaatacaaaatacatggctcaagtattaaaggagcactgggaaatagaatcgagctgaatcctatgttctgggagataacagattaagggagtgggactttggggcaagatcccacccagctaagtttagatcaaggcatggttgtacatacctttaatcccaggagacaaacacaagcatatttaaaccatgatacatataaattctaaattttgatttgagactataatctggagtagtcaatgaagataggaatggaggaaaggatcagtgggaggctttaaacaaagctctagagaggggtaataggacccaggtgctacaaagcagacactgaggaaatgggtacgggcaaaagagtaatacagggggagaaggaggaaggacagagaaatagcactaaggatatttgaagaagctataggtaaacatttttatgagcttatttaaaaatgcatgttgtattaacctctggccttcatattcatgctacacacatgcattgtaccaatatgtacagatacacacatccacatacatataaaacacacacacagagacagacagagagagagagagagagagagagagagagagagagagagagactccaccagaaaaccttttagatctgactaacattaacacagtgattcttaaccttcataatgctgtgaccctttaatacagttcttcatgatcgggtgccccccccaaccatagaattattttcattgctactttataactgtaattttgctattgttatgaatcataatatatatctaatatgtagaatatttaatacacaaccctcaaaggagttatgacccacaggttgagaaacactgctttaacaagttgtcagtgtacaaagttaacatataaaacatagtaggcttcttatatttataacaaatatgtttagaaataaatcagaaaagcaatttcattcacagttgattcaaacaaagaaaatatcttggaacaaatttaataaagaaagtaaacaacctctatactgaaaactttaacatactgaagaaattgaagataataccagataatggaaagacctcccatgttcatggattggaagagttaatattgtgaaaatatctagacaaccaaaacacctatagactcagtatgatccccatcaaaatccctatgccgttcttcatggaaatagaaaaattcttaaaattcataaataaatgaccatggagagttaaagcaatcctgagcaaaaagaataatgttgtgtttatcaccatacctgatctcaagtaatattatcaagtcatggtaacaaaccgagcttggtattagcacagaaacaaatcaatggagtagaataacggatccagatatgaactcacacagccataaccacctgatttttgagaaatatgtatacatcatagaaaagacatcttttccaacaaatggtacagggaaaactggatatccacatgtagattaatcaaagtggatccttatttcatcccatataactatcaactctgaatcaagcactgaaactccgaagctgaaaacataggggtacaaataaggactttcccaaaagcgtaaaatcactcaggaaatagtaccaacagctgacaaatggggttaaatgtaattacaaatcttctggactgaaaaggaaaaagataattaagtgaacagatagtctatagagtgggagaaaatctttgcacactacatgtctggcagatgattaatgtttagaatatacaaagaacaccaaatatgaaacaagaaatcaagcaggctaatcagttctcaaaagataaaatacaaatggccaaaatagtacgtattcacttgtaagtggatattagctgctaggcaaaggataattatgcaacaaatccacagacccagaaaggctgagtaacgaggagggctcaaagaagaatgcatggctctccctgggaagggaaaatagaatagattttttgtaggtgtatttggggcagatggagatgggaacaggaggggtcatgcatggggctatagagggagagattactgtaggagttagagggctcaaagacaccattggaacatgatccacagaatcaactaagcatggctcataggggttcacaaaaaatgaaggggttcaccaaaacaaaaaaaaatcactggattctgtatgggtcagagctcggtcctctacatatacattatggttgtgtatcttgtcattcttgtgagacttctaacagtgggagtaagtgtgtctctcagtcttttgcctgatctttggacccctttcctcctactaggttgcttcatcaagccttgatatgagggttcgtgcctagtcttattgtaaattgtttttctatgtacagttgatatccctgaggcctgctattctgtgaagagaaacagaggaggcttaggtctggggaggaggggaggtagagggtactggaaggagtagagggagaggaaactgaggttagatgggaggcagagggccggagggacctgaatgagagaggggagggggaaggaaaaagggggtaggatcaagtatcaggggagacaggagaggatcccagagatccaggagaatgaatggaaatatgcagcaatgtagggtgagggatgggggaaccactagaaagtcccagacaccagggatgtatgtgggaggctctcaggactcaatgggggtgacattacccgaaatgccaaagggggatgggagatggaacctgaagagaccacccccagcaggtagacatggctcccatttgaggcagtgggccacccaccaatcttcaaaatttttgacccagaattgttcctgtctaaaggaaatgcagggacaaaaatggagcagagactgaaggaaaggctgccagtgactgacccaacttgggatccatcccatgcataggcaacaaaccctgaaaccctgacaatattactaatgccattgtccttgaagacagaagcttagcatggctgtcctgagaggctctcccagcagctgactgactgagacagaggcagatacagccaatcattgcactgaggacatggacctctatggaagagttaggggaagaactgaaggagctgaaggggattgcaaccctgtaagaattagaacaatatcaactaacccagacctctcagaactcctagagactaagcctactaccaaagagcatacatgggctggtttgcagcccccaggacatatgtagcagaaggctgccttgtctggcctcagtgggaaaggatgcacctaatcctgtagagactagataccacagcgaagggggatgctggggtgaggttgggtggggaacaccctctcagaggcaaaagatttgaagagggggttaagaaatctgggaggagaacctggaagggggcaacatttggaatgtaactaaattgaataattaaataataaaagaagaattataaaaaaattaataaataaataaattaaaaaatgaagttgttctgggagacttctcttatagtgtatgatcacagagaggcctctcaactctctttcttgtgcattgattaataataacaatagtaataaaataataacaacaacaaaatatccaatctaaatagccttcagagaaataaaaaataaagttctatcagaaattcattaaaatacaacaacaaatgctggcaagggtggggacaaaaaggaactcataaacactttgggtgggaatgtaaactagtccaacctctatggaagttagcatggaggttccttgagaatctaaaaatagatgtcccatataactcaactattccatgtggtgatttgaataggtttgcaccccccacccccataggctcatgtgtttgaatgcttggcctatagggagtagcacaattaggaggtgtgaccttgttggaatgggtatggccttgttgaaggaagtgtgtcactgtagaggtgggctttgaggtatcatatataagctcaaggtggaatcagagtcttctcctggctgcctgaagaagataatctcctcttagctgcctttggatctagatatagaactcttgactcctccagcaccatggctgcctgtacggtgctatgcttcccaccatcatgatgatgatttaaacctctgaaaccataagtcagtcccaattaaatgtttgcctctataagagatacttggtcatggtgtctcttcacagcaatggaaaccctaactgagacattctactggaatttgtccacggaactccaagccagcatatcatttgaatatcaacatttattgtattactgtttactataactaagttactaaactaccaacatgtctattaataggggagtgggtaaataaaatgtggaatataagtgcaatagacatttttttcaaccataaagaacaaagtcatactctttgtgcggaaaatggatacagctagagatcttcttcatattaagtgtactattaagacacttcagacaatttcagaaagacaaacattgcacacgttctcacagtttgttccttgagtatatagatacacaaaattctgataatttaacattttattgaattaattttattatatttgtttatttatgtgagtgaacacatgcattgcacaatcacacgtagaagttggaacatagcttttagcagtcagttctctccttttgtgtgggttccaagtattgaactcagttgaactaactcagtattgtaggctcagtagcatgtatgtttgccaactgaacaatctcactgccccccaaaacaaataaaaaacaccctgatactttttaacaatataatcatggagtgtttatataagaggtatttagagatcgtctaatttattttctcaatgttacagatgagttatttaatcctgctgaagacagatgaacaagattttataggactttctgaaattttacttgtttggagcctctagaataactgttctacattcttcaaaaaatgctttcaatatttaaaattgccttttgttattcctctaaacttttctcccatgctaagcaccctgaggttttcattattattattattcctttttaatatgaattattttcaggctggaccattctggacagccatcttgatacccagttctgattaattatttccttatttaaattgcagtatgcaaaactaacatccatatgcttcatatattgcttatacagcttaagtcacttattaagagatttctctagtaatgttagtatagactgctgatgctatagactgtcctgctctgtgactctttctctttcttatcatcattattttaaacagcaggtatatctgaatcatagttctgaacactgatttaataattgttttctttagcatggattgctaatgtcatgattagtctattttcttagacactggtttattggaaaaaatgagatgggaggtaaaattgtatacacattttaattcttctagctatattgattgattaaattactttttaatttttttaaattttttttccttattttaaaaatatttttattacatattttcctcaattacatttccaatgctatcccaaaagtcccccataccctggccccactcccctacccacccattccctctttttggccctggtgttcccctgtactggggcatataaagtttgcatgtccaatgggcctctctttccaatgatgggcgaatacgccatcttttgatacatatgcagctagagtcaagagctccagggtactggttagttcataatgttgttgcacctatagggttgcagatctctttaactccttggacactttctctagctcctccattgggggccctgtgagccatccaatagctgactgtgagcatccacttatgtgtttgctaggccccggcctagtctcacaagagacagctatatcagggtcctttcagcaaacgcttgctagtgtatgcaatggtatcatcgtttggaggctaattatgggatggatccctggatatggcagtctctagatggtccatccttttgtctcagctccaaacattgtctctgtaactccttccatgggtgttttgttcccaattctaagaaggggcaaagtgtccacactttggtcttcgttcttcttcaatttcatgtgttttgcaaattgtatcttatatcttgggtatactaagtttctgggttaatatccacttatcagtgagtacatatcatgtgagttcttttgtgattgtattacctcactcaggatgatgccctccaggtccaaccatttgcctaagaatttcataaattcattctttttaatagctgagtagtacttcattgtgtaaatgtaccacattttctgtatccattcctctgttgaggagcatctgggttctttccagcttctggctattataaataaggctgctatgaacatagtggagcatatgtccttcttaccagttgggacatcttctggatatatgcccaggagaggtattgtgggatcctccggtagtactatgtccaattttctgaggaaccaccagactgatttccagaatggttgtacaagcttgcaatcccaccaacaatggaggagtgttcctctttctccacatccttaccagcatctgctgtcacctgaatttttgatcttagccattctgactggtgtgagatggaatatcagggttgttttgatttgcatttctctgatgattaaggatgctgaacattttttcaggtgcttctcagccattcggtattgctcaggtgagaattctttgtttagctctgagccccattttttaacgaggttatttgatttttctagagtccaccttcttgagttctttatatatattggatattagtcccctatctgatttaggatagttaaagatcctttcccaatctgttggtggtctttttgtcttattgacggtgtcttttgccttgcagaagctttgcagtttcatgaggacccatttgtcaattctcgatcttacaacacaagccattgatgttccattcaggaatttttcacctgtgctcatatcttcgaggcttttcccccactttctcctctataagtttcagtgtctctggttttatgtgaagttccttgatccacttagatttgaccttagaacaaggagataggaatggattgattcacattcttctaaatgataaccgccagttgagccagcagcatttgttgaaaatgctgtctttcttccactggatggttttagctcccttgtcgaagatcaagtgaccatgggcgtgtgggttcatttctgggtcttcaattctattccattggtctacttgtctgtcactataccagtaccatgcagtttttatcacaattgctctgtaataaagctttaggtcaggcatggtgattccaccataggttctttttccttgagaagagtttttgctatcctaggtttttttgttattccagatgaatttgcagattgctctttctaattcgttgaagaattgagttggaattttgatggggattgcattgaatctgtagattgcttttggcaagataaccatttttacaatgttgattctgccaatctatgagcatgggagatctttccatcttctgagatcttctttaatttctttcttcagagacttgaagttcttatcatacagatctttcacttccttagttagcgacacgccaaaatattttatattatttgtgactattgagaagggtgttctttccctaatttatttctcagcctgtttattctttgtgtagcgaaaggccattgacttgtttgagttaattttatatccagctacttcaccgaagctgtttatcaggtttaggagttctctggtggaatttttagggtcacttatatatactatcatatcatctgcaaaaagtgatattttgacttcatcttttccaatttgtatcctcttgatctccttttgttgtcgaagtgctctggctaggacttcaagtactatgttgaataggtaggagaaattgtgcagccttgtctagtccctgattttagtgggattgcttccagcttctcactattttctttgatgttggctacaggtttgctgtagattgcttttatcatgtttaggtatgggccttgaattcctgatctttccaagacttttatcatcaatgggtgttgtatcttgttgaatgctttttcctcatctaacgagttgatcatgtggtttttgtctttgagtttgtttatataatggattactttgatggatttccgtatattaaaccatccctgcatccatgaaataaaacctacttggtcaggatggatgattgctttaatgtgttcttggatttggttagtgaaaattttattaagtatttttgcatcgatatttataagggaaatttgtctgaagttttctatctttgttggatctttctgtggtttaggtatcagagtaattgtggcttcacagaatgagttgggtagagtaccttctacttctattttgtggaatagtttgtgcagaactggaattagatcttctttgaatgtctgatagaactctgcactaaacccatctggtcctgggctttttttggctgggggactattaatgactgcttctatttctttaggggatatgggactgtttagatggttaacttgatcctgatttaactttggtaccttgtatctgtctagaaatttgtccatttcgtccaggttttccagttttgttgagtatagccttttgtagaaggatctaatggtgttttggatttcttcaggatctgttgttatgactcccctttcatttctgattttattaattaggatgctgtccctgtgtcctctagtgagtctaggtaagggtttatctatcttgttggttttctcaaagaaccaactcctcgtttggttaattctttgaatagttcttcttgtttccacttggttgattttgcccctgagtttgattatttcctgctgtctactcctcttaggtgaattttcttccttttgttctagagcttttagatgtgttgtcaagctgctagtgtgtgctctctctagtttctttttggaggtactcagagctatgagtttccctcttagaaatgctttcattgtgtcccataggtttgggtatgttgtggcttcatttcattaaactctaaaaagtctttaatttctttctttattccttccttgaccaaggtatctttgagaagagtgttgttcagtttccacgtgaatgttggctttccattatttatgttgttattgaaaatcagccttagtccatggtggtctgataggatgcatgggacgttttcaatatttttgtatctgttgaggcctgttttgtgaccaattatatggtcaattttggagaaggtcccgtgaggtgctgagaagaagttatatccttttgttttaggataaaatgttctgtagatatctgttaagtccatttgtttcataacttctgttaggttcactgtgtccctgtttagtttctgtttccatgatctgcccattgatgaaagtggtgtgttgaagtctcccactattattgtgtgaggtgcaatgtgttcttttagctttactaaagtgtctttaatgaatgtggctgcccttgcatttggagcatatatattcataattaagagttcctcttggaggattttacctttgatgagtatgaagtgtccctccttgtctttttttgataactttgggttggaagtcgattttattcgatatttgaaaggctactccagcttgtttcttcagaccatttgcttggaaaactgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagtgatattaaggaaaagtaattgttgcttcctattttttgtttgtttgtttgtttttagagttgtcattctgtctttgcggctgtcttctttttggtttgttgagggattactttcttcctttttctagggcgtgatttccatccttttatttttttttctgttattatcctttgatgggctggattcgtggaaagataatgtgtgaatatggttttgttgtggaatacttggtctccgcctatggtaattgagagtttggccaggtatagtagtctgggcaggcatttgtgttctcttagtgtctgtaaaacatctgtccaggctcttctggctttcatagtctctggtgaaaagtctggtgtaattctgataggcctgcctttatatgttacttgaccttactttcttattgcttttaatattctctctttatttattgcatttgttgttctgattattatgtttcaggaggaatttcttttctggtccagtctatttggagttctgtaggcgtcttttatgttcatgggcatgtcattctttaggtttgggaagttttcttctataactttgttgaagatatttgctcgccctttaagttgaaaatcttcattctcatctactcctattatcagtaggtttggtcttctcattgtgtcctgtatttcctggatgttttgagttaggatctttttgctttttgtattttctttgattgttgtgccgatgttctctatggaatcttctgcacctgagattctctcttccatctcttgtattctgttgctggtggttccagatttctttcctagggtttctatctccggtgttgcctcactttgggttttctttattgtgtctacttccctttttatgtcttggatggttttattcaattacatcacctgtttggtcgtgttttcctgcaattctttaaggaatttttgtgtttcctctttaaggtcttctacctgtttagctgtgttctcctgtatttctttaagtgagttattaacgtccttcttgatgtcctctactatcatcatgagatatgcttttaaatccgggtctagcttttcgggtgtgttggggtgcgcaggtctaggtggcgtgggagtgctgtgttctgaagatgatgagtggtcttgatttctgttagtaggattcttacctttgcctttcaccatctggtaatctctgaagctagttgttatagttgtctctggttagagcttgttcctcaggtgaataagttagcctctatcagcagacctgggagactagatctctccttagtttcagtggtcagagtactctcttcaggcaagctctcctcttgcagggaaggtacccagatatctggtgttcgaacctgcctcctggcagaagttgtgttccactcatcagaggtcttaggatcccatgggggatcctatgtgggtccttgagggtgtctggagactccaagggcaaggaaccctggtgctggagtggaccggaagggacttgtgcccctgatcaggccgagttatctgcttccttaattaatgcaatctcaggtcccgcacgattggattggagcagatgctgtgttccactcatcagaggtcttaagatcccacgggggatcctgtgtgggtccttgcgagtgtccggagactctgcgggcaaggccccccagtgctggagtggaccggaaggaacttgtgattgattaaattacaagtaccaacattttccacatttgttattcaaatttttttgaggtagactagcttgtatgccattgacatcaaataagagtgcagagctaatcattacctgaaacctaggtgatgaaaggctttattctccaagtagtgaccctctgactcacataagaatgacctaatatggaagtcaagagcatgttgttttctcacattatgctctttttcttaattctcagaggaagggagaaggtatctatgaaaggaggtgtaagagacaggcaagctcaccagagactgttacagaaaaataaaaactgcagcatggagacaggatcagtttttactgtactattgttacttgtcctttaggaggattttttagtggagaaatcttgaagactagaggaaacatgctaagttaggactttaaatgatgtcccaattatcttgtcacattaatggtcaaaatgcaaattaatatttatatatttatatattgttatttacaaatctttgcccttgacaaatctcagttctgtagaatattctcctgtctgtctatttccttatatgtgagatcaagattagaatatagagattgttttgtagcttccacattatcttctaggggagtctgtttctacttagttctttaaactgctcttaggacttcatgtactaatttgtgtaaattgtgcttacctttgttctttatgtcccctactgtattataatctatttcaggtcagtgtctagctatattttatcttcgttacatccatagcttatgaatttttaaaacttaaatattcattacaatcattttagtgactttctctaagttatgaatttatatattttttgattgtacagtgagaattttatttaagcaaatacttgaacaaggaccaagtagaaaaaaatgaaagaacagaacaaagtaagtatacctgacataagagctgaattagtaaatgtaagaaatgaaaaattatatgaatactttaaaatttaagtagaaaagtatccgtgactattttaagaagtgtgaggatgaggactgaaggatatgatttcaagataagtgaaaaatggcttaattaaggactgtagcggtactggaaaggatcaaaattagaaaagagaagacagtgagaagtcagtgtaaaagagcattcaggacatatgactgtaaaatccctaatgatggctgggtaagtttgtgcatgctcgtaattctgcactttagcagctgagacaggaatatcttgagttcaaagccagcaagaccctttctcaaaaaacaaaacaaaacaaaacaaaataaaattcgaccctgtctcagaaaataaaaacctcagtacttaattagtagcagagaaatcacagggaaccatagtggttaagcacacatgtcagagtagctgagctctgccactttctaggtgtttgaaattgatcagattagttttctttgcctttcattccctgtttaagagaatgggattaatagtgcctttcccaggatctgttccacagatcagatgaggagatgcatgtcagtgtaatggtgtaaacatttagaaattagctgttgcagtttcagttgtatcttcaagtttattttcagtagggaactgaattaagtttgattcaataattaagtgataatgtatgtataacaatttatagtgttttccaatcgagtatatcatttggtccctatgtcactttaactcaccagaaccatcctttggtggtttgactggtttgggcatctgtgcagaagagctgttagtctagagtttaaatggttaagcagccagagaaggagagttgggattaccaatcctctcacctttgttgttttccaccctctcatttcctttccacaatcattttgtttggatagaggtaaactttagtcaaaatgcttaccagagtatgagacatagtcactttgtcttttcttcctatttctgtcacccacacacagtgttttgagcagcactaatatggagcaatgttttagaatttatgtgcggagtgttgtctttgaggtttggattaaaagcatcagtgaaaccaaaggaaagtaatcaggcacataattgagcaggtggaacaaatttgttaactttgctttgggaaaacaataactgttttttaagtattaaatcaaccttaggttccatgatccttaataagaatgggaacaagggagatgataatgcattggtttctgaagacatcagagactgtaagccttgcatctaatatggttgattccaattgggggagggtgtggacaggggatgcttgtcattggctcttctataatgcagatgtttcttcaagagaaatatttatcttgtgcgtgttgtcatgagatatttttaagatatcataaaacaaggaatttgaagtataagctcaaaatgtaatgtgctacatagatgaacataatttcttttaagtattgatctttaaaactgagctggacaaatatatttagcataggatttttatttgaaaagattgatttttcacttccgttcttttaaaagaagagacttaaaacatcagagaatctttgaattagaacagacacaaaggtcatccacctcacgtccttgctgtctttgtgaatcagctttgcttgtcatcatcctaaacttgaaatgtgtcagtaatggagaacttgacctcaccagagataatgcatgtcatttgtaggctgatttagttgttataaaatatctttcttattaaattctacaggcataaattgtcttccatatgacggccaatgactagaactcccctcaattttctctaaccccaccctcaagcctaagcatgttatttctactgttcctttattgctttgaatctgtatatttatgcatcctctcaactgtgagctccttgagggcacgggccacatcatatcttcgaatgtgtctggtatgtaaaagggtttttgaatggagaacaacatagtattcaactccttcactgttcaagctactcttgtttgttctctgacttgcctgacattaaataaatatttattaaatgtcttatggtatgagacactgccagcatttagctatacagcagttaaagatatatgggcttcaagtattagatataaacaagaaaagggcaatgcaaaacgaggtgattaggatgtggtagtatcctatgtacattaggatgtatatattatatagtttccaattttgttgttaaaataaggaactattctaagtgtgctttgactagtactacttaacatatattttacttggattcatatctgcttaatgtggttttaggtgataattgcttctaaatactagtacattattgtttaatcattcagtaagaatctatttagcttctatcatgtatgatgagctgaatcaggtattgaagctataacaattattagaaatagatacactagtaagctaatgaaagaaattctcaaaacagtttaactaattttgtattctgttctctaacgagacttctgtattatatgtatttgcatattatacatatacatctaagcaaaatcaacttgtatttgtctttgcttaagacaaacacaaagttttgttccatactataattctgatgtgagctgaggtgtaggaggatgggctgggaagaaaccaacaaacaacagcttcatatgcagtacatctagaatttgtcagctggaagcaaatacaaaagatgaaggaacagaagtgtggagtggctgctctgttgttatcccatttaagtggttagaaaggattcagagaaaaatagcatctgtaggaaatgggtaaagccatgtagacagttaagagatacagctatatggagaaaagtgtgcaaaggtcttaagtctagaatgtgttcgatgtgtttggggaatcctgcaacagaagctgtgataagaaatgaaatttgatgtcatggtgatttgttgagtgttctattaagtcataattttcttttttaaatttcttttttattagatattttctttatttacatttcaaatggtattccctttccttgtttcccctctgaaaaaaaccctccctctatctcctcgcccctccccctactcaccagcccacccactccagattcctggcattcccacacactggggaatagaaccttcacaggaccaagggcctctcctcccattgatgactgactaggccattctctgctacatatgcagctggagccgtgagtcccatcatatgtactctatggttggtgggttagtccctgagagctcttggggtactggttggttcatattgtttttcctcctctgaggctgcagactccttcagctccttgggtcctttctctagctccttcattggggactctgtgatcagtccaatggatgactgtgagcatccacttctggatttgtcagacactagcagagcctctcaggagacaggtataccaggctcttgtccgcaagcactttttagcatctacaatagtgtctgggttaggtaactctatatgggaaggatccccaggttggacagtctctgagtggcctttccttcagtctctgctccacactttttttctgtaactcctcccaagggtattttgttcccctttctgagtaagacagaaatattcacacttggtttctccttcttcttgagcttcatgtggtctgtgaattgtatcttgggtattccaagcttctgagctactatccacttatcagtgagtgaataccatgtgtgttcttttgtgattgggttacctcactcaggatgatgttttgtagttccatcaatttgcctaagactttcataaattcattgtttttaatagctgagtagtactccattgtgtaaatataccacattttcggaattcattcctctgttgaggtacatctgggttctttccagcttctagctattttagataaggctgctatgaacatagtagagcatgtgtccttataaccagtaggagctaagacgaaaaggatgggccatccagagagttggagcatcttctgggtatatgcccaggagtggtatagctgagtcttccggtagtactatatccaattttctgaggaaccgccaaactgatttccagagtggttgtaccagcttgcaatcccatcagcaatggaggagtgttcgtctttctccacatccttgccaacatctgctgtcacctgagtttttgatcttagccattgtgactggtatgagatggaatctcagggttgttttgatttgcatttctctgatgactaaggatgttgaacatctcttttttttagtttttttttaattaggtattttcctcgtttacactttcaatgctatcccaaaggtcccccatacccacccacccccaatcccctacccacccactccccctttttggccctggcgttcccctgtactggggcatataaagtttgcaagtccaatgggcctctctttgcagtgatggccgactaggccatcttttgatacatatgcagctaaagacaagagctcccaggtactggttagttcatattgttgttccacctatagggttgcagttccctttagctccttgggtaatttttctagctcctccattgggggccgtgtgacccatccaatagctgactgtgatcatccacttctgtgtttcctaggccccggcatagtctcacaagagagagctatatctgggtcctttcagcaaaatcttgctagtgtatgcaatggtgtcagcatttggaagctgattatgggatggatccctgcatatggcagtcactagatggtccatccttttgtcacagctccaaattttgtctctgtaactccttctatgggtgttttgttcccatttctaagaaagggtaaagtgtccacactttggtcttcgttcttcttgaatttcatgcgtttggcaagttgtatcttatatcttgggtatcctaagtttctgggctaatatccacttatcaatgagtacatattgtgcgagttcctttgtgattgggttacttcactcaggatgataccctccaggtccatccatttgcctaggaatttcataaattcatttttttaatagctgagtagtattccattgtgtaaatgtaccacattttctgtatccattcctctgttgaggggcatctgggttctttccagcttctggctattataaataaggctgctatgaacatagtggagcatgtgtccttcttaccggttgggacatcttctggaacatttctttaggtatgctgctatatctactcatttgtattttgacctttgtaaagggttttaattttaatttgtattccagattttattgcattgtattacagccaatgtagtatgctaatctttacatctagtaatcctaatgttaatgttgtaatttggacctttaccattcttcaaattctcatatcttgaaggattggtctcaagcactattgggaaatgatataactttttggtggtgaagcctagtggaagtaaatgaaatgattaagagagtgtccttgaatagatttttagaccaatggctccccactccttgccagctccctgctgtcatgaggtgaggagatttactctactgtgtacatctggccataataatctgccacattttaggcctacaaacagtagggtaagcaacagtatgttaaaattttgaaattatgagacaaaattaatattttcttcttttaaattatttctttcaggtagtttgtctgaggaagggaaagatgattaatataagtagctacccctttttcatttaggccatatgcaggtttagtcaatgtgactttgtttgctatataagtcattaatagaaatcttgaaaagggtgaacttctcttgtttggaaattaaatttacatttaatctggaaatcattatttggaatatgctttttgaaataccacttttctcagcttcaatggagcagattaatttttattctttctgtaagtgtattatgaaaacctaccaaatatattcctaaaatcaagaaataaaaacataacttttacttggtaacttttatgacaaagaggaagaaaggagcaaaagaactccaccatttgctattggttgttttgttgaactttgtcattcttggcaacttgggtaagatgaaatatcaatttgtaatttgcatttccctgttaatacaggaaaaatctccagaagcttgtgagccagctagcctggcagatgtagtggcaaaaaggaaggaaggaagggagggagggagggagggagggagggagggagggagggagggagggagggagggagggaggggaggggaggggaggggagggagggaggaagaaaggaaggaaggaaggaagacaggaaggagggaggaaaggaagacaggaaggaaggaagacaggaaggaaggaagacaggaaagagggaggaatagtccctgttagggactatgaacaacatttgagatatttcttagacatttttttctcttgttttgaaaaaaactctgctcctttcttaggtcaatgctttgaaggagtttggttttttgagttcttcatatactctggatattaatcctttgtcagatgtaaagctggcaaaaattctgtgccattcagtgtgtttcctcatcacgctattaattgttcctttggctttgtagaagctttttagttttatgaagtcatacttgccaattgttggccttaattctctggtaaatggagtcctattcaaaaggtccattgttacgcctctattgcataggtactgtctttgttttcttctagcagtttcagtgtttcacagtcaggttgctgatccatttggagtttttgtatgagatgatagatatgtgtataacttctttcttctgcaggcagacatccagggttttcagcactatttttttaaagatgctttcttttgaccagtatatgttttaggcatatgtcaaatattaaatggctaaaattatatgtactcatgttttggtcttttgattttgttaattggtctacatgcttatttttgtgttgatactatattatttttattaaaatggttccttaatatattttaaggtctagaattgtagtccttctggaattgttctcttttgtctgtgttattttggctatcttgggtattttgtggttctatatggatttatgacagtttttttctatattgtgatgagatgggtgttttgattaataatatatataaatagtttttgtaatatggctattttaacaatattaattctacctagctgtgagaaaaggatgtctttccattttctggtgtttttttttttttctatttctttcttcagaagtttgaacttttcattgtagatgtcttccacttccttggttatgtttattcctagatgttgtcttttcttttaggctattgtgaatgggatgctatccatgatccctgcatcttggttgctggtgtataggaagctatttatttgtcctgttgattctatatcctgccccattgctgattttttaaaaataatttctagagggataaaatggtatcaaaaagatagcattttggttctgatagaattttgggaatctctcacatatgacatatcatctgcaagtagaaagagtttgacttctttccgtatttgaatccctttagttttcttctttgtcttactgctcaagcataatactgaaaggaagtgggagtggggatactggacatcccttttctagttcctgactttggtaggattgcttcaagatgtgatcatttaggatgatgatatctgtgggcttctctttatatagcttttgttatgctgaggactgttctctgtagtcctttattctctaggatttttatcatgaagacatgataggttttgtcaaggacttttttctgccttgatgatcatatgattttttttctttgtgctcattaatgtgttttatttacatatattgacttgcatttgttgaagcatccctgtattttcatggataaggccaactttcctatggtggataatcatgttgatgcatccttttttgagtattttgttaagcccttttgaatctatgttcatcagagatcttgtcctgtaatttttttgttgtgttttttttttttattagcgtgactagcttcatagaagggatttaggagtgcttcttttgtttctatttttaaaaatagtttaagaagtattggctgtaaatctttgttgttttgaaagaattctgctctgagttcatctggacctggcttttctttagttggagaattttttattttcatttccatttccacatttattatggatcagtttaggttgttgaattattcttgatttaattttggtcgtttggctgtatctagaaatttatccacttcttttaggtttctaatctaatggagtagagtttttaaaacaatattccccatcaatattctgaatttctttggtgtctgttgtaatgttttatctttcactttaattctgttagttctctttctttctttggttagttggcctgaggttgtgtcaatctgctttatcttctcaaagaaccggctcttagatcccttggttctttgtattattttctttgcttctattttgttcatttcttctccatcttttattattccttgcagatgagtgggtttggatattgttttccttactgtccatgtttttgaattatatcattaagctatttttttcactccttctgacttttcaatgtggacacttaggcctacaaataaaccttttaggtctcctttcaatgtgttcaacaagtttggctctgttgtgttttcattttcattttattccagatcatttttttcaactcttcatttctttttatcaattcactattcagtgatgagttgtttaagcttcatgagtttgtgtatttactggaaattcctttgttatcaattgtacattttattgcgtagtgttcagatagtatccaaggaattatttcaatattttttaatttataaaagtatgttttgtatcccaagatatggcctgttttagagaagcttctatgtgctgctgagaagtatgtgcattttggggtgctggagtgcaatattctatagatatctatcaagttcatttgctatatgatgccatttatttctgatgtttcagtgtttagttttttttctccagatgacctgtctaatggataaatggatgtttaaatcatgtgctattattaatagattgatgctaatttgtgtctttaaataaatattgtttttttaaatgaaatctaagtgccccagagtttggtgtgtgtacatacatatatatatatgtacacacacacacacacacacacacatatatatatatatatatatatatatatatatatatatatatatatatatatatatgcttaaattgaattgaaaatttttgatgcagtttacgattattttttaacttccatattctaggattcatttaggtaatatcattgacagtcattttttctggattggtagatattggagagaagatatgggcttgatcgttcatgttgtttctatttttgtgatgagatctgggcatttgaactttttttttttttttttgctagttttgtgtcatatgaagaaagcagtttggtcctgaggagaggatgtttgagtaggttggctctagaggtttataatgacttagaaggaatgaaattgtgtggacacaggagacaggtgtgtaggatgtgcttcctatttcaagcctggagtgttggtagatatagatctgggtttgggagagtgtacatagaggggaatatcaggcataatcactagattaggccctggagagggacttgtagtatcttggctgggtcatgtgcatgtgtgagtgagtatgtatgtatgtatgtatgtatgtatgtatgtatgtatgtatttttcctgaaacttgtgtgttaattttgtatctttccacttttcaggaaatgtcagctctaacaattttctgatggagtgtttaggttctcttatgtatacaatcatatcatttgtaaataaggatactttaacttcttcccttcttgttagtatctcctttatttctttcctctgtcatgttgctatagtagacttctagcactatactgaatagtaatagagagactctacacctttgtattcaacctgatcttagtagaattgcctttgaatttttctccatttagcataatctggctataaattttctgtaattatcttattatattgcctctatttcttgaatttttagggcttttatcataaagagatgttggattttgccaaaggccttttctgcacctattgagattatcctgtgacttctggccttaagaccatttatgtgatgtattatatttatttatttgcagatgttgaaccatccctgcatctctggaatgaagccaacttgatcatgctgaatgattttctcttgatgtaatcttgaatttggtttgcaagtattttattgagaacttttttcctctatgttccttaaggaaaattagcttttgcatttttggttgtgtctttatctggttttaataacaaaataattctggctttgttggaagagttctctactattccttctcctttatgttatggattcatttgaggagtattagtgttagctcttcttaaagttgggtagaataagcagttaatttatctgggcctacattttggtaggtgaaagatctttttaaattactatttcagccaagttgttttttatagatctactaaaattatttagctcatttggcttaactttggtaggtcatatgcatcagaaatacacccatttcctttatgttttccaatataatgaaatacaagtttttaaggtgcatgcttatgattttctgaatttcactgacatctattgtaatctctcccttgtttctaatttaattaatgattaatttgggtctttgatttctctattagtttgtctttgtctttgcctatcttgtctatcttattaaagtgtatatagactttttgtgtcattgattttgagcccgtttttacccttgtttctatcatttatttctgccctgatatgactcatttatttctacatactgattttgagttttgtttattcatattcttctaagtaccttagatgtagcattaagttatctgttcaaggtctctgtggtttttaacttatagatacttatagctgggaactttcctttcagaactgctttcattgtatcccattggttttggtctattgtattttcattataattcatgtctagaaaatttgatcttctgtttgatttcttcagtggcctagtcattattttgtaatgtgttttccattctatagaagtttgtgtatattctgaagtttctcttgctgttgatttttagctttattccattgtagtagataggatacctgaagttatttcaattttactgtttgtagagacttgccttgtatagtaatgtttgatctattttagataaagtggatggaatactgaaaagaatgtgtatttcagaatttgaaaagaatgttctataaataactattaactcttgacgtttctctgtttactttttgttgggatggcctgtttcttggtgagagtaggataatatccttaccctctattactgcttttatatttgtttcatgaaatagggtatatccatgtccaatgtatagggtatatccatgtaggcttagattgtaatatcttatgtgtggatggattgtcccttttgtcaatatgaggagaccttctttatttctgttgagtaattctgatttgaagtttgttttgttatatatcagaacagcaacatttatcttaatcttagttccattttcttagcatatcctttgttttacttttttcacactggagtaatagctttctttaacagctaggtgtgtttcttaacagaagtgctctcaatcttcttttgtctaggtcctctattttatcatcaagccctgatgttgctttttacttgatgtattgttcaacttataatgctttcccctgaatcttgtaattagcctgttgagttttttaagtccattttcatttcagggcaagttcttttaaatgtttctgcttgttgggttcgttttttaaatcctgaactacctttgctttttcatttagccttatatttgtgttttctttaagttcattgtttggtttttgtcttatttaaactccctgattattcaatgacatttatgattgattgttcaagatctgtgtcctagagtttatgaaggtagttatcgttggagaacaatttttaggtttagtggaactggggagagagagtaatattttgatatttcatgttattttttgtttttgtgatgaaacctgggcaactggatgtctttgattgattgtctgatgtggacacagttgtgcatggcagttgggaatggtatggatggggttcctcaaattgcagtgggacattgggtttaggaactgggtgccatctgaagactgggatatgtaaacctccaagacataactttgtgtgtgtctaatcctacatttaattctatcagcctctgggttttgtatgtttgaattctgctgtttgttacacatacagttagggcattgtcttttattactttctaagttgtctttattttgaagttcattttatcttatatcaatatagccatttttctattaaaatgttaatgtactggacaaccagttggtatgttcttagctgtctagtgccaaacagtcagccctaaaaccatatgtacataacattatgtggtttaaaatggtacattaaggaatatatgtatatgcatatatacatgtatatatagtcatgcaatatcaattagtgaaaaaaagaggacatgaattgggaggagagtggggaggggtacataagagtatttggatggagtaaagagaagagagagatggtgtaatttcaaaaataaaatttaaaaaaatacttaaaatgtaaaattagtcaccaaaaatgttcatgtagtattctttccgaacaattttattttgaattatctatttcactaaatttgaaataagtttcttataaagaacatatatttgagctgggtgtggtgatacatggctctattcacagagctttcaactaagcagaaggatcacaagattgtgctctgctagagctatgcagaaagttcagttgaataggctacatagcgagattgtgggatacaaacaaagaactgagaagtctaatgcatacatggtcttttctctttacccatctgccagtccctgtcttttaattggctcattagtacggtttacacgtatgaaaattattgacatgtagagatgctcaagtgtgctatttattattttttttattgctgtcatcatcatcttttctgatcttgggtcctcagacctaaggttttatcagttagctcttcctggtcttaaactccaagcaagcatttcttccttccattagatgggaagcagggcactgccacaaccccaggattttatttatctgcttgttttctctatgactatatctccttatgtcatatgtatatgtatgtatatatgtgtgtgtgcatgtacatattgcttttatcaatagttattataatatctatgatactcagatatatgtatgtctgtgtatatataccatatataatataggacacatatattttatacacatatcatatgtatatacatacatgtattatatatgcacacatcagtatatatacatatatgtatatgtatatatatgcaaatatatttataaatacctacaaaatacatatatacacacatatgtatttatacacacatacatatacacacacatatatatgtgtattatagtagtcatgttgctattaatagattattatatgtatacatatatgtatacatattcatatatacaatgtgtacatatgtgtacatatatatgtatgtatatatacatataatactagtgaattgatacatttgggcatctaattacaacataatatatgttgtttttcattttttaatttaaaatttatatttaaagtatatgttgtacacacacacagacacacacatacatgtgcatgtgtattccctagtatgcatgtggcattagaggatgtcttgtggaagtaagttctctccttccactatatagattccaaggagagaaatgtcatcaagtttgttggaaattttccttacatgctgagccattttataatatttttgtcttgagtattagatggtattataattttgtttccatggatatatattcttgctgagttttttcttctctatttctggtacttttagattgttcttgttggtttctcttgtgtttcaagaagttcccttgaatgctttttaaggctggttcttctagcaataaatccttttagtttctgttcatctaaaaatgttttacatcccctacactcctaaaggaaatataccagatacaaaaatccatgtttgacagttgtttgctttcacaacatgaaaaatattgttatccctttcccattggcctccactcagaccaaaaatccttagccttttgaattagtgttcacatatagctcaatacacatttcttttggttttctttttacaattgtttgtcttaaaatttaagaatcttaattataatgtgttctggcaagggtgtttttgaatttatactgtttggaattcactcagcttcctagatgcatggcttgtaccaaattttgaaagctttcaagtattgtttctttgaatatgccttcagcaccttatgctttccccctctcattttgaaactctagttatatgaatattgaatactttttaaaatttcttcttaggtatctgagacccctggctgggtaacttttgcactttgtccaaaagtttacttattctgtccttcataatttctgctgtagtattgaatcctccaatagtcttttaaaaatccatcattatatttttatttatatacattttattaggctttgggctcttttatgatgttaatatctttactaaggtgtttattctttccattaatttcaggagagtttttagttggtgctgaaacatttttatgttagctattttaaagttttgtcaagtaattcccagtagagtatgcaagctccaatatcttaggtatacaaagtaagtctcagaatgagagaagagcatttatctccctagctacttaattctagctcttttgtgctagtgctagagacagtgtgcacatctcatgttgtcagaggagtattgtttcatttaggagagaaatgagcccttcctatactgacctctgttgctggcatcagggattcagaaacaccaggtctatttataatcccagaatttgggaggttgaggcaggactattgcaagtatgaggatggtctggtatataatctgttaagacattgtcttacagaacaaacagccattaaaacaattgtacccaccatgtatgagtattctttttctgtgttgcaagatctcttattgttttcctattcccaattcagctcagcctcttgttacccatcaaagttattttgttttctctgtgattagcagagatgaacagagaaaaatactgtcttactcggagtagatttttagaagttctatagtgcctacctataatcatggttacattcaacagcttgaaggcatggctttttagaaaataatcaggagtatgtgtacctctctccagacttctgcccatgtctcattattcacattactgtctagacagtagtttgaaaatcttagcccgcggtcttttctatatcctggaatttatttcattttatttattttgcttccttctatgaatacttcttgtaccctttcctgtcctggattttgttaacagaggccatatggaaataatacaggaattgaatcatttttgtttttctgtctaacattgttactgattgcagtttggaattcctttttattatcttcagtgtatctcttcctgaggctcaggtcatttggacattttaggtgttttgcagatagatgccactcttgtagttatcgttggatagttctttatactcagtccactgattatgtagataattgcgagtgtcagaaaatcttgtatgtggatctcacctgtagcagtctctagagctgtgtggtttggggttgttaacctcggagcttatttcctcacctgtaaagtagaagcaacactgctgctatcaagcagaccaacttcagacttcttatagagattaaacaagataatatgcattaagctaagtggcacagttccttatagagaagaagcattctaactgtggtcatacattttaaaaaccaaggtggtagacaaattttactgttgtttctttggatacctgttgttacttctctgtgattgtatagtcataatttcagttttgagagccttccagttaggttatataaattaaagttctcagggaagattgcatatcttttaaattatgaaatatcatctaattacaactgacactcttaatacagtgctggtgatgattttcttactgagtagtaaatgcaaatattttacagtgcagtctccatggaattgatgtgtaggtgttaaattagcctttctggttaaccatccataaatatttcaaaatacataccttgtgtgggtacctagcttgcttctacatgctgcaaaagtttttgcttgttagacacttcattatgtcttacctgtatttcttgacatattttaagtaagtgtatggttgtagtacatctgcattcctttaaaaaaaatgaagttaccagacatttactttgaatcttctaagtatgcatattattatattttgtacagtatataacatgttttaattcaggtgtttattataacttattgcacctaaaataacagcagtttcaggaaggccaaaaaaggcattattattagaatagtaccagcaacctatttcttccagtacacttttccttgagttaaagctggtaatctttttaatcttggtaaattctttaggtttcatgtttgatagctataattctggaacctcccaaaactaccttaattagaggcatgttggaatgtgtttgaaatttttctgctgtagttgagttacttctggcagtattatgtaatcttaaggatatgcactttctgcagggaatcaagctttcttgctagcttttacttatttttttagtgttccattctcacccctggagagaatagtaatccaaatataaactgtcgttaggcttttgcagatgtttagaactttaggtcttgctaacgctaaccttccaatgttctaccttgtttttgaaggtcagaactgctgttgcaaccaaattgaaatttcactaagttagactctggcaacagaaagctaaatgaaatagtacaaggtctagtgttttgtttcttggtgctttgaaatgccattgtacagtagctacatagttggctttctgtgtgattttttttcatgagctgatttctagatataattttatatgggtgaaaagtgttcatcagtccctgggaggaataaagtatttgattagtagtggggcttttatgctatcctacagaactatagccacaaaaacaaagatcaaacaacctcattcctttggctcaaactacaaccctgcttgagatgttccatgaccactgtgctttccccgtttcttttaggtcactcatggcccaatttgtttttttatttttgaagtttcagatatataatgactttgagttattttcagcccctcattatcttctctcatccctcctagtcttgatgaaacctcagaaaccctcctctttccgagaagggcacatcctactttctttggtgtttatttgtcttgttgagagattggtaacgtttcattatgggtgagggagaagttcaccaggcccacctttcccaaggggatattgattgtcagtagttactgtgggagaagatgacatttgctttagtggtgcagccattgataaactctagttcatgctctagtaagtaacatggcttctcttttaaagaggcttcagttatatagcctaggctgtcctcaaacttgtgatcttcattcctcattctccgagtgctgggttacaggtatgtgccaccctgggttcatcacttggtatttcatagagaacatcaattctggcttctctgtgtgcagaatctttattttctgactgcttccatttgtgtcttgcatagagaatttcttttgtctgccaagccatttttttctggtgtcatcttgaaagagctagaaattttacctccttcattaaactctactggcctgactgtcatggaagagacagttccctgagtcatagatcatgtaaacacttctccctgtcagtttatgtagatgtttagtgttttatgctgctgtcttggtatctttgtgggagagttatatttgttttttttttttttttttagatttttaaaatcacaaaataaagaagtgctttctgactttctggttactcattattagaagtcagtatttaatacattgttcttagatggtaatattgttgggggaaagtatataaatcacttctatgaaaatatataactcatcctgcttattgaacttgcttataggcatcagaaatgatacttggatattcaacttttacattcttgctcatacaatatttactcatagtgttttagaagatttattttacttttctataaatcagtcagatgatacaaagacttgaatttaacacagtaatttttgtatgcatgatgatgttgcctttgaatttataagcctttgactgcaggaaacttaaattttaattgtttcttttttaattttgaaaataacttttcaatagttaccataaatttcttttaaaaatccttactaaactactttatttatttacattagaaaatttgccctgctttctgctctaccctgcctgagttcttcacctcatctcccctgcccccacctctgagagggtgctctctcacccactcacccattcccaccgcacccccaccaccatcccttttccctggggcatcaagtttccacaggattaggctcatcctctgccactgatgccatacaaggcagtcctctgctatacatgtgcctggggccacagaccagcccgtgtatgctccttggtttttggctcactccctgggagctctgaggggtctgggttagttgacactattgttcttcctatggggttgccatccccttcagttccttcagtccttcctctaactcttccatattggtcctggacctcaatctaatggttggttgtaagtatctgtctttgtctcagtcagttgctgatagagtctctcagagaacagccgcgccaggctcctgtctacatacacagtatagcttcagtaatagtgtaaggatttggtgtgcatgcatgggatggatcgcaagttggactagtcactggatgtcctttctttcattctctgctccatttttgttcttgcatttcctttagacaggaacaattctaggtaaaaaatctggagatatgtgggtggctctctgcctcaactgggacccatgtctatttactggaggttaactatctgaacaaaattttgtagaatacagataataccttctacaaacagagttctgcctgacttttcttctttttgtcataacctactctgagcacgatcaaactagtcatgtcccctgctcactactgtacaatattgtacctttgcttctttctgcttaaaggcacctgagtgttttcaaagcaaaaaggggtcaaatttccagaaaaaaaagatgataaattgagataagcccaacattctgtgctatgtctccttcagggcatttgccagtggaagtagtatggacaaagaaaccaagaaactaaacccagagtggtgaacgagacagaaaatgagcaagagtccaacaggcttataggctttagagatacaaaagagagttaagagatatcctgatgatccaaacctgagctttcaaattgccagagaaaaataacacacaatgaaatgaattgagtccaatattttgtattcttttcccttggactagctcctgatgtataagcgggagggacagctgtaaagctcagcagctaagcagagctttcagtaattctgtaatgctggggagacagaaattagagttcagagcctgccaacgagtaggaaccctgaataattatcctaattattcagttgggatccccaaagggctaaagtctaggagtagggatgaactggaaaaaaattccccacagagactaaagtacagatttgaattagttcaatgttggacagaattgaggtggtttgtcccttcctacttgataaaagataagtaaatctctagaggacaacaataatgtattgagctttattaacttttaacatccaatatataacatgaataaacagtcactgggtttaccaggtatattaatcttctaagactggcatgacatagtactacagactggatatcttcaaaattctagaggctgtgtccaactagattcagaatctgtggaaggtactcttcctcattcatagttgaccattctcctgtttgtccttacagtgaaggtattgcagatgtctataaagggattaattccacttaagagagtctttatggctaaaggacttttatctactaataccattgcttttcaggttacgatttcaacatggagaatacaaacatccagtaaacaacaataaaagggaagcaaattctggaattgaggattataataattaaaatatattgattgatacatgcatttagcaataaattagcagctcaagaaaagattgactaatcaactggaagataggtctgtaaaaatattctgactgaagaaccaagcaaaagagttagaaatgtcaccctttcagaaaaaaaagcttgacacaactatgtaactttggaggattccttgagatcaagatttcaaacagcatggaaaagaaacactgctaacccaatctcaggaagaggaggaaatggagggggcaagggaaggagaaacggggtggagggcaaaggcacagagagtatatgtgaatatgagaaaatgacagtgaacccaaacaatggactggcttttataggtatccctgttgggaagccgtggcaaatctactcaactaaattgtagagagaccatagatttacagggtcagacctgggtctacctcagcttcgccttttgctttcttacattatctttgatttgtgattctctaaattgcagtttcctcagatatgaaagaaagttcaattctcttaaagacttattatgctaaatcattgatataaactacaaagtcacatgacatatttttcctttatttttcttagggtgtttacattattttgagctgaaatttatagattctagagacattatctttcctaataaatgttgaaagtttttactccatccattgtgtacttaatgaaaacggaggggtgtctacacttaagtctaggtctttaaattttctgaggttatctttttgctgtgttaatcttagttttggatgtgttaagtacttaatttcattgaatattgttttcttttcttgttgtaaatataattaaatcatttcccccttacatttctgacctccaaactctctcatatactctttcaaagtcatctcctcagttttcattatttttttattcctaaatatctcctgctcagtctatataatgttacttgtatgcatgctttcaagtctcatcatttggtattgaattaccaattggtgtgctcttccccagggaagactgactgttgttccagctttcagcatactttagttgcctgtagttccttttgtagtatttaagcttcctggctccccccacccccatccactttgacatgcttaatgttgttgttcttactcagctcatgtttagtgagtcatcttggtgagacttggtagcttttgactactaggagaaacagtatcatagcaaaatcacagattctctggctcttaaaatctccagacatcttacttcttcaatgatccctgagccttaggtatgggggctttattgtagaagcatccttttagactggactccacaactctgcatttgattggtttggttttctctagtggtctatagaactttccttgataaggcatgatgactctgctcatctatgggtatgaagagaaatatttggaatctagttagggattatgctggtttaataaagtgtcaattaattttcctctgcccactttgaaatatctgttgttttgttcagctcatagttagtcatgttagtgagactttataggtatagcttctgacattactaggagaaatgatatcacaacaaacaggttcccctccaagttccaagacttcactagctctgagtaattggctaggttttcagcaacaggaatgatttccctcttgttaaatagaaagctgctggctactgccaagatatacatgccactattgcatacttagggtaattgtaacattcttgtcattggtgttgttcataggcattatagctgggtaagactgttagttgcttccttctcttagaaccttgcatggcaccttctggaatgatgaaagctactctttggggaggagtcttccaggtcagatccagctcaggtgactctgggccctatatctaaagcacatggtgttttcagcactagggacttgctttccatctctgatggaaaaccaagagcaatagcaatagcatgtatgtttggggagtattttggataagcccaaccaacagctcaaaagaggcttctcatatcttgggttgggatttgttgttgttgttatgtggtctttgtctcttggaaggagttttgtccgtccatatgagaaatttttatttaaatccataattctcaaccttctttaactttttttcctgggatggagagatggctcagtggttgagaaaactggctgctcttccagaggtcctgagttcaattcccagaaaccacatggtggctcacaaccatctgtaatgggatttgatgccctcttctagtgtatctgaagacaatggcagtgtactcacatacatgaaataaataaataaattttcaaaactttacctctaaaattttttcctattattattatttacattgggaccaaagttcccacctctcccaatccatcccccacctccttttgccacccccatccactcctcccccatttctcttcagaaaaaggcaggcctcccatgaatatcacgtaaacatagcatactcagttgaggcaaaatacagcaagcccatagccaacatcaaactcaatggagagaaattcaaagcaattccactaaaactggggacaagacaaggctgtccattctttccatatctattaaacatagtatttgaagttctaggtgaagcataagacaactaaaggagttcaaatggttgcaaatttgaaaggaagaaccctaaccctaaccctaacccctgaattttgggtgtgtacctcccacagctcaggtaagctactgaatgcagggaccagctcttaatcttcttaatgctgtgacccttttatatagttcctcgtgttgtgatgacaccaaccataaaattattttctttgcgatttcatagctgctattttgctgctgcattgttatctgcattttctgatggtcttaggttgaccctgtgaaaatgtcatttggagtgcccacaaaggggtcatgacccataggttgagaaccatgtatgtaaattattatatctatatttatacacagatttatgtgtgtgttatatggtatttttggtaaatagttaatgtcaacttatagatttgacttatttttgtttctaaaagtcaattcattcactcaacgtctgttattgtactatgtgccaggcactgtactaaaagcttgtcataaaagatgagtgatagaaccagtggggaagcacctgaacacttcgaatgtggtaagatgactactacaggagacaaaggcaggcataagtgatgttatttttttcttgggcgctgctgggaacgaaccatttgagccaagtctctaaagattggaagataagtattccatgcagaggatatagtatgtaggaacacaggacaattgaaagattggttgtagtcagggatcaagtattattttatgtggctaggatataggatattaagcaagaaagggggatgtagtgagacatcaagtgtgagtgttgcataaacttggattggcagtaatttggtaatgtgctggagagggtcgtgaagaaatataaagaactgggacgctgatgcaagaaggttctaagtaagaaaggatcagggagaatggcagtggggatggagggttgacacaaagagtaaagcacttgatgctcaagcataattacctgagtttggattcccagaacccacaaaaggccaaatgtattagtgtgtgtctatcatcccaggtatcccactgtgagataagatacaggaaaatcctcaaaaatcatgctagcacaacagcaaagaagaggctattgaagtcaaggagcaaggttaggaccaacagtaaagtttgtcttttgacctccatatgtatgagatacatacacatatacacgcacaaacacagacacacacacacacacacacacacacacacagaaaaatacagaaaaagagggggaagagagggaagagagggagagggggagagattctttaatagcaagtcaaatggataaaaagctccactatgataatacctaaattattttaataaagagttatgataaaattttatgtaacaaggacataaacactacccatcttcatgaaattttatctaatattgaaaaattccataagaactattatattctgagggattcatagagattaagttttgctatctttttaacagcacaatgctgttattgccctgtataagaaatagaaagagtaaacatctaaggtcacacagtgggtagaatgtgagccatcatcaatttctagaacattaacatttatatttagctaccttttaaatatcaccagttggtagtaattgtttaatagcattttaaaacacaatagataattaacagagaaatacttaagtaactccttgttattctccatcttacagaagtaaatattctcctgagtgtatttccttcaactgcaaacatgtttctatattattaccaattctttgtgcacacataagaaatatttctgtattcatgtttataaaactgtttttatattttgtatattatgaatcatgttttatactcattaaattctaacaccatgaagagtctatagcaccatcatttatttttcaattctactgcttaaattgtcagggatttttattgctctctaaacatatttaacaccatactacttctcttcaaacatatgtaaaagtagatgaagtattggattaaatgtttaattaattaaattaaacattattttaacaaattaattagattttcatataacattcacattttatactaaacttattttttgttgtgagtttgggtgtgtgtgtgtgagtgtgtgtgtgagtatcagtattacagagggcaaaggacaacatcagctgtcctgctctatcaatctccatctcatttccttcagagagggcttcccactgaatctggacctaggccgacagccaacatgctccagtgacctaagtggagttcagtttagtgaaaccattttaatttcagaaatcaatacaaagctagtttctttgtggggagtaccaatgtaattgttaaacatttaaatatgactaatatcaagaattaatcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaaaaatgaaaaaaaaaatatcaagaattaaaatgaggcttatataacacattctgtggatatgtaaaaattaaaatgaggtccatctaggcacatagattttacatttagaagaaattgaccatttttaaagacagaaaaaacagagctcatgcttatataactaacaataatatatctagtaaacaaactgaatgtatagatatgactgaatactaaagggtttacatgggctgactggaaatttaaccaaatatttaaataaaattaatatgtagtaaaatacttcaattttagtgaaaatgttgatgagatttgacatatgtgaatgtactataaagataaaaatcagaaaaattgatatctaggagttaagcttattcattttccatacattaaagtagagaagaaaatgcactatatgtaatattcatttttcatgaatgtgttctgctgattttgttctactgatcaaaagccataaaatgtagatcatttttcaccaactaaagcactcaaaacaccaaataatttctttttccaacatcaagcttacactttctgagtacctcttgggtatatgcgaataaatcacagttcctgtcccaaagaaacaatgtacttatgaatgggaaacttgtagtgtttaatgagctcccaaagaggcacaacttaaagattgttaagattggagaggcttttatagacaagagtctggtgtggttgttacacaccttttaatctcagcacccaggctgcacaggcaattggatttctgtgagtttgagaccatcctagtctatatggtgagttccaggacagccaggctcgtagttacaaagagaaaccctgtctcaaaaaaaatccagatagatagatagatagatagatagatagatagatagatagatagatagataatctctttcatttataccttgactgccatttcttggtactaagacaaaatgcttcctctccccataccacaagagctcattcttacattcctatctccataaataacactgaccctgccaattacagtgtctgtcatcttccctccatgctatatatagctctccatgctttaagaaccttcctccaaactcacttccaggagagggccactaattattaatcaatttggtcattcagaagtatttactaagcacctaatacatctaggagctatggatacaccagtgaacaaacaaaatctacctcaaggagctctttcattagaaggaaacaacataaaataagcaagtaagtaaatgtaagaatgtaaatatttacatattatatgaagaaaaataatgcaggatgaattgtcaaacttcatttatgagttgaatgttttgcatgctagaaagacttgcagtagaaggatattggggatttgggaaggaaacctaaagagataagaaaacaaaccatttggtgttagtctatgaggagaggaagacagatcaaaaagcacaaacatcccaagtctagaacatgcttagcaagtttgactggcactaagaacaaagggtggagtggaataaaatgaccagaaagatatctttggacagatcacattaaagactgttgacttcattatcacacaatgggagtaaaatcagcatatgagttgtttttaaagggtcattctagcaattgtatagagatgagaatgacataggcgggaacagtgcagagtagctccaagatgttgatttgtaccaaagcaatagcagaggacataagaaaccatatggaaagtatttatgatgtttagttgatacaattgctaggagactgattggactatgtggggagagagaattgggttataattgctggaacagtgctctcttgttggaaaatgaagatggaatgtaatgcatagaaggaggagctggctttagattaaagcatggacagttcactagagaaacatgagaagaatttggcacagaagcatccaggtgagtaagtatgaggataggaaacctgagggctcagtactgactgctttctcttttgctgcagaaagaaacctggagctaggaatgaaaaggagagatttgaatatgaaatagtcatccaaacatagccactaaatcttaacctctgtatccatttccacccagctggattcattttccttggtttgtgtatgttctcagaagctctttcttcattaaatcctcaccttgaatgatagaaacactcatataagtagtttactaaggagaaaataataaaccattaatttccttataaaggaaacatctacttggagaaatgatgatgtggtctatctactactacctctgtcatgctgctcaaatctccatccccactgccattctccgtgatcctttcttacttggaactttatgtcagcatcccggctctttatatttcttcacgaccctcttcagcacatcaccaaattatggccaatccaagtttatgcaacactcacacttgatatctcactacatccccctttcttgctttataccctgtatcctagccacataaaataaaatctgatagttttatccaaaattgctgtaatccagattggcttcacatttactaagtatcttaggatggctttgcattggttgatctcttgcttctaatctccatgtggtgggtgtatagcaaatccaactgttgtgtagagatttcccaaagctataaaaaccactgaaaaaattattaaaattataaataacaagaaaaatgcatttagaaaagaatacatgttgaatttgatcaaatatattttggacttattgagttgatcatttctctttcctttttatcctgttaaacagtgacaaaaattatattgatttattttgagcattttattaacaagtttcattcacatctacattcacaagtggtgttctcctataatgccttttcttggttttcttattaggctaatacttaattcagatgaaatgggttggaaagttttcctttctcatattttctgcaagtttatgaggggttggtatgatttctttattttaaaatgtttggtagaatttatcaataaaataactagtgcttgaatgtttcttgctagaatttttataatagtaaaccaaagtttaagaaagtcatagaactattcatatcatccctttcattacaggaacccttgatagtttgtgactctgaaagaattcatccattttgtgcaattttaccaatttccaggcacaaagtcttgtcttttaaatttctgtggggtcaagcatggtgcctcttctttatctgatgcttatagtttatatcttctctactgttttcttggttaggttgtaagcgtctcagttttactgccccccccccccaccaccaaaggacaagttagctcttggtttgattaaaatcatgcaaataactgacataaaaattttattgattcctatttttgtctctttctttttacctttggtttaatttcctttttttttctagtgttgaaagttttgggagcttagttccatagtgtcttttcttctaatataagctttagtgttttcatttttaagcactacgtactataattgtatcccagacaatttgataagctaattatttaattactaaattttgatgctatggattgaactgtgggccgtgtgcatgtttgacagcagtctgccactgaactactccctcagctaaatttttattttcacgcagctcaaagtattttaaagttttgccttagaattcttttttgatccataagttatttacatatatgcttttaaatgtccaactacttaagaaataggtgttatatacatttttttctagtttaatttcattatatttaaagaacatactttatatgatttcaattcctgtaaaagtttcccatgtccatttaatgtactgctagtctaattataaaacttagcagctactatggaaaacaaggaggttcctcaaaaaataaatgcagaaagctataatgtaatccagcaatcccaatagagtcttgaaaagatacttcacacccacatttgtaacatgagtatttgcaatgtcaagagctagaagcagtacaaatatttttttgtcaatagatggatcaacaaactatggcttatagccacaatagacttaaaattccactttaaaagagaaagaaatgcagctacatagatggatcttgaaggctttttatattttctgaaataagccaaagattttatgtctccatttgcatgaattaccttaagtagttaaattcatagaaacagaaagtataattatgactattagggaatggggatgaaagtaaagggtagttgtaatctaatgagcctagaatttcagctttgtaaggtgaaaaattccataagatctctttacaacaatatgaatatactactgaaatatacacttccaaaaatggcaaaaatttttaaaaagctttgcattacatggatatttttactgcaattagatataaaataaatcttttttgagatttgtcttatggaccagaatatcatgaaagatggtaaatactctttgtgcacttgtaaagcctgttttttgctcttgtagaatagaggtttttttttttaataaatgtcaattaactgaaattagctaacagcattgtgcagttctctacgcttactgattttctgcctagtcgttttattgattgctgagagaagcgtgttaatatccacaactatagctgtcagtttcccttctcagactttttagttctgccaacttttgtttcatatatcttgaacctctgttgatagttgcatacataatctggattgtgaggatttctagttgaagtgatccttttagtttcatgtgatcatctctgtttatttcagctgatattctgtattttgaagtctactttttattactatgaagtgagctttttatatggaacatgtgattttttaaaatttctatcttcttaaggtatatttattcagatgatttatatttgatgtaatcattgatataattggattttattatctgctttctgattattcttgctagacttggttgtgattttctttctttaagatcactgtggaatatttattagtccattttaatttatgtgttactgctgtatgttacatttgtatattgatgtttgctgtatgaatttcaatccatattctcaatattgcaatgtcatgtttgagttactattgtactacttcaggtacaatatagaagatttaactgaccgtgtggcttcattatcttaccctatttgcattcataagtattttgagaattatagaaaattcaaagtactatttcataacattttgcttccaatagttgcccatattttgaagaacataaatgtaacttgtaacatttgtaagagatttatacttctcttgtattttcattgtttctgattatcttagtttccatctaatacattttccctcacctaaaagaatttcctatatagtttttggccagaatcatcatatttttagttatcattaatctgaaaatatcatttacctttatttatattttaaaagtttttttgagaatgtcatatatgagtgttgtaccttctataatttctatctctctctttccccttccaattcttcttgtgaaagtaatttcactgtatgtaaaagtctcacttatatttgttaagtaatttaaatatgaagttctactatcttctgacttccatttttttctttcaagaattctcatattaatattgttttgagacaggatttctcagtgtaaccctggttgtcctggtggaactcactctgtagtccaggctgaccttgaatttagagatctgcctggctctccctccccagtgctagaattaaaggcatagaccattactgcctagccatctacatataattttagttgttttgtttaagatggaggtctaactatgtaaaaaaggctgaccttaaactccttatataatatataacattttttaacattgtggccatgattttctttgtccatatcatgtttgagatttgttgagtttcttaagcctttaattaagccttttaccaagttttagaaatcttcaattgtaatagtttaggtatattttctatgttcatttcattcttctcttctaggactctagcacatggaagttaaaatttccgatgttattcttcaagtctctcatcatttcttcactttctcaacattttttctttttattaatcttactggatagttcctactgatttatcctaaaattgtcttttttcctgtcatttctatttctaatttactattaagtttatctcatcattttaatattttagatcccttatccctcagttataaattttcatatggttctttttatggtttgctttttctacttaaacttatctagtatgtttacctttattgcatatagcatgattctcatagctatatattagctctctattgctaggttgtgggcaccacctccagcaggaagacaggacatttgtggggttgccatcccacagtcacacctctgacccataattgttcctgtctgaaagaattacagggatggaaatggagaggagcctgaggaaaacaaggtccagtgacaggcctaaagtgggatccagctcaaggggaggtcccaaggcctgacactattactgaggctattcaatgctcacaaaaagggacctatcatgactgtcctctgaaagacccaacaagcagctgaaagagtcagatgcagatatttgcaaccaaccaatggacagaagcagctgacccctgttgttgaattagggaaggctgaaagaagctgaggagaagggcgatcctatagaaggaccaacagtcttaattaatctggaccgctgagatctctcaaacaccaaacagacaacatacaccagctgatatgagaccccaaacacacatacagcagaggacttccaagtctgtgttcatttagagatgatgcacctaaccctcaagagactggaggccccagggagtttagaagtcaggtggggcggtgggtgggggcatccacgtggagacagggggtggagaggaggtgtgggatgtggagcagttggagggtggatgggaaggtggggaatggaatatggagtgtaaaaatgaattacaaataaaattacatcatatatatatatatatatatccctttttaaaacgaagtaaagctgctatgaagaaaaaaagagaaaaaaacaaaatgttatacagctatacagccccatagtacaaagtgtatctgtgcactatgcttcttgttcattacaaagaagtaaaagcttgaaaaatttgaaaaaaaaccaataaataaacaaataaataaataaaaataaattgtgggctcttagcagcttaaaaccttaaaagggccagggtcttagattattgtaattaagttgttgctagagtcacctgaagcttggggtcttctactgacctaacatagttgttgacagaattagcccctggaagctgaaggactgaattcctcaattactaaaattacctgtagtttccttgccacaaggccctctcaagaggcatttcacattttatcaagttgctcctttaagaagaacacggcccccaatggaggagctagagaaagtacccaaggagctaaagggaactgcaaccctataggtggaacaacaatatgaactaaccagtaccccggagctcttgtctctagctgcatatgtatcaaaagatggcctagtcggccatcactgcaaagagaggcccattggacttgcaaactttatatgccccagtacaggggaacgccagggccaaaaagggggagtgggtgggtaggggattgggcgggtgggtatgggggacttttgggatagcattggaaatgtaaacgaggaaaatacataattaaaaaataatgataataaaataaaaaaataaaagaagaataacagacagctggtctaggtggcatgtgcctttaaatccagcactgggaaggcacaggcaggcagatctctgagagttcaaggccagccgagtctacagattgagctccaggtcagacagggatacacagagaaaccctatattgtcaaaaaacaaaacaaacaaaaacaaacaaaaaaaccccaaaaaacaaaacaaaacacccaaaaaatcccacaaaaaaaaaaagaaaaagaaaatctgtctggtgtactaaaactggtgtgtttttcccctttaaaagttttaaaagtcatttttaaaatttctactattgtcgattttattacttctatttatttttcatttaatttctttctcctttttaaattagatattttctttatttacatttcaaattctatcccctttcctagtttccactctgaaaaaatcccatatcccctccctccccccttccccctctcctgcccctgctcaccaacccacccactcctgcttcctggccctggcattcccctatactgggaccaagggcctctcctcccattgatgactgattaggccatcctctgctacatatgcagctagagccatgagtccaaccctgtattttctttgattggcagtccagtcacagggagctctggggttactggttacttcatattgttgttcctcctatggggcttcaaaccccttcagttccttgggtactttctctagctccttcattggggagcctgtgctctccttccaatggatggctgagagtatccacttcagtatttgtcaggcactggcatagcctctcaggagacagctttatcaggttcctgtcagcaagctcttgttggcattctcaatagtttctgggtttggtaattgtatatggaatggatccccaggtggggtagtatctggatggtccatccttcagtctctgctccggtctttgtctctgtaactccttccatgggtattttgttcccccttctaagaagtgtatccaaaatttggtcttccttcttcttgagtttcatgtgttttgcaaattgtatcttgggtattctgagcttcttggctaatatccacttatcagtgagtgcatatcatgtgggttttgtgtgtgtgtgtgtgtgtgtgtgtgtgtgtgtgtgtgtgtgtgtgtgtgagagagagagagagagagagagagagattgggttacctaacttagggtgatatcctccagatccatccatttgtctaagaatttcataaattctgtttttaatagctgagtagtactccatggtgtaaatgtaccacattttctatatccattcctctgttgaggggcatctgggttctttttagcttctggctattataaatgaggctgttatgaacatagtggagcatgtgaggaaccaccagactgatttccagagccattgtaccagcttgcaatcccaccaccaatggagtgatagtcctctttctccacatcctcaccagcacatgctgtcacctgagtttttgatcttagccattctgactggtgtgaggtggaatctcagggttgttttgattagcattcccctaatgactaaggatgttgagcatttctttaggtgcttcttggccattccgtattcctcagttgagaattctttgtttacctctgtaccccatttttaatagggttatttggttttctggagtctaacttctagagttctttgtatatattggatattagccatgtattggatataggattggtaaagatcttttcccaatctgttggttgcctttttgtcctattgatagtgtcctttgccttacagaagaaggtttgcaatttatgaggtcccatttgtcaattcttgatcttagagcataagcccttggtgttttgttcaggaaaatttcccctgtgcccttgtgtttgaggctcttccccactttctcctctgtaagtttcagtgtatcaggttttatgtggaggtccttgatccacttggacttgagctttgtacaaggagataagaatgggtcgatttgcatttttctccatgctgacagccatttgaacgagcaccatttgttgaaaatgctcttttttccactggatggttttagctcctttttcaaagatcaagtgaccatagttgtgtggattcatttctgggtcttcaattctattccattgatctacctgtctgtcgctgtactagtaccatgcggtttttatcacaattgctctgtagtacagcttgaggtctggcatggtgattccaccagaggttcttttattgttgagaagagtttttgctattctaggttttttttttattattccagatgaatttgcaaattgccctttctaattcagtgaagaattgagttggaattttgatggggattgcattgaatctgtagattgctttcggcaggatagccattttgactatattaatcccgccaatccatgagcacgggagatctttccatcttcttagatcttcaatttatttcttcagaaacttgaagttcatgtccaacagatgtttcacttgcttgataagagtcacactgaggtatggaatataattttaaatattgtgaatggtgtcatttccctaatttctttctcagcctgtttatcctttgatgaggaagactactgatttgtttgaattagttttatatccagcgacttcgctgaagttgtttatcagctttaggagttctatggtggaattttgggggtcacttaattataccatcatatcatctgcaaatagtgatattttgagttcttcatttccaatttgtacccctttgacctccatttgttgtgtaattgctctagttaaaacttcaagtactatgttgaataggtagggaaaaagtgggcagccttgtctagtccctgattttagtgggattgcttcaagtttttcctccatttactttgatgttggctactggtttgttgtagattgcttttatcatgtttaggtatgggccttgaattcctgatctttcgaagactattgccatgaaggggtgttgaattctgtcaaatgctttctcagcatctaatgaaatgaccatgtggtttttgtctttgagtttgtttatatagtggatttttgatggatatatatatatatatatatatatatatatatatatatatatatatatatatatatatttaaacattcctatatgcctgggaagaaaccttgattgtggtgaatgattgtgttgatgtgttcttggatttctttgtgagaattttattgtgtatttttgcattgatatttacaagtgaaattgatctgaagttctctttctttgttggttttttgtatggtttaggtatgagcgtaattgtggcttcatagaacaaattgggtagtgttccttctgtttctattttgtataacatttgaagagtattgttattagaccttctttgaagatctgatagtaatatgcactaaacccatctggtcctgggttttttttggatgggagactattgatgactgcttatatttctttaggggaaaggtgactgtttagatcgttaatctgatcctgatttaactttggtacctggtatctgtctagaaaattgtccatttcatccagattttccacttttgtgagtataggcttttgtagtaagatctgatgattttattagatttccttggtttctgttatgtctctcttttcatttctgattttgtaaatttggatactatttctgtaccctctggtttgtctagctaagggtttatctatcttgttgattttctcaaagatccagttcctggttttattgattctgtgtatagttcttttggtttctacttggttgatttcagccctgagtttgattatttcctgctgtctactcctcttgggtgaatttgcttccttttgttctagagcttttataggtgtgctgtcaagctgatagtgtattttctctccagttactttttggaggcactcatagctgagttttcctctttgtgctgctttcattgtgtcccatatgtttgagtatgttgtgctttcattttatttaaattctaaagagtctttaatttctttcattttttaaaattccttgaccaagtaatcattgagtagaacattgttctgcttccctgtatatgtgggctttctgttgtttttgaagacctacctaagtctgtggtgatctgacagggtgcatgggattatttcaatcttcttgtatctgttgaggcctgttttgtgaccaattatatggtcagttgtggagaaggtaccatgaggtactgagaagaaggtatattcttttgctttaggatgaactgttttataaatatctgttagataaatttggttaataacttctgttattttcactatgtctctgtttagtttctttttccatgatctttccattgctgagagttgggtgttgaagtctcccactattattgtatggggtgtgatgtttgctttgagttttattaaattccttttatgaatgtgggtgcccttgtatttggagcatagatgttcagaattgagaattcatcctggtagatttttcttttgaccagtatgaagtgtccttccttatcatttttgataacttttggtttaaagttgattttattcaatattagaatgaccactcgtgcttgtttcttggaaacacttgcttggaaaattgttttctagccttttactctgaggtagtgtctgtctttggcactgaggtgggtttcctgtatgcagcaaaatgggttctgtttaagtatccattctattagtccatgtctttttattgggtaattgagtccattgatgttaagagatattaaagaaaagtgatggttacttcttgttatttttgttgttagagcaggaattaagtttgtgttgctattttcttttaggtttgtttaaagactactttcttgctctttctacggtgtagtttcccaccttgttttggtgttttccatccgatatcctttgtaggggtgggtttgtggaaagatattgcttaaatttggttttatcatggaatatcttggtttctccatctatggtaattgagagttttgctgggtatagtagtatggggtggcacttctgttctcttagggtctatatgacatctgcccaggatcttttagctttcttagtctctggtgagaagtctggtgtaattctgataggtctgccttcatatgttacctgacctttttcccttactgcttttaatattttttcgttgtttagtgcatttggtgttttgattattatgtgatgggaggaatttcttttctagtctattctattgggaggctcttgtatgttcatggacatctctatttttaggctagggaagttttcttcttaattttgtggaagatatttactcacccagtaagttgggaatctttgctctcttttatacgtgttatccttagatttggtcttctcattgtgtcctggatttcctggatgttttgtgttagggtctttttacactttgcatttcctttgactattgtgtcagtgttttctatggtatcttctgcccttgagattctctcttctatctcttgtattgtgttgatgatgcttgcatctatgactcctgatctctttcctaggttttctgactccagcgttgtctacctttgtgatttttttattgtttctatttccatttggatgattttgtttatttccttcgactatttgattgtgctttcctgtaactctttaagggatttttgtgtttcctctctgagggcttctacctattttcctgtgttcacctgtatttctttacaggagttagttatgtccttcttgaagtcctctatcatcatcatgagaagtgattttagatctgagtcttgcttttccagtgtgatagtgtatccaggacttgctatggtgggagaatttggttctgaggatgccaagtaactttggtttgagttgcttatgttcttatgcttttctctcagcatctgattatttctagtgctccctgccctccattatccgactggatcctttccttcctgtaatcctggttgtgtcagaactcctcagtgcccagctatatctgtgatcctgtgattcagggatcctgggatcctgagattctgggtgtgtcagtgttcctggaagtcaagctgcctctgggaccctgagaatctggtgtgaccaagctcctgggatcctgggatcctggaatcctgtgagcctgtcaacctgagcacctgagatttgagcctcctctggatgctgtgggacttgctgtggagttagcacccatggtaaactggtgcagaacggaaagaatgggagccactggttgggtggggttcctgagtccctggatcctgctggtcccagttattcctgatggtgttggaacggatgttgtgtcctactcacccctgattctgcgatccttagggtgctagagtccctgggagtagagcctcctctgggtgttgtgggactggctgcagagttcttgcctaagttttgggttccttttaagtagatgttttttgtattttctccagaattttattacgaaaggtcagttctagtgagcttcttccatcttgaccaggagtgtaggtttttatttataacatatttgcacatttacagtgggtttcttagagacagcacataatgtacttatttttttaacctaacctcaattttgacatttaatttggacgttcagataattttttaaaaagcttgtggacaattttattagtttgagagaaaaactacaaggcaggaaagctgtaaatctcagcagctacttagagtaggaaaacagaccacaagtcatttcatttgtaagcagccatgtagtgggaagtggggggagcttcagagaaagactgagaaaacccagtgtcagggaaagcatgcggagactttggaaaatagataaagaaattttttttttcgcttttatctgcaacacacaaaaaaaaaccttgttcaggcttcacatagccacattgtggtaactccataagtaagtgcagtgaggagaggcttctgggaaagaaaagtacattatgtaatcaagagaataattattcctccactctcctcagcatgtcttcaggtgaataagatttcctggggtgtgtactcttgggcaggtggttgacaggcccagttggactaattcttattccaggatacaatagtatgtagagttctgatctttggagccattcagaacattgcatctctgcatctctgtccagggccagacacagatcccattcttttctaatttttcttcttcttcttcttcttcttcttcttcttcttcttcttcttcttcttcttcttcttcttcttcttcttcttcttcttcttcttcttatcaggaaagaagtagctttatcgtaatggccctcaacagagctctgatacttatcctccgtggtatttctgtaacatactttcttaaagagtgaagaccctaaaatcgtttagaaatagacaaaattaaaaaaaaaatagttataacctatttctgccatgaaaatgcagatgtaattgtaaacctgtttaccagagggaattagtgtctggactggtggtttctgtcataccctcatgtatagcctccaagctgggctgctaatttaggagaagataacaagaaataagagctcctttctggcattcttggcctctggccagaatagaaccaaggacatttccggcttctggccaaggacaagaatgaaaactgttccctttggggtctctgcccctaagtctgtctaagctgtttctgtttcctgtcctcatttaactgtttaaagaggagaatattgttgggaaatttgggcaataactggttctggcatatgcctgctggatgggggtcctcaaaccgtccagtgggcctagaaaagggacttcagaagtccattagtgattccacttgtataaccaaaaggtgtagggaggaaaagcatcccctgcatagacagagatgtgagggtggagaaaaagcaagaaaggagtcagagaaaagtgaaattggagccctttaagcagaggaaatgattccatcccaccaggagcaggtacagaagtttaaataataccttagagttataagccctagtcagaaaaccagaagtcagaacaaaggacattgaaagatatctaagtcaattagaatcccttactagactcacaagaacatcatccatatgaggcttattgggtttctccttggagtttttcctatagtatttaaagtccgactaaagagcgacgaactgagggtctcctttcaaataagtactttgatacttattggagtcatgataaaaatcaaatggtaaaacctacagaaggtggctcaacagttaaaagcatctgttcctcttatagaagacttgagttcagttcccaacatccacgttactagtgcacaaccagcaggagatctgatgccctcttctagcctctttgggcagtggtacatggtatacacacacacacacacacatacacatacacatacacacattttaaaagattaaacaacagctaaatccttttctcttttttcccccttagaacctacctagaagggacctaattcattattttttaaagaaaatattacttggtactgtacagggggcagcaatctgggaagtaataacaatacttaatgtttgcccataattttcatttaatatcattacaataatatttggatttaaatctaccatttttctatttatattctattgattccatctactttttcatgacttgtttcttctcttcttgtcttctttcagagtaatatatttctatgatttcattttatcttgacttttagatcactagtcttagttctttgtttttaatggttgcaccatttaaaaatcttcattcaacaccacatataaaccatacagagctatgcctgtgttgtatatgtgtgtgtgtgtgtgtgtgtgtgtgtgtgtgtgtgtgtgtgtgtgtgtgtgtgtatggtgttgaggatagagtaggggaaagctaaaagattgctacacactgttaatgacaactcttggcttttgtttggataggatttgtttagcacttaaatttgaaagacaatttcattgaattaaataagctaggtttacagatttttgtttaatcacttaaaaatgttactctactctcttctgaatctcatagattctgatattatgtttgtaattattcttaacctttttcctatgtctttaaatttgggtacttttagcattttctttttatcactgggttaaaggaattagatatgacatgttttactgtgtttttgtttgtaattatgcttcttgtggcttgtagactttattaagttatcaggattatcattttcaaccatctggaaaaagtttggtcatatttttcattaaatacatttttgtctttgtctccttgtatgggtccagtgctttgtttattttgaattttctttcttggcataattccatttgcattgtttctattacctattcttcagcattgctgatttgtatagattgtaatttgtcattttgcttttatatgtttactgatttaatttaaatttactgctacatatattcatctgctacatatattcatctctcccctttgtgtgtgatagtgagatattcctacaagtgaaataatatattgttatatttactactttatacaacatgttttgttcgtttgttttgcagcactagtatcaaacccatatttttatacttgctaggcaagtgttctaccactgagctatatccccacttctctgtatgacatattttaaagtagctgaaagatttaaggagaacaaaaacatattcatagggtttattatctttgtgttcctgttgtatttctggttctttacatgtttttttgcctctaaattcaagttgccatttgctatcatttccttattcccttggtgctattattgtcattaatatatttctatatattatatatacattaattcaattataaacctatagcttcattcaattaaaataatatgtacaaaaaagtaagtagaaaaatatacattttacaatagttaatatttatatatttacctttacaagtcctatgctctttgtgtaagatcaaattaccaacaaaattaaccttccttcgtaatatttcccacccttctctctcttctgagaggatctcactgtgtgcacaggttggtctagaacttgtgctgagattgcagtgccattttaggcttcttcagtatttctcatcagccaggtaaagtagcaacatttttgtttgaatatcttcatttcattttaagttttgaaaggttggtttggagagagaactcttggttgaccccttttgtatttatttttctttataattgcatccttctgccatttgttgtcctctataatctctgatgggaagtcactttaaacttagttggttctcctgtatatgctacattcatgattttgactttttctttgaacttatttctcttgtcataagccttgatgtagatctattgccattatcttcttggtctttttcaggattatcatgtttaggttaatggattttgttatattttattggttttagttttggttttctaaatctcgggtttttccattcattatttcctttttttttaaaatcttaactctttttttggtattcttttaattatatgttgattttattaatgaagtcctgaatttctctgagaccctgttttcttttgattcgctgttctttcagttgcacaatatgctgcttttccatgtttgctaattctttatcagatctactattgacattcccttgctctctttataaagaaaactgaaattatattacatacattcaataattatgtgttaatatatttcctatctctattaagattacgtgtttaaagagacatttatagtagtttactttttagtcattgcttgcttcctttggctttttaaaatgtttatgtcttctttacatattttgctcagtcagtaactgtgcttttttttaatgataatctctcctttctactttttaaaaagttatatgggccacaatttattaattctttctatatctgaaaagacctgcttggctttataattgacctgagtagggtaaaagagtaaaaacatcacaggtatagaaaggctgggatcaggtgggccacgcactgtgctgaagttgcaccagaagccgggaaattcaacatgcttatttcatccagcagaaggaggagacaggtttatgacatatagtggaacaaggaggcaggtttattatatacagatgaccgagtaggcgagggaacagatagaatcttcataggcgctctctgctggggagtagtttcctgctgaagtcctctggaaggaggaccttttgcttgacacccttctttaaccaggagaaggcatccatcccaattgccatattttgatagatttgaattgagtccttgacatgctatcaatacacagtcactcagtaattaatctgttcctttagatatctgtcaagttttttgtttaaaactggacatttgcggttagagatggagctcagggatagagtacgtgaggaccatgtacaaggcctgtgagtctatccctaccaccagaaaaagaaacataggtattttagatatatcatgtcactatctagttactgattactattactgcagtcccattctgtaatctaaactttatttttattgtctgtttgatgacttgaatgtattattagtttagtgaagttcatttcttcagcatgtacaaagtttggcatgtgcatagttaccttggaatgtcaatgattttagaagaattatgttctaatatgtcattttgtccctctgatatcatatatttagcttgttgccaacagcaataatcaactggttttttcctattattttttataatgttttgggaaattctgatccaattacattctagctgttttggtagttagccttttcctcctccccctcccccaccccctcccccctcctgctgctgctgctgcttcacttctgcttctgcttcatcttctctcctcctcctcttcctcctccttcttttattccttagttttagtccaaattgacttcaaacatgtgattctcctgccttagcctcctgaatgctgggattacaggttatgctataatacatttttgtgtcagtatttttgagacaaatctttgaggtttagtctaaccccagggggcctctttttaaatgaatcttaccctggttttgccttaagtgtctaactggtggatagtttagttgtttcttttatgaatcaacgagtctttcagtactcatcagtaaaaccttcatagtgtttggggactaaccttctccccatgctcttttctaagtaaaatcaatcacctagggccgaattacatggagtcctttcttcttatggctgttctgtccctatgggaaaagttgtctatcattcttcagaggtggaggcagtgaaaatagcctgttgtttttttcctcatagttatactttgttcctgggagtaccatcttctgaactccttggttttccttctcagcataataattcaccttatgacagaactgagttaaggaaatttgagacccacaattcttggccaactatttcaagaggagcttatgaagtggtagctcggtaaaagaagggagtctcagattcttagctgtatctacctggattggattacaatttctgaaactcaacattgggtgctatgtatgaactttccgaattctaccctatgtcacacaacaccatgatttagatacagcaaactggagagtatgcctgtgttcttgtttataattgtctagggtagtttttgtcattagaagttggggaaatgggttggagtctaggtgataatagtgtcttaagtgccatatattgatattatataaatattttgatattaataaatattttgatatttttgatagttttaaagaaatgcttttcattgttctatgctcttagaatgatttcctggtacctttttctctccctcttctcccttgtgtgtgtgtgttcgtgttctgtattcacatgtatgtatgagtatactggacatgtatatggaggcaagtctgtgggacattttttaattaattaattaattaatttatttattcactttaattcccaatattagatcccctctcctcccagtcccccttgaaactcctcccccatgctcccctcctattctcctctgagaagagggaatcccttgggtccctgacccccagcacatctcattgtaggactaggcacatgctctctcaataggccagagaaggtagcccagttaggggaatgggatccacagacaggtgacaaattcaaagacaagccatgcttcagttgttgggagacccacaggaagaccaagctgcacatctgctatatatgggggggggggtaggtccagcccatgtttactctttggttggtcattcagtctctgagctccccaaaggtccaggttatgtaggattgtagggaagtgcagagacactgctctggggttggaaaaacacagtgtgagatgtgggaaagacagtgctggttggaggtctccaggcctgcaatgagtcctgggccatggggttctcaggctcatggacaaccaggcactgcagggagtggcagaaggggagagtgtggaattgggggctcaggctggggagtgtctagcctggggcccagggccagggaacaaggagagctccagcttgtcacacaggggatgactgtggcttgatggcagcagatttggtggtggatatgcctgggaatgcagagagaccttctatgggagattaggttgcagctctgtaggtgaaggtcttcttcatggctccccatggcagatttttggggataccctccttctcagggtggacctaagattaaataccttttgcagggagggatgtctgggaagggcagcttattgactaagccctccaggcctctaggtacctctttagagggagaactctgttttcgggcctatgtgactgtgatcatgtctcttttcctattgtcttggtctgagatgttagggatgcttcatctacatgtggaagggattggggcattgcccctacatgactgatggccaaaattctctctacagagggctgtgtatacatgagaggtacctggtgccaagagcaggtaacactcctattgtcctattgttcagggtctccagggcttctagcctttagctcaaccttaccaggcttcttttcatggtccaccaccccacaaagttagttgactctgttggtcttcctgtggcgttcctatcctcttcagttcactcaatccttcacccaactcttccacaggactcttgaactccatataatgtttagctgtgggtctctgaatctgttttggtcagctgttgggtggagcctctcagaggacagttatgctaggctcctgttctaccatcatagcagagtatcattaatagtgtcaggaattggtttttgctcatgggattggtctcagtttgggccagtcattgattgaccattccagccatctctgctctatctttgtccctgcatttcttgcatgcaggatacattttaggtcaaaggttttgtaagtgggttgctgtcctcatccctccaccagaagtcctgcttggctaaaggaagtggccacttcaggatccatctactgtggggcattttaggtggttccatccctggttagatagttttgagtggtaacagaaagcaggctgaacaatgtgtggcaaggaaaccagtaggcagtgcccccatggcttctgtttaggttcctgccctgtttgtgctcctgccatgcttgagtgcttgccctaacttcccttcatgttagaaggtaagttgtaaaccaaatcaaatccttctcttccctaagtagctcctgctcatggtgtttatcacaggaatgagaagcaaactaggatacttttcaccttagttttggaggtagaatctctttctgaacctgaagatccgattttgattaagccgggtaactagtgtactctcaggtgctacctgtctcctacttctcagcactgaggttacagattaaaagtggacatggccatggtcagttacatacctactaaagatttgaactcaggtccttttgcttcatcagtaagcattcttacaaactttagccatcatcctagcccccaattttctgtttaattacaattgcttcttataatattcactaactctggttatctatctgggttgagagtgaccagtggtgtatgctattatcgttaaagtcattccttctggttttttttttttcctgaaaatcctttctctcagttttgggtagctcctggtcatgcatatacagattgaataatcagctaattactcatggagattcccctgacccaagtaaatcactgaagttcttatattctgtggctctctcattcacaattacaaaacatagtgactagtagtaacttcagtctgtttcttcagtcccgagaaaacattgattctctatttcagttccttcttgcctgtgacttaaaaactgcctcagtgccatgaactgtaataataataatttgcctggtctttccttagcaattacagtcttgtgcagcttgtctaatatcagaatgaagatttttctagctattttcctgtttaaggaaggaaggtaaatctgaccctttttactacacttatctggatataagattcttacatcaatttttttccttttatttttcttgaaaaggcactatgtagtagttaaggcagctgctccatttttctgtgcctcattattggcctctgtggactagagatagtaagactcttacccttgcagtgttgttaacatgactgagttaatgtatgccaacagtttataaaagtttacacttaagctgaaataagttttaaattctacatccagcaatattttcaccatcattaccactgatacaactgtctttatttcccatatatcattggagaaattttccaaggcttcacttatgaactgtatataaaagtggactagatcaaaatatctaagttacttgtaaatattagacattgtagcccttccgctcgactcgagactcgagccccgggctaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggtccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggcccacacgggactccccacgggaccctaagacctctggtgagtggaccacagtgcctgccccaatccaatcacgcggaacttgagactgcggtacatagggaagcaggctacccgggcctgatctggggcacaagtcccttccgctcgactcgagactcgagccccgggctaccttgccagcagagtcttgcccaacacccgcaagggtccacacgggactccccacgggaccctaagacctctggtgagtggatcacagtgcctgccccaatccaatcgcgcggaacttgagactgcagtacatagggaagcaggctacccgggcctgatctggggcacaagtcccttccgcaagactcgtgactcgagccccgggctaccttgccagcagagtcttgcccaacacccgcaagggtccacacaggactccccacgggaccctaagacctctggtgagtggaacacagcgcctaccccaatccaatcgcgtggaacttgagactgcggtacatagggaagcaggctacccgggcttgatctggggcacaaaccccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtacctgccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagatttacaggagagcactgctaaagagttacaggctctaaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcatacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaccaagttcacacaatatctttccacgaatccagcccttcaaaggataataacagaaaagaagcaatacaaggacggaaatcacgccctagaacaaccaagaaagtaatcattcaacaaaccaaaaagaagacagcaacaagaacagaatgccaactctaacaacaaaaataaaagggagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgccagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttacctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgtaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtaataaaaactgcatggtactggtatagagacagacaagtagaccaatggaatagaattgaagatccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtaggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtccatctacacaatggagtactactcagctactaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaattccagggccaaaaaggggaagtgggtgggcaggggagtgggggtgggtggatatgggggacttttggtatagcattggaaatgtaaatgagttaaatacctaataaaaaatggaaaaaaaaaaaaaagaaacaccaaaaaaaaaaatattagacattgtataacagttgttttttgtatgtatgaacacttatatatttgtgtatatatagacaaaccttaggttggtagagtttgagagttaaaagaattacatatattgatttacttggtccatgaacacatttatgcccattatgctgagtagcttgatgaaatttccatagcaagccttttaaaagttgtccatgaagcattcttttacacaatgtcactagttggccctttggtacctaatacgttcttggccaccaactaagtataaaattgcactagcaattctgtacaattatctagttttaaaaattgagagccaggcatggtgattcatgctcttaattctagtactttagaggctgaagcaagtatcttaagttcaaagccatcatggactatacagtgagagcatatcttttaaaaaattaagataaaactgatgataattgaccacatggaattttagggcaatttaatccaagtagttagaagggtccaatacccaagcattagcagaatatccatggcatgttttctattttataaagatctggaaatagttaaggtggctacttttagaaatatattgcatttccatctggtctaaatcaataaaattaaactttatgctgtgtgagatggagattccagatttagagactgttatataatgttcttagaatcttcatttagtattatttgagaaacttatctagttatcaggacacaggtgatatggtatacataattttttatgagaaaaaatgaatttttttgtgatttggacatattgattttgagccttccctgtatagatgttctttatcaagtgaagtttatgttttagtataaattttttttcatcatgacaagatgatttagtacaatttataaactaatattgatcattgtgtaccagggattgtgtgctagaactataacataccctttgtgtatgttatatcacctaatcctcactgaaccagtatggggactggagcaatggctcagtaattaagagtatggactgttattcacaggacctcaattctagtcccagaacccacattaggcagcacacaactgcctgtaactccagcttcaggggatcatacacccttttctgcactctgatcatgcaatcaagtatggaaacccatatatatatatatataaatgtttgtgtgtgtataatttaaaaataaaagtaaaaaaaatcattttgatgtaggtgttatattccagttttatagaagagaaagatgaggttcaaaatatgtaacttccaagattataaaacaattcaatagcagatttagaattctgacccagggtcttactgatatcctgtttttaaagaacttcatcattagtattactattaacatctttgctcataccactgttacctaatgatagttctagcatacagattgttaaaggcattgttagaaagaaaatacagtgtgcttttatacccagaagattaccagggggagtaagtaattaaagattacatgtcagataagactttagtgaaagtttaacagccaccaggtggtcttaagagaaaagagatgtttttaaagctaagcagaaacagaaaataaaaagggactgtggtttagaattgtaagaattggtagtgggaggctagttgctaggtgcctgtaggatcctagtttgattataaatagaggttatcattcctattttcagataaagagtttaaagcttaataattggcttaaggggacgagctgtgtattcatagttatcctccaggttgacctgcattttactataccctattttcccctcccaagtaggattctggtagcactgtccttgcgactaacttattttcctcttagctttttttattacttgcttctttttcagtggattacaggaagaactatttcttcagcctgtaaaacttttcactggagagtagtatgtggttcttcaggctgtacttaatctgtctggagtcagtgaaggagaggattaaatatctttgaaactgtttcatgtcctaattaacatgtttcctgtcacgtttgctttatcaaatgagggtggcactcattgtcacatagtgatcccaagttccattgggtagctatgtatttttttattgataaaatccaaaaactggccaatttacccatgagattaaactttcaaaaatgagatacttttgggcaactgggagcaaaagaggcttcagtgagaaaagttcttatagttgatgttttgggggattggtgaatcttgttagattgatagattctgcttcttcccttccattaactaccctttaatcacagctatcacacacacaaaaatgagtaaataaatatctaaatacttgactttgcactccaaatcctttcactatggttgtttggtacatcaaagcagtcttttttttttcctcattaagagtagaccctataagtcagctactaaatatttcactaatggaattaacttattagtgttccaaaatatcaagtgccccagaaacattctgtcataaaatggtaaatggaaaagaatgatcctgtgttcccccttctccccacttccttccttcattcagctgctcttacttctcccgtccctcctatgcccctcctttatctgataatctttcttattctccattgtgttttcctttcctcctgctttccctcttttcctctttgtttacattagaaccgctgctcctttatgcgaacactaagtagcagtcatgtttgttcaggttgccatggaaatattgcaagtaggcctttacacaaactggcttgctctattaatgaatcacacctagaacttctaaggctaataatataggaaaaaaaattctacatagaaattaggtctcagaactcaagtccaattattttctccttcagatagagtttttatccattgtatcattttagagatacatgtatgactttattaataagctatttctttagacttttatttcttttcaccacagaacagtgacttccagtatttttcatttcagagtacacggggaatttacaaattgaaatcttggtttggggtagaaataaaaatgttttagagtagaaggagagagacttgttgactctctcaaaggcatgaaggtaagcagcagcagaggcctcttttgtttggggtgtgtgtgtgtgtgtgtgtgtgtgtgtgtgtgtgtgtgtgtgtgtgtaaagacttcccaacccctgtctctagaataagaagaaagcagttgaaggagggcttcagcctctgagggataaaaagtgggcatagggaagagacaaaggaaatactggatactgtgagggagatagtgtgagaaggaaaataatatgcccaactgtggcctcagaaaggcccaagtatcatttacaagtctgttactctagctctatgataaacagctgcttcctcctttctccaaataggctttgaggttttgtttttgttgttgtggtggtggtggtttaaatcacttgagatactgttgtaagtagatccaatctcttccttcctagaggttagcttagttctggggccggtgggggggggggggaggtaacaactttcaaagacagcaaaaggaatgtaagatgaagaaaaacataggatagtgataacaaaaggaaattaaaatgggaagacaaactctttgataagataatacgcaaagtgagacttagatttgttcacatttagaacccttgagaaagactgattcagatagagaaaaaggcaagttcaaaaggcaagtactattatactgatagtagaaaaacttccagcctttattaggaaccaagagtaagtgaataagtgaagactgggaagaagtgacagaacccagatcatgttgattaagatttataggccataataagggatgagtattttattctagatatagcaggaaaaaatggaggatgagtctttaacaagatgatgttgtacagaatggataatggatagaaggaggtcaaaagtaaaagcagacagactaattaggaagctgttgcttttattcaagactgagatgatggcttaaatcagataacaaaggagatagaagcaggaggactttgttgataatttaaaggtagttaacaggaattgctgagggaataaatgtggtgatttaaagatttctttttaaactttggtaactgggtagcttgaaatagaatgtgggaagagtgctccttggattagaaggaagggcagtggtttggaaaaataaaagcccacatgagactggcagagctctgaaattgataggctgacaacagtcagttcagtagctgccaaatgcaagagaagtagcatcctggaacagacaaaagttaggacagttgctcagctggcttaactcttgttgttctgtagcagttagaggtgcagaagaaatcctctctggaaaagaagaggaggaataaaacgggtgttctaggattggggtcagaagggtttgattttcttggcaccttcattgtgactcaaataattagtcttccccgcctccctcaaaaccataggatgcatattaagcctgtagtggaaaagttttggaagtgaaatccccatttttctgtttctaaagtgaggattgatgagataaaaagaatgagtgaaagaggactgcactgttcttcccaaccctgggacttttgagagttttcttattaagactcaaagggccctgtggtgcagtatgttatacgtagtcatcatgtaaacaaacttcttagtcatcatgtaaacaaacttaggatgtttgccacctgtctgtttgttttgaaagaactacaacatcaatagtttacattttttagaagaaagcaaggcatctttaggataattgctaaaacagccctcataatttattttcttctttgggaggatggcataacataattgctaaaaccatgactcttgatctatctgtggtctaatctctgctctaccaaataagcttttcttatctgtgaaatgaagctaacagaatctccctcctaaggattttgtgctaatgaaatatgttgacatttacaaccttcttagagcagtatctatgtgtttgttttaaaaggtttttttttaaagtatttagatgggaagctaatcaaaaaatatgactgacccagaattcaggttcactgggttaggtcagtcagcaagccaggcattgaacacgggtttagaaaaagctctagagtaggactggtatgcttactatgcagtgccctggtttcaggctgggagttgataggatttagagagactcttgagttccaggcacaggtgaagaatccccagattctctcagtgtactaaattatatacagatagttaaattacttcctggtgacataaaattcaataggatattatttcttaaaaacactatttttccaaaggtaggtgtgactctcactgtgtccttatggaaactattccttaccaaggtttctttttttgtcaggaaaagtcagatatcaggaggagagtggttcaaaagaattgatgaagtttgaaaaatctttgtcttgctttatctttgtcataaaagtaaccctgtactcttctgatcacataatgtatattgtttccttcataaatgaggacatttcttttatctccttatattattacaaataccccatccaaaagatttataattggagtctttatatattagatgaactaccaagtggtgtgttatgagcatcagattgcaaaaggcagcatctcttgatggatcaagatagtagttataagtggctgttttatcctaccccatctgtgcagtacagcagaaataaggccttttttaaagttataggactgtataggtttgtagtggtctcatatatcttcctccctctatgcttacctctaacatttctagaaagatgacttatttttaaagggcctttgagaattaaatttcataaccctccttctaagtcatttcggtgttgagaactttcacagtcaagacattttgccttttattcaagtgaaatctcattacaaagatatcgttcctctttcttcaggtgctttatagggaaggtgctttgttgcactgagtacaatgggctacattactacaagcaagcctattcaagcaggcttttttccttgccctaattctgtatcagctagtttacaagacatatatctaagtgtgtgtgtgtgtgtgtgtgtgtgttgtgagaggaaaaggaataaaaggtatgggggatgtataagcagtttgttttataatgtttattctttactgctaggctatgatcacatgctgatgtatcattgacattgacctctcttgctttgggagcccatggatccgtaatataatttctagaactacaataatttaaaaaattatcttcaggcttagtgtgtctctaatcccgatgcttggaaagctgaggcagaaagatcacttcaaaggaagcctgcacattacacagagtgcctcacaacatcagacaaaataacaaaagacaaagcttctaccgtatagtgctaatcatccaggcagaatatgcccaccgatgtaataatatcatgaatgtttggagagtaacaaaacacattatgattatatgtgaagaccactccacaagaggtgatatatgcctgattctgtaaacctctgtgaaaaacttatggctgcagatttcaaaggcattaagggagaaattactactaatactttgtgatgtacacatagagtcaaagttctcgctaatcaggtactgttttcagtctaagaggaacctcaggcctgtgtattagtgccgtgctcaaccttgatcagagaagtttctttttgcagaaagcagaagtaagtacagaaactcataatttaccaatacactgagaaaaggtgactattttctctcttaaatagaatatctatgtcatgtcttctaaaatccaagaaacacttcagaaaaggggcagaaggattgtaagagctgaaggacagaaagggagcttggaaatggggttttctggatatgacatgtctatttcaatcataagcacacaacagctatgcctatctgcacaaaatctttgtgtgcaagttcatgagtacatataccccaaagtagaaggggagaaagggactcaagtgggagtggaagttgataaaaataatggggtgaatattgaatatattcatgatacattgtatacatttatgaaactggcatacatgcttaaaatgaaaaaggggaaacaatggacccttatgctggctacttacttttaagaggctgacaaaaacatgttatttaaaaccctttcatccgaggttccataacataatggttagcactgtagactctgaagcctttatgtatatttggaaagcaaacaagcaagcaagcaacaacaaacctgtgtgacatgaactgatagtggcacaagttcaaaccaggaaaaaccccattgtggaacaggaggtgtctatatattccaaaccctagctgagaagtgtttggcaattaatagttgctggggaggcgagaggaagttttcttcaatgacgtagccactagaaagctccccatgctgtagtagttggcaggtttgatcagaacgcattagataactgtacgaaaacatttctccaacattaaaaattacctgtgtgaaggaaaaaaagaaataactgataaaaatgaaggctgacaaaggatatatcaattagtgataatagttatctctatgtaacaattccatgtgtctttctcaatatttgaaatcttctggtccttttgattttcacttttttttttcagaatgtagcccatgaaaacttcagagtagatgttgttggctaagaaggattctcaagctgtatttctttaggagttaaagtgagtgctacatataatcagataattagtggacatgctgacccaccatggttgatgaaatgtgatacttcacagttcatatctgcttagataacttaactccaagattgactattagttaaaaatctctctttttaagctaatactgatcgcatgatcctgagtactcaatattaaatcatcttaagccagcgtatttcttttaggaggtaaagggtatcatctggtaggcattaaggctctaatgtagtccatatttctttctttataactaaaaatattctaacttcatctcagcagatactatgatagctgctcagcagcaacatgttcagatttaactctgccctgaggggtactgtaaagcattgtgaacagaaaactaaactttcataatgaagccattgtggatagtgtgtcaaaatgtcattttaataatccatattttaatcatactgacttcacctgtcagatcctattttagttcctattagccatgcacttctgagaggctcggtaagaggcagtggtgatagaatctacacctgtcctaatttgtttgctttgccaggtattgctgggagagtgggtttaacatacattgtataaagatctccatctgggctcagtctctgaatggaatatgttctttatgtgggtacagataggaacttgtcagcatcttttgggtatggagtcatcattttcaagtgatttgtctgtgtttttattgtatatcactcagaagtagagtttatattgaagtttatacgaaatgctctagtggtgtagacagaaaaggaaaaaggagctggcacttccaatgtccttagaaagaacaagttgaacaatcagaatttatagataatcattgtgtgcttgcttttctctctgatactgctctcatttgaacgtttttctttaactgttacttggctcagggaacaatatttgcagatagaaaactttttaaatgcactttaaaaattatctttaatctttttctacagtctaattgttatcctcctcctggtacgccttccaacagttacttcttcatcccatcccccctgccccatctccaagaggatatgcccacttccaggccttcccactccctggggcctcaagtctctggagggttaggcgcatcttctctgactaaacccagacccagcagtcctctgctgtatatgtgttggggacctcatatcagttggtgtatgctgcctggttggtaatccagtgtctgagagatctcaggggtccagattaattgagattcctatgggattaccctcctcctcagcttcttccagcttttccctaattcatccacaggggtccctgacttctgtccattggttggttgtaagtatctgcacctgactctctcagctgcttattgggccactcagagggcagccatgttaggctcctatctataagtacactatagcatcagtaatattttcagactttggagcctccccttgagatggatcacaatttgggcctgtcactggacctcctttccctcagtctcttctccatttttgtccctgtagtacttttagacagggacaattctgggtcagagtctttttctgtgggatagcaacaccctccctccaattgatgccctgtctttctactggaggtgggctctacaagttccctctccccactgttgggcattttatctaaggtccctccctttgagtcctgagagtctctcacctcccaggtctctggtccattctagaggatccctccacgcatctcctgaggttgcctttttctattcattcttctggccctctgggcttctctcctgtctcccccaccatacctgatcatgttcccctcttcccctccctgtttcctattccctttccctttcccacccaggtctctccctccctgcgtcccctgtgattgctttcttctccctcccaagtgggattgagccatcctcacttgggtccttcagcttgttaaccttcttgagtgctgcagattttatcctggtattttgtaccttttggctaatattacacttatgagtgagtatacacaatgcatatccttttggggctgagttacctcactcagaatgatatttacttgttccatccatttgcctacaaaactcaggatgtcctcattcttaatagctgagtagtattccattgtgtaaatgaaccacattttctgtatccattctttcattgtggctatcacaaatagagaaactatatacatagtggaacacgtgcccctgtagcatggtggggcatcttttgagtatatacccaagaatggtatagctgggtcttcaggtagatctatttccaacgttctgaggaatctccagactgacttccagggtggttgtaccagtttgcaatcccaccagcaatggagaaaattgataaattggacctcatgaaactgaaattgttctgtaaggcaaaggacatatcaatagaacaaataagctacctacagattgggaaaaatatcttcactaaccccatattggatagagggctaatattcaaaatacataaagaactcaagaagctaaccttaaaaaaccaaacaacccactttaaaaaaaaatggggtattgaactaaacagagaattcacaactgagaaatcttgactagccaagaagcacttaaagaaatgttcagagtccttagtcattagggaaatgcaaatcaaaacgaccctgagatgattaagttgcacttgtttaactgtaaatctagatgggcaagtttgctttaaaaaaaaagataagaaaaaaaaaacaaaaatcacatagtgatcacatccttttctttccatatggacacttgtgaaaccagttgctgccgtgttggagtttatggatcacacttgaatcctggatccacataagaatatatgacctgtctcatccagttagcttctaattcattttggtgtttaaaattactgtgagtctctaaatgtttagattcatggcagattgggttttattattcagcaactatctgtatcttaaggttttctttgttctggggaaatcagtggctttacttttaaaaagcagaattgtttcccggtagagcagtgtaactgatgatagctaggatatgttcaatcccaagtggaaccaggttgattttctataaaactggaggaaaaagttcatctgtagataagcttgaaggaaaatggcttgtgttttacctttagaggagcatcttgaagggtatttaatttgatattcttatctataagaaatgcggcaggatgaagcatgtacactcagatgtgtagctgataacactcgtgaaaactggaagttccattttttaacttttaaaaatatgcaagaagggcccaaaataatgcagggaaagaaaaatgataccaaactgaagtcacaggactcaacatataattctggtgaaactcaggaagaaccgtattagtgatagtctagaatatgcacagtgctttacaataggttgattgcactaaacaaaggagaaaatcctttctctgaagagcttacaatctaaagatgcaagttagttacaatgtggaatgagaacaataagagatccccatggtgggtggccttcatagatgaaatacttaaaaataaggtgagggttagagagagttgaagggaaatagaagcttctttgagactggtgaatagggataaggaaatgaagattggacaatgtgtctgaaaagaggctcagcataagaatgggcaaagagatgagactgatgacattacagcgcttggagatttagtgaacaagagaaaaaatgccagcagaggagaattgagacattctataaacattctataataaggctctgaattacagagaataccacagctttaaagacacagattccgagaatgcagcttgcaacagctttcttgccacagtgttggcttcgatagcagaagaaggaagagtgtagcaggcttgaaacaattcagtgagattctatatgtgcttcataagcagtaaagcagtacagatgtacatacagtcatcatattttgcttaactttgattttattaaaattttggttagcataatattttaagtcaaatgattatcagtagaatgttccattacagagatgttatgaggaatttatctgattataaatgtttcatttgtttccatgtttttacaagctcattgcaaattctcctcatgagtgtcacagagcttagcctttctttgaacatacatacatcttcatgtcagtgaaattctcatcgccatcatccctgccctctcacttgcttccagcctcatctatacctttgcatttatatgtcatgcatttcctttgatgtaacaatattgttttatattatgcctaatttcaataaggctttcagtgcatttactgtatatatatataaagcttaagccgggcatggtggcacacacctttaatcccagcactcagaagccagaggcagacagatttctgagttccaggccaggctggtctacaaagtgagttccaggacagccagggctatacagagaaaccctgtcttaaaaaaataaacaaaaaacagaaacaacaagaaaaacaaacaaacaaacaaaaagcttaacacattgacaaagaaatgagcctgttagaaaaatatatgtaagttaaaggggaatcagataaggttagtacaataaatacataaacttaaggattttatagttatgctctgacataggtgccatgcttctcaccagactcaaaaaaaaacaaaaacaaaaacaaaaacggatgagttaataaaagggtttgcaggtgtcaataagctgagaagcacagctttttaaaatttgtgagaaatttctgtctgtctctcctccccaatctctctctcctatgtgtatgtttctctctctttctgtctgtctgtctgtctctctctctctctctctctctctctctctctctctctctctctctctctctctctctgtgtgtgtgtgtgtgtgtgtgtgtgtgtgtgtgtgcataaatataacctacaaagtccatataatgttacttctgtttgttttcagggctgaccatttgctactggacaatcaattggagtctctggggaaaaacacctctcctgctttcagctttcctcagttgcctgctgtgagtgtgtgtgtgtgtgtgtgtgtgtgtgtgtgtgtgtgtgtatagtgttgaggcctcatgagctctttctaccatccactctgacatgccatccacatgacatatgtgtcatctatgttcagcttatattgaggcagtcatgttaatgagtctttatgaatgtggcctctgattttactaggagattcattctcatagcgaactctccagtcctatggctcttatgatcttcctgccttcctcttctataatgtccccggagccataaagttcagagtgttttgtatccattgggactgggctccacaactctgcattttgattgattgtggttttctgtagtggtctccatctgttgcaaagagaagtttccttgataagggctgaggactacacttatctatggctataaagacaaacatttagattgtagttaggaattatgctgatttagtaaagtggtagttttacattctcctccaagttacatgactccataagcactgagtagttggctaagtttccaataccagatgtgatttccctcttgctgagcaggtcttaagcccacatagagagctgttggttactggcaaggtatgtgtgctattattgtaaccttagggttatcctgctatgctgtctgttgatgttgatatagttcataggcatcatagctgggtagaactgcgtcctgactctggaagctttcatggcaatttctggtatcatgaaagctagtcctgaggatgaagactttaggtcaattctagctcaggggtctctgggccctgcttctgaagtgtgtggtgtcttcagcaatagagacttaccttccacctctggcaggcaaccaagggcaactcctagacaacaattcaaaagaggacttttcatgtctgttattagagttttggttaattggtctttggctcttgggggagcattctcagtacagataagaaaagctcattaggtaagtagtcagtagtttgtttccttatggctttttcagaaaccctcatctaccacccatcactaaagaaccctatcctgtcataattccctgatcatatcacttgtaccctagtattcccttctgcattgctccccaaacctgggaaacactcctattttatgttacttgatttctgttgttacttaaggtatagcctcacatgtgaacatttggagctaggatcttttaaagagtcttttggatctggattacttcattacaatgatctctagttgtatctatttacctgcaaagctaattatttcatttttctttgtgctgaatattatttcatagtgcatatgtaccacattttattaattggaggacatttagttgtttctatttcctagaaattgtgaataaagcttcactgaatatgtctgagaaagtatctatagagtaggatgtcagtcctctgggcaaatactgaggagtgctatacttgggtcatattgtacatttatttttatctttctgaaggtttttcacacttattaccagaatggctacaccagtttatcatcccaccaactgtggatgagggttccctttcccccaaatctctccagcatttattgttattattttgttgatcttttcctttctgactagagtaaaattaaatctcaaaattgacttccttttgcattttcttaattgctaggaaccatggacattttttgagatacttcttagccatctttgtcctttatagaactttttgttcaggtctcaggcccatttttcaaatgagtcatttcgagtctttattctttgtttcttgaactctttatagattctagatattgctcctctgtcagatgcatggctggcaaagattctctcccatcctgtgaggtttcctctttacccagttgactgtttatttagctctgcagagcctttaattgtcatgaggccctacgtgtcacttgttggtcttaattcttggggaaatggagtcctatttagaagtcatttcttcacctatattgtttaagtactgcctttattctcttctagtagtttcagtgtttcaggtttcacattgaggtatttgatcaagttagagttagtttttgtgtaaggtgatataggtttagtttcattcgtctatatgtggacatccatttttagcaccatttgttgaaagtccatttttcctccagtgtatgtttttggcatcctcaacaaatattaaatggctggatttacatatattaaaactttggtcttcaattttgttccattggtctctatgtctgatttttgtacctgtaccatattgtttttattactatggctctgtaatatattaagattttatttcttccaatgttgttcttttttccagtcttattattttgtctgttttgggtcttttgtgcttccatataaattttaagagtttttttctatttctgtgaaaaataggatcagattttgattgagagcacattgaatctgtaaatagttttttagtaaaacggtcattttcataatattaattatcaatctgtcagcatgggatatctttccattttctagtgtttttctctatttcttcagaattttaaagttttattgtagagttacttcactttcttgtttaggtttatttctggatactgtgttttctttgagggtttattgtaaaagggaatttattcatgttttccttctctgtatgtttgttgtgattctatagaaaatatgttggtttgtgtaagttgattctatatgcttccataatgctgaatttgtttattatttctaggtattttccagtacactatccagtaggatgtctaatgtataatgtcatctgcacatagagatagtttgatttcttattttcctatttgcatccttttagtttccttctcttgccttaccactctagctattgctacaagtatattaaaatggagtgtggatgttgaacatctcgttctcattcctgagttcagtaagattgctttttttttccatttagtgtaatgttgtctgtgggcttctctatatatagcttttattatgctgaggactgttctctctattccttcattctctagaacttttatcatgaaggcatgctggattttatcaaaggctttttctacatctattgacatgaacatgtgatttttatatttagattgatttatgtggtttacttagtctatggaattgcacatgttgaagcatcctgcttttgagggataaagtaaatttgtcatagtgtatactcttgatacatgtttgtattctatttgtaagcattttttcagtatttttgaatgtaggtttatcagagatgttggcctacagttttctttttgttgtgtctttacctgtaactggatattagagttgttagcattctgtcctagctctaccacacagttacctggcaacaaccaggtatgctcctccccacagttacctggcaacagccaggtaggcctgactcactataaaaggaactgcctgaagtctcctctctcttgcccctctctcttgcctcttgctctcttgctccctctctctccccattctctccccccctccatgtggtcatggctatggctggcctctacttctctactctctccccctctctgcctttctctgtctctactatcctcttaactctcctccccatgttttgaataaactctattctagactataccattgttgtatggctggtcccttgggggcgggggagagatgctttggcatgggtctgctgagacattctcttcccccatacctcaccaccacctcccagagaacatattcttatatctctttatcttcttataaacacatcaagagtgatcctgtctccatgaaaggattttccttccttccttccttccttccttccttccttccttccttccttccttccttccttccttcctctctctctctctctctctctctctctctctctctctctctctcttttccatcctccttctcctgctcctcctcctcttcctcctccttctccttctttgttgttgagacaaggtctcatgatgtagcactggctgttctggaacttgatctgtattaaaggtacacactattttggggtattttcttcttttcttcttttttatgttttgcttttgaatagtttaagaaatggttggagatctactttgaatgtcttatagaattctgctaagaatccatcttatcctgggatttcttttttttttttttttttttttttttttagctgaaagccttttaattactatttcaaactcatcatttgttattagttaatttaggctgttgacttcttcttggtttaattttggtggtttggctgaatttaaaaatccatccatttctattaaggttttctttctatgccattgacctagaattcttctccctcatctacacctataattcttattttttggttttttattcatggcatctcatattttctgtgtgttcctttatttttatttttatatattccttgcttattatttggtctagatcatctactttatctttgagttctgatattctattttctgcttgattagttctacttgtaaggctttcctttagttcttagttgagttattggatttttcaattttattttcatttcagcttgagtcctcttcatttatatcttttgactgaattctgttctcaagtgatgtattgtcttcatcagcctatgtttctgttttttggtcattgttcagtagtttgttctctttgagctctttcttcttaatttcatggagctgtttctttgtgtcttcattaaactctcccaattcttgttagagttcatacttgttctcttaaattctgtgtcctggagtccatctaggtaattctcattatcaaacatttctacacaacttttaaatttcagacagaagatactggcttgatctatcatattcttggtatttttgcaatgatatctgggaatgtggacttttactgttagttctgggtctgatatggacagagtaaattggggaagaagacaatttgtgtaagtggtttgggtctcaaggtgtggaatgaagtcacagcaatactgggacaggactgctctacagaatatgcttcctatgccaagcctagagtgtaagggtagacctgtctaggtgcaaaaggttggctatgtcatggaagaatactgtgggttagagtatagctagggaggatcctagccaaagcctagtgttccttccctgtgcaggcaggagaggtcaggctaagctgatgcatttgttgtgggacccaggctagatttggtgggttgtggaaaaggcatggatgaattggaaggtcaaggggactcactggaccttgatggggatatgggaagtttgcataatgagtgggctggttggaagctgtgcagaagggacttttgggtggttgcagtaagacgggtcctagtataaccctgaagttgtttgagcaacaggcatagaaggtcagactagactggagcatgtgatgtgggaccctacgaaagcctagaggctcactaaagtgcaagaggggtactcctgaaaggcagactgaggctgaaagagactagacggggagagaaataaagacaccaagacaaaagtactctgttcaaggcaccttaaagtttacttagtgtctaagcttatatagggggtaggcccatcccccgccagtccatccaggcacctgtagaaagctacactgcaggtggccccacttcagttgcgacaaggtctgcacaagcccgcttcaggctgggggaggctacaattcctccctaagtatataataaaaatagctggaccaagacataaaatttatttatgctccatagtcctgcctgggagttatggtagctggtggccatgcctggcttgggaaatctcagatttttccgaactattcttatctgtcaaggagtatatatgcagcttgtttgtgtttattttacacaaacatggctctgtggtgtattattaacaaaccacggcctcttggcataacccttagattgatatagttccgaaatctggttgccagtcattggctgaccagccctcatagcacaccttattcccaaatcagaccaaagccacaatatatacttaaaatgcttcttcatattgacgaatttctgccacctgcgcttgctggaggtgaggctgcacacttgctgaaatcaggctgtaaggagagacttacgtgcttgaaaaacaaagtagaaacaattgaaaaacaacaggataatagcttctttggggatgtccaggtactttattcagttgcaaattagcaacgatcaagctcagactctgacctcctagtgtgggggagctggctttgagaattaacagaaagactgtaaattctctggaagtggaggttatattccaaattaactcttctggccaaaaagaatttttagccatcatcgaggttagaatcatacttactagaagattcgggatctgtgaccacttgacaaaccaatctttcaggcagccatcgcgcttcatcttctttttgtgaataaacacagtccgaacatcttccccagattaaaacggggtctggaccattccacgcattagttaatgggtcccgccaattaaccatggcataagaactggaagtaactggatgccagtggtgattcctgcagactgacctttaacatcagtttgcaaaaaaatttaaaacgaacaagacaaaagcaagatgtgcttttggtgaccttgggggggggtataactgcccctcttttgtttttaaaagccaatttttcagagtgcaatgagcacgtttaacaattccttgtcccatggggttataaggaattccagttttatgtttgataccaaattccttacaaaataaagtaaaattgttgccagtataagatggcccattatctgtcttaatgagtttaggcaatcccatagcattgaaggcttgtaaacaatgatcaattacatttctagaggcctctcctgtatgtagagaggcaaaaagaaatcctgaacaagtgtcaatacaaacatgtatatattttaattttccaaattctgcataatgagttacatccatttgccaaatatgattaggcataagaccttgtggattaactcctaaatgcagcactggagataatgtaatacatttaggacattgttttacagtcattcttgcctgttctttagtgatcttgtgttggagctttaaggtatggctggagagatgaaatttatcatgatcacgactagccaaaacaacaggatctggaattaaggcctctcctattagagctctgttgatgcaatcattgcctgcagctaaaggtccaggaagaccagagtgagctcatatatgaccaatataatatggatgttttcaggcaagaatgatgttttgcaattgtgaaaacagagatcctactggcatattaaagttaaacatgccacaagtctccaataagggaatcgattgtgcaccatataaactatcagtaaaaatattaaaagtatcatgtacagactgaaaaacattcagtactgctgtcagttctgctaactgagctgagaggctcaggagtctctatgactacttgttgattattcataagatatccagctcatcctttagaggagccatcagtaaaaatcaaaggagcatcatacaaaggctgtaaagaagtcatattaggaaatatcacctcatgtacatttaaaaattttatcaacctatcttgaggatagtgattatctataattcctataaatcctatttgagcaagcaaccaatccgtactgtgctgattcagccaactatcttgatccatactataagactgaacaatgatatctggctctttgccaaaataagttagtgcctacttccatccaagtatgatcatctgagctactgcttcataatatcctcaaatgtatccatgttagaggagccctttgccacaacaatcctgtaggcatatgaatcatattaaaaattaacagatgtaaaggcaaagagtaatctatataagtgacaaattgttcttcaatagctctttctacttgttgtaaggccagcaatccttctgaggttaaagatctaggggaggtaggatcagaactccctttaagaatatcaaataaaggtttcaattcccctgtagtaagctttaaataggggtgaagccaattaatatcacctaacaatttttgaaaatcatttaaagtttttaagttgtccctgcgaataactatcttctgggggaaaacagcttgatttgtaagtctaaaccccaaataattataaggatcctgagtttgtatcttctcaggagctatttatagtcctttatcagctaaggccttttgtaaatctgtataacacaaaagcaaatcctgggggtcttttcctgccatcaaaacatcatctgtataatgaattatttaaatcataggccattgttgtctcacaggctgaatggcttgtgccacaaacttttgacataaggtaggactattagcaatgccctgtgggagaactgtccattgatatctcttcataggttctttaaaatttatagaaggaatactaaaagcaaatctttcacaatcctcaggatgcaaaggaatagtaaagaaacagtgcttcagatctaccacaattttataatatccttttaggaattgctatcagagacggaagcccaggttgtaaagctcccattggtaccatggtttctttaacctttcttagatcttgtaacaatctccatttaccagattttttcttgataaaaaaaaattggagtattccaaggagactgagattctgctaaatgtcttgcctctagttgctcctgcactagcgaagtggcgacttctattttcgctttaggtaaagaccgctggtaaatcaacccacaccagaatatcattaagccattgaattttatcagcatgggatgcaggcaagatagtagccattactgaaaataccccaaacctcttgtgttagagtgggttttaggaccttcaaaagtcttaataccttgtactttctttcctagctcatgaccaggcaaaaatccttgtctgagcatctgcttgggtgtttttacaaagcttctccaactctctcccaggttctgctagctaaagttttttcttccctgaaccatgggcaacaagaatctatcttatctgaaatttttttctaacaattgttcttcaaaccctactcctctcgcctgtagcagctcttgaaggctgtggacaactgcctctttggaagtgtctagtcccatatttcgatgccaaccctaagtggaatcagcgccgggttagcactgttccaacttagcccgtatccaatcgcacctccagcaacactttaaaatatgaagtttaaagccagcgctagcataaatacctgttgctcactgtgcccgatatgatattcttgttcttcccttcttgtggagctccacataagacagcagtccctcagctgtaccccgccattttcaggtccgtgttcatggcaccaatctgtagtagtaagctgcccagggcctacatgaactgggtactcctgaaaggcaggctggggctgaaagagactaaatggggagagaaataaagacgccaagacaaaagtactctgttcaaggcaccttaaagtttacttagtgtctaagcttatatagggggtaagcccatgcccaccccaccccaaggtctgcatcagcccgcttcaggctgggggaggctacagggattgtcagactagccctatgcactggttgagagaccagtgctagatctggtgggttgtgggaaaggcataaatggggatttctgagaaactcactaggctagaatatggaagagaaagaacatgggacatttgggtgctaagggggtggctcaagactgtacagaaggggcctgtgagtgattgcaggtagggtgagtagtagcagaaatgcaggtgcggcttcacactaggcagaggcagtgcttttgaaacctgtgctagatatggaaggagcaaaagacatggatcagaaagtcagatggactcactcacctggcttgactttggaaaaagatatgtgaagtcgtgtacagagtgggatagattgaagtggtgcagaacagactggtgggtggttctgctctgagctcttatcattacattttggagcaaatacaacaaagaaaatgggtgtagctcattttttataaggtgctttcacacaactcactcattttgtctttgtgtaactcctacatgaaaagtagtagtaagcacattttacaatttaataaacctggggcttagatgaactaatctatgtaatatgatataactgataagttctttgctttcttccatatgaaaccatatggtaaagcagtgctttaccatagagctctttgtgtaatattactggaagactaaattgggacaagttaacagtattgttatcgttatggtttttttgtttctactttgctttatacaattgttgaactgggatcttttgatatgaatgacactgcttgctcgggcactaaatatcccccagacttatattcttataaattgtcctatcttctttttttatcctttttaaatcactttctctgctctgagctgttactatttgatgtatcttgcagctcccctacttctaatcagtaggtaagtacataggactttcatctgataatacaaaacctaattctctaatgttttcattatttgaatatacatttttgcctgttttctatgttgttagctaattctggatagttgaaggtgctaggtaaattacctccagaagtgagatattcttatatttctttaccacctgtgggcagctccattttgagttcttattgttacattttggaggaaatacaacaaagaaatagagagtaggacatattttttgaagtgcttttatacactgtattattttgtccttgtgaaatttctgcatgggaaatagcactatctacattttacaattttttaaaaaaaatctgagacattgtgattaactgatctatataaacatatctaattaataagtgaagtactcaatacttttgtttatatttattttttgaggcaaagtcttgctatattgttcagacttaacccaaactcacaaactcctggcctctacctcctaagtattgaaattacaggcaaccacacctggcttgactcttactttaaataaaacattactgtggccaagtatatgattcagttggtacacagaaacctaaggatctaagttgagatccccataactcctgtaaaaggcaggagtagtagtgtatgcttgcagtcccagtgcttgggactcatagacaggaagatccctagggctggctgatcagccacttatgctgaatttgtgagcttaaggttcagtaagagactctgtcttaaaaataaattgaggagtgattgaagaacacaccaaccattgacttctggcctgcattcaatctgtgtctgtctgtctgtctctcatattcctgttaccatactctgcaaacaggattctgtgaaattttagaaagctatttattgaaggtttgaagtgactgcccaatgtaccttattccatagtagtacttaatttctttttttttccagtcttttttgcttaccttttgtctccctataagtcttccaaaaatagtcactgaagcttcccatataaccctctctgcctaggtttactcgttaacctcccttccatttttggataagttttgacataaagatgtattggccatctacagggacattgctcttataggtagcactgcacttcatgtaaaatttgtgtctccagctggctgaatagtcttatagtactcagtactgtgtatacataaaattcagatgtgagagttgtaaacatgggcagatacgttgtgtctaaatagaaatggtattttttttaatttttattaattgtgattctcacatcctgcatcccaatcctactaatcaccctgttccttcatatccaccttccgcccttgcaacctcccacctgaagaaaaaacattttgcagcagaagctgtagtgcgtcacacatattgtgtcacacagtatatttgtccactcttctttgcttgcaaatgttcattgcaatgagtcatttgtctggtttaaggtctcttgtttctgctgcattattaatacaggatccccaccagggcttctctcagatatcctgttgttgctttgtgtcagaaagatcaggtagctttcattctgcaaactagcccccgcatgtgctctagcagatcatagatggggtatgtgttgaggtgggccaactcaaggccctggatctgggcttgggtggtagctgagttggtcagcccaccagctctcctgcactggaaccaccatggtcagctctcccatcttatgctattggggtagctctactgtgctgaccaggtagggtgctgggcctgctctctctaaatttactttttaagttatgtgtaaggtgatggacaatttgtggctaatcagtatatgcgttaattcaatggaacttgatgaaaatgagagaaaaggatgcagatttcatcctctgtgaagtatgaaattaacaaaagttgatatcactagctaaaacatttggttttaaaaatgtctcaggaaagattgtattcttcataccaatgagaaggcaaagttcttatttttgtctatataatttaaggtaaaataattacttttactgttacaaattacatatgtgtcacctaatgcaaacaaaaatgggaatgactttggaatttctgtggtctatgaaaaacatggagctgtaatgttactaacttctgcctttgaattgggctttgggaaaatatttttggtttgatgctttttggaactcacaatggaatttaagattcatgagatgattggtaagatacatgtccaaatgcccttgcataaatccatttctggcatgaaaatattttctggaaatagataggacgtccaagccttccagtgatcctggaggtcagtttcctggagtctccttgtattacttacttgtcagtttgctgtgataaaacatcatgcccaaaggcagctcagaaaagagggagtttattttggtttatggttccagaggggtaagtacccatcatgtttgaaaaaactgagagattgcatcttcagccacaagtgggaaatagagcaaacttgaagtgaagctatgaacactcaaagcccttccccaggacatacttcctccagcaagcctgcatcctccttcaaacagtgctaccaaccagggaccaagttttcaaatattagtgcatatggggacacagtttcattcaaaccaccacaccttttttctttagtagttgttatgttttacatgtgaacatgtcagtaaataaattttgggctgacttttcagagagaaatctgttttttttcttttatatctaagtgtccattataggaacatacagttagtaggcattccaatgatcctgatgagatgcttattggtaagtgaaaaggtgttctctgaagggtgaaagtggtctgctctctaaagataatcaaggttaccacttcaaaaatatttcaaagaaactgaagtatcagggcaaaatggtaaattatgaattatgtctctagaatactgcatctgctcctttatgtgacctcaactctagcaatataataaaggtaaatgactaaacatttataaacagcctcacttattgaataaagacaatcagtagcttgatgtgttatgtttggaggtagtgctacagatactttacatggtataatgcttgtgaggtcagcccctgatatttgaaagacatgcaaatttaaccagagcagcacagtttggagttttctttgatgtatccactagctttagtttcctgtagacgatgatgagtgggtatcaagtgtaagctataatataaacaaatgagatgtatacttttgggttttcaattacttttcatctaactgcattgaactttcatttagtgaaccaaattgaccgactggcaactgttgtgagactctgctataataaatcttgattaagcatcagcagatgtaataggtataagagttgagctagacagaaagggtcagatgggtggacatttttgatctgtagagcggataatgagatgatatcaaaatgaaacttccatacctcttcacccttcctctgccattactttattctgagaactgaacttatagatcagtgatccttatttaacttttcttataccataactgctcccatttatgctttgtattaataatgtagcagaaacaagagaccttaaaccagacaaatgactcattgcaatgaacatttgcaagcaaagaagagtggacaaatatactgtgtgacacaacataagcttttaaaaagttatgtctttttggaagttgcttattaatgaatgacataattaaagaaaaacatcaagaatgactttgcttatctttgttttacttgttttttctatgtattctcttatttaacacatcccaaccacagctttccctccattccctctttttagtccttctccaaccttttcttttcccccagatccactgcttctccatttctcttcagaaaagagcaggcctcctagggatatcaacagaacatggcataacaagatgtagtaatactaggcataaaaactgaagaaaatcaacctagtgggagtaaaagagtgagtcccaagagcagggaaaacagtcagagacaaccccagtcccactgttgggagtctcacaagaacaccaagctacacaaccataacatatatgcagaggacctttgcaaagacctatgcaggctctattattgttgctttagaagtctccatgagccctgcttgtttgattctgtgggccatgttttcctggtgtccttgaccctctggcttttctacaatccttcctcccactattgtgagaggttccctgagctctgcatagtgcttggctgtgggtctctgtgctggctccattcagctactggaggaatcctctctggtgattgttggcctgggtactggtctatgaacatagtaaaatatccttaggaattatttcattaattctttttgtcagttgtgtttggttctaccttaggtgtctgagcatggtataggtgtctgagtatggtagtttgaatagatatagccctatagactcatatgtttgaatgattggccatagggagtgacactattaggagatgtggccttgttggattaggtgtggctttattggaggaagtgtgtcactgtgggagcagagtttgaagtctcctatgcttaagctacatccagtatggcatgtagtctcctactgctgcttacaattcaagatgtagaactctccgatcctccagcaccatgtctgtctgttcactgccatacttcttaccatgacaataatggcctaaattctgaaattgtaagccagccccaattagatgttttcctttataagagttgccttggtcatggtgcctcttcatagcaataaaaccctaactaagacactgagctatccagcttccaatttacttgttttgaaaaatactgcctaattttcatcttacctttctttactgacactgtaagaataaatgccttataaaataatcttatacatacttgttataatagaattctcataaatgactgaaacaattttgcttatctgagaaatagtattctttgggtcacatctcaatcattctgacaccctgtcgtctagggtggcatcccgggatatttataatcttctcagtggttaccatgaaattatcaaactaaaattaatttgaagtcactttatgtaaaatgatttagataagatctccaaattaaattgttatacacagagaaccatttaatagttagaaattggtgctttggaacaatggttcttaaactatttcatttctacatgaaataatttattacactccactctatgaacaacagtcatttagaactaaatattgtaaatcatagtctgtcaagattctgggtacttatgttggtgttagaacttttatatgaacaggaaaaaaagacttaagctatcaaacttgctgtttctggccttgatacctcatttgggttatcatgaagaataaagaccctagtagatgatgaacaaattctaatgccatggtcttgaacttccatgctcctagatccatgatgtaaacaaacttgtattctttataaattaccatgtttcatgtattttgttataacagaagaaagcagactaaaacaaacagtacatagttgggggttatcactttctactattatgcttttgtttctagtctaggatgctgctcaggtctatagcatttgtgttagttagggtttctgtcaaaacaccatgaccaaaagcaacttggacaaggaagagtttatttcattttacaactctcatggcacattctcatcactgatggaaatcggggcagaagcctggagggacaagctgatacaggggctgtgaaggagagctgctgcctagcttgctcctcatggctttctctgagtgctttcttatagaacctaggaccaccagcccagggcatccatagtgagctgggcaatcccacattaatcatcaatgaaaaagagcaccccaacttgtacccagtctaattgaggcattttttttttcttggttgaatttgactggtgtggagttgacaaaatgaaaacaaacaagaaaaccctaccagaacagcatcatatccattcttaactatccttcctgtttgttgagtttttccagtgtcttcactttattttttctttatttttaaaattattttaaaatatcttaacataaccttttacttttaaaactctgcagtaaatttcaaaaagtcgaaaggtcggtttctcccagtggttacattttgtatagctacagtataatatcaaagcaggaaactgatactggtacactaattatatatattgtggtagtttgaatgtaattggttccataggcccatcgggaatgacactaataggtgtggccttgttgaggtaggtgtggccttgttgaggtaggtgtggccttgttgaggtaggtgtggccttgctggaggaagtctgtcactgtaggggtgggctttggggtcttatatgctcaagctgcacctggtgtggcagatatcttctttcctattgcctgtatatgaagatatagaactcacagctccttctctaggatcatgcctgcttgcatgctgccgtgcttcccaccatgctaataataaactaaatctctgaaactgtaaggcagcaccaatgaaatgttctccgttataggactcgccatgctggtcatgcttctcttcccaggaatgaaaccctaactaatacatataccttctgccattttatcacatgatatttttatagtcaatcaagacatagaaacatatcaaccacaaaaagctccctcttactacctacattttagggtcaagcccatgccttcccattctttaatattcattaaaaccaatcaacaactaaatcttttttaacactaaaacatggtcactcctagataactattataaatactgcgtgtgtatatatatatattacaaagttcgtttagtgttgtttgtatgtacttgtgtttagggctgatcacttaggattgtttaactataaccatatgttcatgtggtggcatacattgttaattactgtattctgaaggtataggcaggtgaatttctgtgtgttcaagattggcctgaactatatagagaggccctgtcttaggaaaacaaaaccaaaaactaaaactaaaaaaaccttgaataatcataaccattcatgagcttaagggcattttgtctgtttccagtttggctataatgatatgaactattatataaagttcccttacataagcataaatttctctggaattattattcaagagtataagcaattgtggttacattgttttgttttatatgagacttccaaattgtttttcagattatctgtgccattttatagtcccaccaacaatgtgggatcccatcttgccagcatttgatattatcagtaatctttatttcacttacctttactgtctacatgcacacatgcatgtgtaaatacatgtgcctgcacatatatgtctatcacacgtggggaaatcaaaagacaacttttgggagctattttttccttctaccatgcgttcctggaactcaaatcatcaggattatgtcacaagtgctctgagccatcttgctagctattttagtctctcagacctgtaatgatatcccattattgatataagttgcatttatttaacagctaatgaggtggaacatcttttcatatgcgtatttctcttcaatgtatgacgaaatatgttttcatgttgctttcagtccctctctctctctctctctctctctctctctctttccttcttcctttctttttctttctttctttctttctttctttctttctttctttctttctttctctctctctgtctttcttcctctttcactttttctttcttttggtatctatacatgctatatatgtgtataaatgttcttatgtgtgcatatgtgtgtacaattttgtgcgtgtgtgtgcatacatcttgagatcagaagtcaatgtcaaatgttttccttactctccatattgttattaagcaactgatgaaaactgatgcagaggcccacagccaaacactaagtagagtttggggagtcctgtggaagagggggaggaaggattgaaggaaccagagtgttcaaggaaatcacaagaaaacctacagaatcaacagacctgggctaacaagggttcataaagactgaactgccaaccagggagagtatgcatgggacagacctaggccctctgcacatatgtaaaagttgggcagatggatcttcatgtgggactcttgaagtgggagcattggccttctctgactctgttgccttggcaacaatagatgtgtctagttcttctgcatcttgctatgccaaggcaagttgatatctatgggaggcatccccttctctgaggagaagggtaggagggatggatcaggggaaatgagaggagggactgagagggaaggagggaagggaaactgcaactgagatgtaaaataaataaataaaaaatgaatatgggtaaaacaaaagcaaaaccaaaggttccatacatttatagaatgtgtattcatcatatccaccaaccgccacctcccttcagctccctctagtgacaacacactatcttgctcccagcttcatgtcctctttttatttgtttttttaaataattactgctcccttagtccatttggttccacttatatgcacacggagtgtgtgtgtgtgtgtgtgtgtgtgtgtgtgtgtgtgtgtgtatgacattctaccggggcatgaacaactttcaagtagccaaatacccaaagaaaacagactctacatcagcagctatcaacagtcaatgactactctaaaagttatggtgccatagagcccatcctctgtccatgctggaattttttttttttttttttttttttttttggtttttcgagacagggtttctctttatagctctggctgtcctggagctcactttgtagaccaggctggcctcgaactcagaaatccgcctgcctctgcctcccaagtgctgggattaaaggcgcatgctggaattttggcaggccagctcttatgcaggtattgtgcaggaaaccacaattgcttggcacctgcagctctcatatcacgaccagaagtcattatttcacagctctcttctccactcactcactaactcttaagttctttgtgcctcttattctctaagccttgcttggtaggagattgattccctgtccctgcctccccagcattgggataacaggtacacagcactgtacttgtttttttgtctttttacatcaatcctggggagctaaacacaggtatccatgattgtataggcatcactttatcaactgaaccatccaccccacttctttcccttatattttttatttttttattctctctctttcttttctttccattttttcacgttctttctcctcgtccttcctcttcctactctcactaaggttggaacttttataggcatgattactattgacaggctgtcccattgtttatttttttaattatttcttggttgttttatttacttttttgataatcttacatgtttataatacattctagtcaaatgcatccatctgccctgttttatctttatcccacccctacaacttccttgccttcttgtaaccaagtccctatttgaattttttgtctctttgctttgtttttgattttgctttgctcctcactttgttcaatcaagcccaccttagtgggaatggctatgaagctatctcctggagtataaataacttaccaattgactacataactgaagacaatgactttcttcactagtcatcctatactgcagtcatctcccgtagtagggcgatgtagtagggtgaacaaagaccctgtgagccctttgttcatctatgactgaatatttactgaatcagctttgtgcaggccccgtgtaggcaagtgtagctgttagtcatgttgtacccccaaaccactcttcatcaacctaccttatcatcactcagctcttaaattctatatacccaatcttctgtgatttttctcagaactttgcacatagtactgaacgtgaactctgctctgctgaataagccttggatctatacagaatagtcatgccactattgcaccattaagtaactatcatctgcaaaattagtaggacaacatgtaactggggatgactgttactgaccttttagtttttcctccagttgtctgcatgggaacttctaaatacaataaagatgccttagttacttgcttgttgctgtgataaaacaccatgaccaagggtttgtatcggtgtacagttctagagggaaaatagtcagtcaccatcatgggcaagaagcatggcagcaggaacagctgaaaactcatatctctaacctcatgcaaaaaacacaggaagagaaagtggactcaaaatggtgcaaatcttttacctctcaaaacccacccctagtgtcatactttctccagcaaggtcacaaacagacccacgaactggggaccaagtattaaaatgcctgggaatatggagtcatctgctatccaattcaaaccacaatagaggactaaccaacaggaaggaagcctctagctcggttctattacaatttctctgtatttgcatacaaagtatcttcaaaaatagtctcttaccttccaatttttctgggtaaccaatgacaacttgtatagtttttgaggactctgggacctttctgttcaacagctcctaaggaggtgccccacacttggattttctttgaacaacttatgacttctgagatcatcattagccatccaatatatatccatatatatatatatgtagatatatatatgtagatatatatatatggatatatatgtgtgtgtgtgtatatatatatgcatgctttataagctaattataatatatataattatatattataattaacttagaaagtagtcagcttccatgtggtttcattatgaatacttatctttggttagtcttttccatgaactccatcttctcccccttctttcatgcctatccttgtttaaacttgccactggcagtatttctttccaatgtctccatatcatgtgtatactacctttcttacctttcttcaaatctctttcctacttcaccatgacccctttcttgcttccacatctctacaggcataccatgataaccaaatctaaaaaatgcaatgctgtgttccgcatatgagaaaggggacatggcatttgactttctgagcctgagttacctcattcaatataattgttctagttccattcatttttatacaaattctgcttttctttccagctgaataaaaatacattgtatacatgtgccacactttactatttattgacctgttgatagatatgtttgatgattccatttcctacatattatgaatagggcagcaatgaataaagatgtccttgtttttaatagctgagtagcattccattgtgttaatgaatcacattttctgtatctatttttcagttgacgggcatctggatcttatccagcttctggatattacaattaaagttgctatgaacacagtggagcatgtgtctttctgatatgatagaccatctttgggtatatacccaggagtggtatagctgggtctaaaaggagaacttttccaaattttctgagaaacaccaaattgatttcagagtggttgtgcaagtttttatttccacaagcaaagaagtgtcctcctttctccacatcctcaccagcatgtactgtcccttgaacttttgatcgtagtcattctgatgagaattaggtgggatctagagttgttttgatttgcatttacccgatgactaagagaaagtaatcccacattgactcaaagcatattatgttgtaaattatttgtagcatatttcaccaaatttattgcattatctagaaaatatgtctaatttgtctaatttacttgggaaattcatttttaacatgtgatattaaagctacaaaagtttaatataatcactttaaagggtaccaaaatttggaagaagtagtaatagatgatagctatattctatagctatatcaaaatctattctatatagtatagagattatgatttgctcagataactataaaagacaacaaagttaataactacttgctaatcatagatcattaattttgaaacttaatagaagactctggacttaatgggttatattgaggaatatactggttacttttaggaacacatatgtatatattaatacatgtatacatgtaataataataataaaaagagatcatatatttgagggagaatgaggaggtatataaatgagattgtagctaaattgcaatctcaaaaataaaaactaaatgaatagaagactcatagttaactttatttccaagttgaatcaatatatttttaatagaaatgtaagaaaaattctaataggcatagtatataaataggaatggaaatatattaaagtctttaattgttattttacaaaattgttataatatgacaaaaacataaatttgatgacagcaaagcttaatattgtacttgtgtctcaaaattttagatgagcagaaatgtgaatacaatttcaatacacatattcatgcataaaattctaaaagaattaataaaaataattattttaaaaactatatattcgtgaaaagaagtctgaccttgttagttagcagtgtgccttaaaaaatccatactagttaacctgataaaacaaattaatgacttaggtggccattacaaatttagtatataaaaaaattcaagtgtgtgtgtgtgtgtgtgtgtgtgtgtacatgatgtacctatgtacgtgtagttacatatcacagtgtgtatgtggagatcagagcacagctttgtggagctatctttttccacctttatataggttctggggattaaattctggattccagacttgtgcagcaagtagatttactcatcaagcaatcttgttgaccctgttacacagcatttaaattaatttaaaatattttaaatcgttggaaattttgtaagttgattggtgttcccatcaccccactgggggttctgtctggctactgaaagcaatctcttcaggttccatatccccactgttgggcatttcagctaaggtcacctgcattgagtcctcggagcctccccatctcaggtctctggaatttcttagagattccctatacccctcccccagcagctgcctatttccactcattttcctgagcctttcagcttctcttctgtttctccctatacctgattctgcccaaccccattcctctctcctcatgtctcccaccctgatccctccctccctctggttcccatgactattttggttgcccttcttttttttttttttaattaccaactctttttttatttttaaggcattttctattagacattttaagtgggatttatgcatcctcacttggaccttccttcttgtttaactactttgattcttttggggtatatcatgcatatcctgtactttatggctaatatccacttatcagtgagtacataccatgaatgcccttttgggtctgagttaatcactcagaatgatattgctcctgtctaaaagaaatgccgggataaaaatggaccagagactgaaggaatggccaaccagtggtgggccaaacttgggatccatcccatgcatgccatgtatgcacaacaaaccccaacactattgcagatgccaagatgtgcttgcatacaggagcctgctatggctgtcctctgagaggttctgccagctcatactcacagtcaagcattggactgagcctggggaccccaagggaaaagttaggggaaggattgaaggagctgaaggggatttcaaccccataggatgaccaacagtgtcaactaagctggacccctcacagcttccagagactaagccaaaaaccaaggagcatacatgggctggtctgtggccctgaacacatttgtagcagaggactgccttttttggcctcaatgggaaaggatgcaccttatcctgtagagacttgaggccccagagaagagggatgcttagcttagcatttggcagggttgaaaattaccatcagtgggattaatgcatctcacttatttgtttaataagccaatataagattaaaagaagaatgtctttataaatatggacacagtgatctctgactatcatttttactataatcttttaagtggtcttgtcacctttttatgtttcatgtgtatgaccagagccataggccaagacagataatgttaccttatttttgatgttgagtgaattttatgagaattgccaggtacatttggtgttggtgcatgattgtagtcatagcattcaggagactggggcaggggaattttcataagttcagtgtgaccacatgtaacatagcgagactgtttcaagggaaatataaaagtgatatttatggggaaagtattttgtgagattgctttacaaattattaaaattatagttaggaatgacttataaagtatacatttaagttaaaagcaatttaattgaataatattgaaggacttctgaaaagcttttagtcaaatgtacgtgggtactgttagagatgcagtatctgaccacaagctataccttatttatatgtagatcctctttgtatgctttattaccctgataataaaaggcactactctattttgtaacacagtaaatttcctttttcctcaaagttatggagggaccatatttagctgagtttatgaggtttctctattaattcaaaccttttagataatattgacaatgtaagccccccaggctacttttgcttgattgatgaaatattacacgaaacttgaatttactatgatgagactttagaaatactgataagaacaagctctctctgtatagttgtctacattaaacgcttgaatcaacagaaagttagctgtggctacaattaaatgaaatatgtctttgatatttgtttctaatactattgattaagaaaagaaatgactggggcaaaagataatccccaaattcacaaacagtgataaatactgttctcactcttatataactgaaggtttgagagccaaaataccaggaggtattgttcagtattttatcggtcatctgttttgacacttccagcttttatgtgccccttcattttcctctttagagacacttagtgaataaaccttctaaaacttgtagtgagtttactggttggtttttgtcaacttacacaagtcagagtcatctggaaagatagatctcaattgagaacatgccttcttcagattctctgtaaacaaatctatagggcattttcttgattagtgattgacatgggagggcctatcctctgggcagatggtacttagttgtgtaagaaagcaaatttactaagtcatggagagcaagacagtaaacagggtccctccatggtctctgtttctgttcctgccatcaggctctttccttgagttcctatcctgacttcctttgatgactgtacggttgtggtttttgtttgtttgtttgtttgtttttaatcacaactaagatagaaggaaataatgactatatactatggttttcaccaattgcaaggttcattgaatttttatactctgttaagtaaaatactcaccagttcatgcatcccataaattttttggttgtcttttggattacagttaaaataaccttctattgagtctgtatcttgctacatcaattttgttgttttgtcttagaaattgtaaggacaaaccaatgaatgatcctgagccttcagaatgctagaataaaaatgtttactgcaattttaaagcctaaatctctacttcagtgttcggaacattttttttttctttttacaaagggccagagaagaaataaccttcaactgtactgatagtaagcttccatagacaatacagaatagagtgtgtctatgtagtattaaaactgttacccccagagacccctgggactaaaccaccaatcaaagaaaacacatggtggcactcatgactcaagctgcatatgtagcagagaatggcctagtcggtcatcagtgggaggagaggcccttggtcctgtgaaggttctatgccctagtataggggaatgccagtgccaggaagcaggagtgggtaggttatggagcaaggggagcgggggaggataggggattttcagaggggaaactaggaaaggggataacatttgagatgtaaatacagaaaatatctaataaaaaagaaaaagaaaaaatgtgctttctaaaacaggctgcaatatatttcaaaaataagtacagatgtccaacaaacatatgtaaagaagttcagtattactactcatttggaaaatgaaaatgaaagtcacttcacttttaactaaggatgcatacaattaaaaaaactgaaagtagtttttagaaggattcatagaaattggaataaaatatattggcatctttggaatctaaaacttcaagtgtggcagtttgattaagcaaataatcccatgatataaaattttcattcataggtactgccttagttaattttctattgctgtgaagagacactatgaccaaggtaacttacgtgaaggcatttaattgtgggcttgcttacagtttcagagggctagttcaagatcatcacagtggagatcatggcaatggccatttgggcatcttgttggagcagtaacagagcttacattttatctgcaatttagaggcagagaaaacaactgggcttaggcttttaaaaccacaaatccaacttcctatgacatatctcctttagcaatgccacagatcctaatccttcccaaaatagttccaccatcttggaaccaagcattcaaatggtatgatcattagagtatcatttttcattcacaccattgcaggtacatgcccttaaaagctgaaatggctattctttacatacttttataaaaatgttcatagcagtattattcacaatagtcaaagctggaaacgatctaaaagttcactgctgaatgaatagataatcaaattatagcatacccacacaagagcattgtgtggcaaccaaaagaaatgaagaactagtacatattatgacatgggtaaaccttagtactatgccagatgacagaagtcagatgcaaaaggtatgattccatttgtattaaagacccacaataggtaaatccatggagacagcagattcataatttctagggactggtataggatgaggactaagaataaggaatggatgattaataaacacttctttgagaagcgatgaaaatgaattggaattaaatatagatgatgagacggcagaactcctgtcctgttctcttgctttgctctcctcttcagacaatatgagcttcaccaccctctccactaccttctccaccaactaccagtccctgggctctgtgcggactctcagccagtaagtccagcctaccagcagcccagccagtgtctatacaggtgctgggggctccggatctgggatatccctgtcttgctccatctgggatggctctcttggatcttcaggcctcgtgggaatgggctgagagtctcaacggtgctccggactccaacaactccatgcaaactatgaagaggacaactatcagtaaggtcgtggatggtaaaatgatgtccaagaccaattacaccagagttctgaggcactgaggctgagaaggagagagcccctggagactgagggaccaataaaagttgagagctcactggaaaaaggtatagatgatgggtatgcactactgaattactgaagtggacagtttaaagtagttaattccatgttttatgaacttcacctctatacaaaaaatggacagttatgatgattgaccagagtttactgacctctgctctatttggtaagtgagtatcctctatctccttcatttctgaggtttctctgtctctcatatcatgagagctgctagagaatatgcctaaatttgcaggaaaaggtatatggctttaatgcaacccagctaccatgagctggtaaaacatagaacgattctctcagggttttgtcagtacatcatcatcattgttatcatcaacaacaagaacaacaacatcaccatcgataacaataacaacaacaacaacaacatgactatttttgaagcagagtatcactatgtagtccttgttagcctagaaccatgaattcttagagttccatctgtctgccttcaaagtactgggaaagggtcttaaccccataccaaattaaaaaaaatgtttatagaagcagccttgctaagatataatccatacacgcatgcacgcgtacacacacacacacacacacacacacacacacacacacacactagaatctacctatttaagttacatgatttagttacatgatttattttttaaagtcatattctatgaaaggtctaactacttctatatttaactttagaccattttggttgttactatattttagccagtataacaatacacctggggtgttggaaaatgattcagtggtagtacctagatttggatccccagaacctaagttaaagagccaggtgctatggtacatgtttatagtcctagcactggggaggcaaaggtgggaaggttcttgcggttcaccttgcattctatcagtcaagctgaagaaacaacaccagaccaatgagaaacattttcttgtaaaacaagataaatatttcctgagaaacaacactcatttttatcaaactttgccctccacatgcctgcctactcaaatgtgttcacacagacatatgtatacacagaaataatacatctatgaacactcatgtacagatgtttgtgtggacatatgtaatcatttatctctacacctaggggtagaattgctggattatatgacaagtctatgtttaacctaatattatccagtcagcagaaatttgtgaaatttctcatttttttctcaaccttaccagcacacattatttatctgtctgttaataaagatatatttgaaataccacaatattccttcttttacaggttgtctgccactgcttttgcaatacaatcattttggtggttataacaaagatattatattccactataaattacaaagcacccagtagttacttgtagaacttttattgttctactaacttgacttgtgaattaaaagtttgccagctgctgctatacagggattctcattaagttgaagttaattgtgttttttaatgtcttagtgaagtctgataatgaggattcttttttctacattgtttttctttgaatgacactcctaagtggcctgtagtcactttgtgtgtgtgtgtgtggggggggggggaaggcgtatcctagatataaagttttatctatttggtagaaagcctatgatttaaaaagaaaagacaatttgttctcatagtttatcatccaaagcattgacaaagagtacaaatatcaaaagggtaccaataaatgtgctattccagaacttgagttatatagcttggaatatcatagtggagagggtaagattgaattagtaagttaaaaatgaaatgggaagggagtttggcaggtaaagatctgggtataaggcgggtgctaagtcttggaagaagctatagtgctaactttgttcccagaagggcctatagccaagttctatcctgctgtattttccaccaagggagccaaatacaaactggaatggtcagagatatggaaagctgctatcagaacctttcctctttgttgataagaaaaaaggattatatatgaaaatgccactgggatcgagatggtgtaagtgaagaaatagaaaagtgaatcaggcaaaatttgtcatgttcgatctctgaagagctttgattgctattaattgtgttcaggaaacataacattaaatgttccagaagacatacagcagctactaaggaaacttgaacttaatggaagaagaggggttacagagccttgcctagaagttatttttgttttgcgtggtcacacaaatgagtagcctagcaactgaaagcaactgcaaggtacattagtgacgctttgtgtgattatacagtactgcttgttttaagcaggatgtacttcattatggaaggtttttatttctgagacatttgttaattgaaatgtcccagggagagactttgttttgaatatattgaaggaagttacaagtctaagccaaggagcagacaaaatctagtacttgtcttctgtgctgtgagttaactaattaataaaacaaaatggatggagcaggaaagcatcatagtaagtatggtaactcagattcagaaagacaaaacttacatgttctatttcataagtcacccttgtttataaggtgtgtgggggtgggggagagagagagcagggggggagagggacaggggggaagaggagagggagaggagagagagaaagggagagagagagagagagagagagagagagagagagagagagagagagagagagagagaaggggggagtataggaacaaattataaaactagaagggaaaccatgagaagtctaatgagacaatgtgggaacagtgtagggcacatgggacatgaaagaggaagcaatgggtggtagatggaggagtaggtggaggagtggggtcaagagagttgaaaaaaaaaggggagggagaacaacaacaaaaacaaaatttgctttaaaatgcccaaatggaacttaattactgtgtatgttaattcaaacgcttggatataaaaaaatctcttgtgcaaagaaaaatctgttaacacaactaaggacttggaggctgaacttggtaaagctccttctcttcttgtagaaaatgcactaagaccatagcaaagcatccatttccatgcattgttcatgacattaaatgaaaacaccatgttcattgtaatcagactttcactcttatagggataaaatatgatctgtaaaccgggcatggtggcgtacgcctttaatcccagcacttgggaggcagaggcaggcggatttctgagttcaaggccagcctggtctacagagtgagttccaggacagccagggctacacagagaaaccccatctcgaaaaaccaaaaaaaatatatgatcaataaataatatataaggatttatatcattatgtgccataaattatgtccataaaaattaaaaactaatgggactggagatgaattatataggtaaagtggtgaaataaatgtcattcaactaaatgattttctggggagttggaactcatgggatagttttaatgacagaagaaatatttcgtgggctaaagtggtaaatataatctgatcttatttcatgccaaaactaaggtagcagcaaattgaccagataaaaaaatttatgaaattagtatcataaaatgaaggatatcatattccttgaaatataatccaaatgaatgataaaggccagatgtcttcatttcctccacattcactgtcaccattctgttcaaactgttgtctagaagaaagatggcagcagctgcctggacctgcagcagagcatcctggagtttcagagacccaaggaggttccaaggagtgacccgagggcaggagtttgcagggccagcaatagctccagaacaactaaggggaaaaatagacaagtcttatggaaaagtgcttttaaaatgtgaaatcacaaaatcagaaggaaaaatggatgaacagagctggctcagagaatgatgaatttgtacccttcactgccactagtctcagcttcaagaacaaaatatgtttctgatgagcattggtgtataggcaccaaggactgggagatgtgctgccccctggagttcctgcaaaaatccattattgttgaatagggccagcataggtcctaggcacccaacatggaggccctgaagctgcaactccatgcttcctgtcctgctgggacatggaaagtactgagcagcatcactgtacacaggcttcaaaaggtcacgtctggtgagcctcaaggtggcagacattgagggcagggaggtgtgtgactgccagcagctcccacagaacttaccccagcctccatccctccccaaagccccagttattgacaccctgcctagctccaacattatcctggctctgggaaacgaaacaataggatatctgagacaaatctcaacaatggtccaatatttatggtgcaacagaaaccttgatccagaccaccacctcattgcaatgaatatctgcatgcacagctgtctgagacagacagacagacagacatacagagacactgcagtttctaatgctactattatggatgaatatttgatagagaggtgggaaagatagaggactgtagcagtgagcgagtggtggaaaaaggaatgtggtgttgctgagtagggccagcccagtggtgtgcagcagattgaaccttgcaatcttactcagcccccagacatgctgtgcagactcatgatcactctggtccgaagcaatgacaggattccaaggtgaagaacagtacattttctgaattggatctccttgaaatccctctatgatcactgctgcctttggagaccactttagtatctgtggtctgctgctccaggctctattgaagccctagattcaggtagatgtctgtgatcctacagcagctcagagacttgttgatgtctctggcccgacttaccactgaaagctatatggatatccttggtctgggcaaccacctgaggccatcctgatgtctatggactgtacttctacctggatcaatgttgtgagtagcctgggaagccacctgaggccattttgattgatgtctgagtccatcatcctactctatccaggacctgtgttgatgtttgtggcctgtgctaccactaaaggttattcagatgtctgtggtgtatggtaccactggggcaatgtctggatggtcctactgcagcaggggtttgttgatttctgtggatcatgttgccactgaaggctgtgtggatgtccttgctctgtactgcagtctaaacccattaaatggctatgggctatgctgcctccaaggccatgttgatgaaagtagcttggggttgccccttgagaccatgttaaggccttggcctatgttgacacttagggctatggtggtatctgtgacccacagagcagtcacatagagggcatgatgtccatggtctgtagccacaggagaccttttttgttgttgttgttgtttttaaggcatttattattagatattttctttatttacatttcaaatgctaaccccaaagccccctataccctccccctaccctgctccccaacccacccaatcccgcttcctggccctggcattcccctgtactggggcatatgatcttccgaataccaagggcctctcctcccattgacagctgattaggccatcctctgctacatatgcaactagagacacaagctttgcggggggggggggtactggttagttcatattgttgttcctcctatagcattgcagacccctttagctccttgggtactttctctctagctcttccattaggggccctgtgttccatccaatagatgactgtgagcatccacttctgcatttgccaggcactagatagtctcacaagatacagctatgtcagggtcctgtcagcaaaatcttgctggcatatgcaatagtgtctgggtttggtggttgaatatggaatggatccccgggtggggcagtctttggatggtctttccttccatctcagatctgaactttgtctctgtaactccttccatgggtattttgttccccattctaagaaggagcgaagtatccacactttggtcttctttcttcttgagtttcatgtgttttgcaaattgtatcttggatattctaagtttctgggctaatatctacttaacagtgagtgcataccatgtgagttcttttgtgattgggttacctcactcaggatgatatcctccagatgcatccatttgcccaagaatttcatgaattcattgtttttaatagctgagtagtgttccattgtgtaaatgtaccacattttctgtatccattcctctgttcagggacatctgggttctttctagcttctggctattataaataaggctgctatgaacatagtggagcatgtgtcattattacaagttggaacatcttctggatatatgcccaggaatggtattgctggttcttctggtagtactgtgtctaattttctgaggaactgacagacagatttcaggagtggttgtacaagcttgcaatcccaccaacaatggaggagtatccctctttctccacatccttgccagcatctgctgtcacctgaatttttgaccttagccattctgactggtgtgaggtggaatctcagggttgttttgatttacatttccctgatgattaaggatattgaacatttttttcaggtgtttctcagccattcggtattcctcagttgaaaattctttgtttagctttgtaccccatttttaatagggttatttgatccatcttaaaatcagccaccaaaccaagacactattgcatatgccagcaagtttttgatgaagggaccctggtatatctgtctcgtatgaggcaaatacagaagtggatgctcacaatcatctataagatggaacacagggcccccaatggagaatctagagaaagcacccaagtagctgaaggggtctgcaaccctataggtggaacaacaaaatgaactaaccagtactcccagagctcttatctctagttgcataagtagcagaggatggcctagtcggcctacactgggaagagagactccttggtattacaaactttatatgccccaatacaggagaatgccagggccaagatgtgggagtgggtggggaggggagcagggtggaaggatggcatagggaactttcaggatagcatttgaaatgtatataaagaaaatatctaataaaaaataattgatttggaattttgatggggattgcattgaatctgtggattgcttttggcaagatggtcatttttactatatcaatcctgcccatctatgatcatgggagtcctttctatcttctgagatcttcttcaatttctttattcggagatttgaagttcttgtcatatggatctttcacttgcttagagtcacaccaagatatagtattcgtgactattgtgaaaggtgttatttccctaatttctttctcagcctctttatcctttgaatagaggaagaacactgatttgtttgagttaattttatatatagccaacttgttgaagttgtttattatgtttcggagttctctggtggaatttttgggtcacttaagtaaactatcatatcatctgtaaatagtgatattttgacttcttcctttccaatttgtatccatttgaccaccttttgttttctaattgctctgtctagtatttatagtactatattgaactggtagtgagagagtgggagtcttgtctagtccctgattttagtgggattgtttcaagtttctcttcatttaatttggtgttggctattagtttgctttatattgcttttactatgtttagatataggccttgaattcctgatctttccatgactaatatcatgaagaggtgttggattttgtcaaatgcttcctcagcatctaatgaaatgatcatgtgttttttttttcctttgagtttgtttatatagtggattatgattatggattaccatatattgaatcatccctgcatctctaggatgaagcctactcaatcatgatggatgatcattttgatgtgttcttggattcacgttgccagagttttcttgagtatttttgcatcgatattcataagggaaattggtctgaagttctctttctttattgggtctttgtgtagttcaattatcagagtaactgtaggttcatagaatgaattgggtaatgttccttctgtttctattttgtttaacattttgaaaagcattggtattaggtgttctttaaaggtctgatagaactctacaccaaacccatctggtcctgggatttttttggttgggagactattaataactgtttctactctttaggggatatgggactgtttagatggtttatctgatcatcatttaactttggtacttggtatctgtctataaaattgtccatttcatccaggttttccaattttgttgagtataggcttttgtagtaggatctgatccaaaaaggatttcctcaggatctgttgttatgtctcccttttcatttctgattttgttaatttggattctgtctctgtgccctctagttagtctggctaagggtttatctatcttgttgattttctcaaagaaccagttcctggtttggatgattctttgtatagttctttttgtttctacttggttgatttcagccctgagtttgatcattttcttccttctagtcctcttggaactatttgcttctttttgttctagagctttcagttgtactgtcaagctgctcttgcatgctttctccagtttctttttgtaggtactcagagctgtgagttttcctcttagcactgctttcattatgtcccataagtttaggtatgttgtggcttattttcattaaattctaaaaattttctttttttatttcttccttgaccaagttatcattgagtagagtatttctcagcttccacttgtatgtgggatttttattatttctgttgttattgaagaccagccttggtccatcatgcatgagataggatgcatgggattatttcaatcttcttgtatctgttcaggcctgttttgtgaccagttgtatggtcagttttggagaaggtaccatgaggtgctgagaagaaggtatatccttttgttttaggataaaatgttctatagatatctgttaaatctatttgtttcataacttctgtcagtttcactgtgtctccgtttagtttctgtttccaggatctgtccattgatgagagtgggatgttgaagtctcccactattattgcatgcagtgcaatgtgtgctttgagttttactaaagtttcttttatgaatgtgggtgccctagcatttggagcatagatgttcagaattgagacttcatcttggtaaattttacctttgatgagcatgaaatgccctccttgtatttattggcaacttttggtttaaagtcgattttatatgatattagaatggctactccagcttgtttcttgggaccaaattgctttccagccttttactctgaggtagtgtctgtgacatgggtttcctgtatacagcaaaatattgtgtcctgtttacatatccagtctgttagtctatgtctttttattggtgaattgagcccatagatattaaggaaaagtgattgttgttttctgttatttttgttattagagatggagttttatatatatatatatatatatatatatatatatatatatatatatatatgtctatcttccttttggtttgttaaaagtttattttcctgcttttttcccttactgctcttaatattctttctttgttttgtgcatttggtgttttgattattatgtgaagggaagaattacttttatggtccaatctatttggagttctgtaggtttcttgtatattcatgggcatctctttctttaggttaggtaagttttcttctataattttgttgaagatatttactggctgtttaagttgggaatcttcattctcttctatacttattatccttaagtttggttctctcatcatgtcctccttttttgggttatgagctttttgctttttgaattttctttgactgttgtgtcaatgttttctctggtatcttctgtacctgagattctctcttctatcttttgtattctgttggtgatgctcacatctataactcctgatctctttcctaggttttctatctccacagttgtctccctttgtgtttctttattgtttatacttccatttttagatcctggatggttttgttcagttcctttacctgttaagttgtgttttcctgtaattctttaagtgatttttaggtttcctctttaagtgcttctacctgtttacctgtgttctcctgtatttctttaaaagagttattcatgtccttctgaaagacctctatcagcatcatgagatgataattttaaatcccaatcttgcttttctggtgtgttggaatttccaggacttgctattgtgggagatctatgttctgatgatgccctgtagtcttggtttctgttggtaagattcttatgcttgccttttgccatctggttatctctggtgttagttggtcttgctgtctcttccttgagtttgtccctcctgtgggcctgtaagcctgtgtcagcactcctgagtgaccagctctcccctggcaggacctgtgcacagaggggctcctgggtacagctggaggcaggaaggaccctatcccactgcttttggggcctggcctgtgcgctcctggttggtcctgccttagattgtcactggagagaaaatggcaatctcacctccgagtccaggagtcagaacactccctggagatgagctctcccctggcaggacccatgcacagaggactgtggaacagccccagcttctggctgcaatagaggctggaaggaccctgtctcagctgctccactgctcctgcggcctgtgtactcctggctaataagtacagttttataaataaataaatcaaatcatttaagtcacagactggaaagataacatgttaaataaccagcttccaaatgacagggctcagatttgatttcagtaagcctgagatcatatttcaaaaaatctaccctcttaatcactgtcaaatgggcaaaatagataaaatcaatgtggtatctaattaaatgtcagtcagaaattgaagttctattttaggaaatgatacatcaatagagaaatggtatctttattgaaatttaactgatatcatttcaggactatatttgttgtgtaagtcagctttctgtactacatcaaaaaccctgacaatatgagctaaaaggaaaaaaaaaggaaagatttattttggctcaggttgtcacaggttttagtctatgatcacttggccccaatgcctttagtgctgaacaattgccttaacatgatagaagtacttggtggaggaaaatactcaacttatgctagaaatgaagcaaagggggaaaaaggaagggcagcagcagttgagtcccccctcgagcatgtagtatcacttcattttactaggttacagctcctaagtagctcaccatctccatcagcctcatcaaattggaaccatactttgacacaaaaacatttgggagacatttaagttatagaacataacaattgtttcatgacataaaagcatacttccatattgaaaagcaatccttagtgaaggtgttagaaactgtcttatataagttttattttgcactctctatttcatcagtcaatatgattattatcaattaatgtttctttgggtagaagtaacagaaaacccaaccaagtcaaagtgacttttaactgttttattttctccaggaatatgctagtcaaaatcctagaactgagaaattctaagtcacctggtaccaacaaggatctggggtctttcgtcatttgtcttttaccatccttcacacattagctattgcctataatctggacctctaatagctgaacatgttttgctgtaacttaagagcttatatctttataaaattcatatagtaagaattattatgatagtcatatatatgtctattatttattataagaaaatgtataaaaatacattacagtctttttttaaaaaaaaggatataggataatctaaaaataattcaggctctccccagtactttcctacaaatcttctcacagtggagccccagagaacatatttaattctctcaggtattaattgaagcaaactatatgctgaaagcttactagggattcagtatctaggggtttccttgggagatgattatgtaggaaacctctgcctagcacataatcaaattcactctcccgaagggaattaggtattccacatactctacattggttgtacaaacaatcgaggtatagtaatgtaccctcaaggtacacaccagaaactcaaattctctgatgcaaaccaaaggccaacctttctagtgaacttttctatgtataccaactccaggcttgctatgtcatctcttttcttcacagatagtaaagttttcttgcaagcgaaactttctttgaagacaaagtgtcactgccaatactagaacagttgcccatttcccctcttaaacggatagttgaaagaatctagtgttttgcaattttagcctctcatggaagatggatttttataatgaggtaatgaacaagggcttctgaatagagacaactagtaacctcttccaaaacacctttacatgttccttggtttaaaaattcactatttgaacttgctcttgtttcatttaataaccattaaatatttattgaatgcctcttatctagaaactctttaactgcaaaagtgggtgatgaaaaggagagattttagacagaagaaaagagtaccacaaaaaatgtttttttttttttatgtatccaaataactaaaaataaggtatagcaaacacagatagtgcaacaggtgttatttaaaaaaaaaaaaacaagccaggtatgctctataggactatgtcagactctgcaggacgttgttataaggacagggttgtaaggatttgggcctttagcttcattatcaaggagagccattgaaggtttttaaatagtcagtttcacatctaagtttgttaaaagttttttacttgaaaataatttagacacacattgaatttcaaagtagtaaatgagttccagtgttatatttacctgtggaaatcctgtatatggaggttcattttaaataaccatcttaaatgatcttacatgagtatactatagtttatcaaaaccaggaaactaataaagtatcaactgaaatacagacctgagctaatatgttactagttaaatatttttaagcattctcctgtatacagtgtagaaaatcttctccataatacactattgacaattagattcagtagatacataaaccataatgtaacaaaataaggtgagtcatttagtgggatgttcagagaaataatgtcaggaatggtttctaaatttctggtttagaaaacttgatagaagtggtgttatatatgctgagctaaggattatcttggtatgtggtcaggtagagttcaacatgtagagctgttgagtacacagtcgggtgttaaactctggagctcagataaaggactatatgatgctctatagcattgatacatcatgacatgtttatcattttctttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctgtggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttgcctaggaatttcataaattcattctttttaatagctgagtagtactccattgtgtagatgtaccacattttctgtatccattcctctgttgaggggcatctaggttctttccagcttctggctattataaataaggctgctatgaacatagtggagcacgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttattacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttcttttagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcctgtgtggacccttgcgggtgttgggcaagactctgctggcaaggtagcccggggctcgagtcacgagtcttgcggaagggacttgtgccccagatcaggcccgggtagcctgcttccctatgtactgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcaggcctgggtagcctgcttccctatgtaccgcagtctcaagttccgcgcgattggattggggcaggcactgtgatccactcaccagaggtcttagggtcccgtggggagtcctgtgtggacccttgcgggtgttgggcaagactctgctggcaaggtagcccggggctcgagtcacgagtcttgcggaagggacttgtgccccagatcaggcccgggtagcctgcttccctatgtactgcagtctcaagttccgtgcgattggattggggcaggcactgtgatccactcaccagaggtcttagggtcccgtggggagtcccgtgtggacccttgcgggtgttgggcaagactctgttggcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacccttgcgggtgttgggcaagactctgctggcaaggtagcccggggctcgagtctcgattatcattttctattagataccaaaaagaaattttcacttatagtgtgtaatatctgtatttgttgatacatatttctataaatattcattttctcatgataaattctcagaagtgaaatgtctgaataaaagaacatgcatgttttattttaatactaatattggagttaactcctttctctttgatactaatgtaattcctcattaacaatttaagccagactatttgaggtcaaattaaaaatatttgatgaactataataatttttgagcaccaagagataccacaacatgtggtttgctgcctaaatgtacatacactagaatattggtcttcaatatgacaatactaagatttagtgaacgttttttgacaaggtgaggcttagtaggatgttattatgtcattggaagtacttggaaattattaacctggtcttttagtatctcagtctttatctgacttcctgtcttgctgtgagatctttcccactatgatgccatcatccatgatttgacccagtcagcaaggaattgattggatgccaattccatccatggaattttcaaatcttgggttttcagcttcttaaaatatgagctatataaacatccttgctttataaagaacctggccaaaaagcttttggtatcaatgggcagtaaattaagataccagtaaaatggttttgagtttatttgtggaataagtcggttcctaggtatcaaaccaacttaaatagtttacgataagctagaatcttgtgagtaatataattgagaaaatatgcatccgaaaagtaatgtctttattccagtcagctattggtacagtaattgtagtactatcttgatccatgattttccacgtttaaaaattttaaatattactctaatttatatttagctttttaattctttatttacattccaaacattgctccccttcctggtatcccctccaagagttctttaccccataacccctccactttgcctctgagagggtgcttccccaccccttaccctcccaccctcacctcaccccttcatatcccccttccctgggacctcaagtctctacaggattaggtgcatcctctcccactgaggccagacaaggcagtcctctgttagataagtgctggtggccatagaccagccactgtatgctctttgattgatagcttagtccctggaagctcccagtggtccaggatacttgacactgttggtctttctatggggttgccttcccattcagcttcttcaatgcttgcttcccttaactcttccataaaggtcctgatctcaatctaatgcttgtctgtaagtatctgcaactttctcagtcagctgctggtagagcctctcagaaaacagccatgctaggtccttgtctgcaagtacaacatggcattagtaatagtgtcagggtttgtttcccacccatgggattgatccaagttgggccagtcactgggtggcctttcctttccctgtatttcttttagacagaaacaattctaggtcaaatattttgaaggtaggttgatatccccaaccctccactggggtccctatctatctacttgaggtggtttattaaggttccatctccccactgctggacatttcaaggttacgcccattgagtcctgggagcctctcacatcccagatctctgagactttctagatgtctccctcccccaacatgcccctcagctgcatatttccattcattttcctgaccctttgggcttctctcctgattctgtccatgcctgattctgatccccttttccctccccctcccctctcccaccatgattatttattttccccccttctaagtgggattgaagcattctcactttggccttttttcttgttaagcttcttatggtcagtgggttgtatcatgggtattctatacttttgggctaatatccgcttatcagtgtatacatatcatacatgtccttttaggtctaggttaccttactcagaatgatattttctagttccatccatttgcctgcaaaatttatgaagtcctcctttttaataatggaatagtattccattgcataaatgaatcaattttttttctatccattcttcagttaagcgacatctgagttgttttccagcttctggctgttatgaataaggctgctatgaacatagtggagcacatgtccttgtggtatggtggaacatcttttgagtatatgcccaggagcagtatagctgggttttcagatagaattatttccaattttctgaggaattgccagattgatttccagagtgattttacccaccagcaatggaggtgtgttcttctttctccacatcctcaccagcatgtgctgtcacttgagtttttgatcttagccattctgactggtataaggtaaagtctcaaggtaagtttgatttgcatttccctaatgactaaggatggtgaacgtttctttaaagcttcttggccattcgagattcctctgttgccaattctgtttagctctgtacccaagttttggggggttatttggcttttgaaagtctaacttttgggttcttggtatatttttgatattagtcctctgtcagatgtagggttagtgaagacctttccccaatctggaggttgctgtttgtcctttggatgttgtcctttgccttgcaaaagcttttcaggctgggcagtggtggcacatgtatgtaatcccagcacttgggagaggttgtggccagcgtggtctacagagtgagttccaggacagccaggactgcacagaaaaaacctatctcagaaagaaaaaaaatgcttttcagtttcatgagctcccaattgtcattgatcttagagcctgagccactggtgttctgttcaggaaatttttccctgtgccaatgcattcaagggtatttctcactttctcttctattaggttcaatatatctggtcttgtgtggaggtccttgatccacgtggaattgaactttgtacagggagataagaatggatcaatttatattcttctacatgcagacagttagaacagcactatttgttgaagatgctgtcttttttccactttttttttttggcttctttgtcaagggtcaagtgaccataggtgtatcagtttatttctgggtctttaattctattcaattgatccatctgtctgtctctgtaccaatactgtgtggattttatcatcattgctctgtagtacagcttgaggtcaggaacagtgattcctccaggagttcttttattgtcgagaatagttttcacaattctgggtcttttgtttttccatatgaagttgagaattgctctttccatgtctgtgaagaattgatttggaattttgatggggattgcattgaatttgtagattgcttttgataaaatgaccatttctactatgtaaatcctaccaatccatgagcatgggagatctctctatcttctgatgtcttctttgatttccagcttcagggacatgaagttctttttatacagatctttaacttgctggttagagttacaccacaatattttatattatgtgtggctattgtgaagggtgttgtttccctaatttctttctcagcctgtttatcatttgtataaagaaggactgcagatttcttaaagtcaattttatatccatccagtttgctcaagttgtatgttacgtataggagttctctagtagaatttcttggtgtcacttatgtatactatcatactatatttaggtatgtggcatgaatttctgatctgtccaagacttttatcatgaaggggtattggattttgtcaaatgctttctcagcatctaatgaaatgatcatatgtttttttttctttgagtttgtttatattgtggattatgttgatggattttcatatattgaacaatccccgcatccctgggatgaagcctacttgattgtagtgaatgatggttttgatatgtttatggatttggagtgcaagactttattttttttttacttttataagtgtataatcctctttaatatttataattaattcatagatttagagcaaaatgatatcttcacatagtctcctatgtttacataaatatatatatatatatagagagagagatagatatagatattttcttcatttatatttcaaatgctatccagaaagtcccctataccctccccctgccctgctccccagcccatccactcctgcttcctggccctggcattcccctctactgaggcatataatatttgcaagaccaaggacctctcctcccattgatggcctactaggccatcctctgctacatatgcaactagagacacaagctctggggggtactagttagttcatattgttggtcctcctatagggttgcagaccccttcagctccttgggtactttctctagctccttcattgggggccctgtgttccatccaatagatgactgtgggcatccacttctgtatttaccaggcactggcatagcctcacaagagacagctatgtcagggtcctgtcagcaaagtcttgctggcatatgcaatagtgtctgggtttggtggtagtatatgggatggatcccccggtggggcagtctctggatggaccttccttctgtctcagctccgaactttgtctctgtaactccttccattggtattttgctccccattctgagaaggaatgaagtagccacactttggtcttccttcttcttgagtttcatgtgttttgcaaattgtatcttgggtattctgcatttctgggctaatatccacttaacagtgagtgtatatcatgtgtgttcttttgttttgggggttttttctttttttattttcgagacagggtttctctgtgtagccctggctgtcctgaaactcactctgtagaccaggctggcctcaaactcagaaatccccctgcctctgcctcccaagttctgggattaaaggcatgcaccactactacctaacatgtttgttcttttgtgattgcgttacctcactcaggatgatgccctccagatccatccatttgcctaagaatttcataaattcattctttttaatagctgagtagtactccattgtgtaaatgtaccacattttctgtatccattcctctgttgagggacatctgggttttttctagcttctggctattataaataaggctgctatgaacatagtggagcatgtgtccttcttatcggttggaccatcttctggatatatgctcaggagaggtattgctggattttctggtagtactatgtccaattttctgaggaactgtcagactgatttccagagtggttgtacaagcttgcaatcccaccaacaatggaggagtgttcctctttctccacatcctcaccagcatctactgtcacctgaatttttgatcttagccattctgactgatgtgagatggaatcccaggtttgttttgatttgcatttccctgatgattaaagatgttgaacattttttttcaggtgcttctttgccattcggtattcctcaattgagaattctttgtttggctctttaccccatttgtaatagggctatttgattttctggagtccagcttctttaattttttgtatatattggatattagtcccctatcagatttaggattggtaaagatcctttcccaatctgttggtggccatttttgtcttattgacagtggcttttcaggctagggatttttccagggtctactgagctccaacttgaccacttgaggttctgctctttcttaaaacaaagcatatatgtgaagtcattcttacagagacttataaaatatccttgatttctatgatctctgtacattttgtaacgcaaaaaccgtaatttaagaaaactctatttggtacttgcagagtcatgcacaattccaaattacatccaaggactggtttgtttagctacatttatatccctcattagtcagagctggagtggacatctaagtatgaagaacacatttcttgtgtgtggtacattctttaaaatacataatttcagtgtgttgaatacagaaactaagcaaagcttttcaaaatttaggtaaaactttattactttggaatcagtcaaaatttatatataccaggttatctctcagaatattgaaaaatattaatttttatttactaaaacattgcatttctgttcattttaatctaaatatacattaaaggtgaaaatacaaatatgatagatgacatttgtatcacatctaattggcagatgatcattactcagaatttataaagaattcaaataattataaaaagttgttggaataactagttcttagaagagtaaatgattgacttatgaacatgaaaaaattagcattcttattaaaaataaaaaatatgaattaacacagcccggctaacactttatatgtttcaaatttacagaattgtgaagtctgatatttccagttattaactagaaattacagtagtggaactttttttcctgcctaatgggaatgtagatatgcacagctactttgaagaacaacatggcagtatcatttaaagttgaagaagtaaaaattcctacagataaataacattgtgaatagaaactctgttgaactgccaaggcagtcctaaaagggaagtttatagtgatgcacatttacataaaaaaaattaagagagatttcaaataaacagcctaatgtttcaacgctctcaaaaaaataaaaatcagcccatccaaaacccaataaatagcaagaaataataaatattagggaagaaattaatgaaaaagagaataaaagaacaatacccaataatgccagaggcctttcctttattttaacacatttctgagaacactgtgtttaaattgcattgagatctctgggtaccctgatagcttatagagttgtatcaggcctacaaacagaaagctctatgtcagtagttcagaaccttcctaatattgcaactctttaatgcaatcccccatgtgtggtgacccccaactataaagtcatttttttttgctacttcctaactttaattttgccctgacatgaatcgtaatgtaaatatctgatatgtgggatatctgatatgctacctttatggaaaggtaatttgacaccccctgcaaggaggtcacaacctataggttgaaaatcacttctactgcaagacataaagcaaggaaacctatataatcattgaagattcagtagtagctgtttttgccccttaattggttaagatgtttgtgggtggtttaaccagttgtgtacagtgatacagatactacaactttgagatgcatctgtaagaaatgatctgtaaacatcctctgtactgtaatgtatcttgtcctttttagtacctcaaaaagatgattcactgggtggtaatttttgataaaaaacgactttgggaaaatggctcatacatgtcactgagtttttattgtttttaatcatagctaacttaatttatattcaaaaaaggatgtggtctacttcttaatatttctttgacacagagcagataagatttcttattatttttttcaagatatacaactaaaaggagatcaaaatcagtgttgtagactctcagtgtgccaaaaaggctgagagtaaaatttaatcattgtcacacacttatgaaatatcattagtggatccctaccactagccctctttctctttctagagcaaagataaaagaaacaggcttaatatacattgggagtgctagtttacacataggaagaagtacaaaatggtgaggtttattcaacagtagatcagctaagcagaggagacagttggactttactcctgggtaaaggctttatgaaataggacagacaatcatctaatatgattagttagggagaatgatattcatgtaactaaatggcctcacagggtgccttctacactctactctctgtgaaaataattgaattaaaacctgtttccaagacaaaatgtactgctcaagcctataacctggcactgatgcagtcagctcctgagctgtgctcttctcactaccgaaactagagtgctggaccagaacaattattcaaggattttgtgaaactttttgctacataaggaaaattaccctttattcacggggaggcagatattgttattctagatcactatctatttttaaagttgtatataaatcatttaattttttaaaaatgtatgccctcttcttagaaaaatgaaaacaaaataaaactaagccattttctcactagtttccaggtaaaaatttctgcattgatttgcctcttgtggtacagtcaagcttagcacagtaattaacatctactattaaatcagctcaaacataaaacactttaattaagcagccatgtatgtgcccaagaaattaagaatgtgctgattggaatgaagcagctgttgttcctgcttgtgatctaacttggacaatactgagcaaacataactaaagcaggacaaagaacaaataaacaattatgtatattcatgaatttcacttgttatatactctgatatgtcccccatttactaactccctattattagcctagcattatgctctgtgctctctctatatctttccacacatatagccaggagatatacatatagaaaaatagatagatagatagatagatagatagatagatagatagatagatagaaaaatagatagatagatagatagatagatagatagatagatagatagatagatagatagagatagatagatgtgaatgtggatgtggatatggatatagatatagatatagtcttgttcatactaccttttaaaatgtaatagaagaaatagaagcactatataaataatgaaaatacctgtagtgtagattatgtgcagccgtggagaattaattcaattatgctagtctctcttcctctgcaactctctctctctctctctctctctctctctctctctctctctctctctctttccctcccatgagtgagtgtgtgtgagtgtgtgtgtgcatgtgcgtgcgtgtgtgtgtgtgtgtgtgtgtgagagagagagagagagagagagagagaaagagagagagatcctacagcatacctgtggaaataatattttctgaataaatagtcttgactttttctgtgcacagcagagagcatatgacattgggattcttaatgtagatttatattctttatatttaagtaccattatatatttattctttcatcaaatatttgtttaaaagttaaaatatgcaaggtgccaaggagctcagttggattttccacttatatactaaagggtatggttgcagaaaaaatacaccacaaatatatctaaaaatatcaatactgttaacatgctacaaaagggatgctatggtgccaagaaagtttgtaataagatgctaaaagaggttttatgattacctagcagtctgaaggaaaaagtggtaattgcctagattgagaagtagctgagagaattccaagtagaggagaaagtatgtctaatgtcttgtaatgggaagaacgcaaggaattgggacagatgaaaggagtcctgtattacagaaaaaaaaaagaaaagaaatggtagtcaaagagacttaagaaggtcaaattgaactatgctaccatttatacgtcatggaaaagtagtagttgcacaagttttaaagaaaggttttatgagaagagttgactcaatgttatattatattcttgtgtataccaagtgctttttccaactaagttatgtcggcacgtgcatatatatgcagttataattaacaagattatacacaattggaaaaattagtaatgaattacatacaagaatggaaactaggaagacaattctatgtggggacataattggaatgcctagtacacagtatcctaaaagaattcagtctattaagtagacaaaagatatgttttgaatagctaacataggagataataataaataaaggatatcatgaatgagggagagctaaaatgggtagagtgaaaatgtgaacatgttgtgaaggctaggagatgactcagtggataaaatcacaagcctggtgaccctattttagttttgaatcccagaatcagttgtaaaagccatatacaatagcacaagcatgtgtgatgccagctttcctactgtgagatgcagagacagcagcatcttctggagcatgtggtccagtcagcttcacttgtacaatggctgagacctttgtctcaaataaggaccagaggaaaggaccacagccagaggttatcctctgaactctcccttcctccctctttccctttctcccctcctcctctctttatacacacacacacacacacacacacacacacacacacacacacacacacacacacacacagagaagcacacagaacaataaagtggctatgagctagtatagtccagaaaaacaagaggataatttaacttgaatttagttctgaatgctaagtagtgtatcatattatgtctcaaaatctcaaattataaaacttggggatcacaatgaaaaaaaatgttttcttaggcgttgccttgttaatataattcttccattgagtggcctagatataaattatttctgtgtatctatctagcaaccaattctaaagccagattctttcaaagtacaagttcaacagtcatcccaaattttctttctttattaatttatttttcacactccatattttattcccccatccaccctctgactgttatatatcccatacctcctccccactccctgtctccacatgcatctacccatccccaaccccacctgacctctaaactccctggggcctccagtttccttagggttaggtgcatcatctctgaatgaacacagacctggaagtcctctgctgtatgtgtgttgggggcctcatgtcagctggtgtatgctgcctagttggtggtccagtgtttgagagatctcaggaatccagattaactgagactgctggtccttctgcaagattgtcctcctcagcttctttcagcctcccctaattcaacaacaggggtcagctgcttctgtccattggttggttgcaaatatctgcatctgactctttcagctatttgttgggtctttcagagtgcagtcatgataggttcctttttgtgagcattgaatagcctcagtaatagtgtcaggccttgggacctccccttgagctggatcccactttgggcctgtcactggaccttattttcctcaggctcctctccatttccatccctgtaattctttcagacaggaacaattatgggtcagagatgtgactgtgggatggcaaccccatccctgacttgatgccctgtcttcctgctggaagtgggctctacaaattttgtctccctactgtctggcatttcatcaaacttccctccctttgagtcctgagtctctcacctcccaggtctctggtgcatttgggggtcccccaacttcctatttcctgaggttgcttgtttccattctttctgctggccctcggggcttcagtccttttccctcacccagtaccagatcaggttcccctctcccccctcctctgcccaccagatccccacccccacttctgacagctttcttctgtctcccaagtgggactgaggcatcctcacttaggcacttcagcttgttgaactttatgagttctgtggactgtagcttgggtattctgtaattttggggctaatatctactcattagggagtacataccatgcatgtccttttgggtctgagttacctcactcaggatgatattttccagttccatccatttgcctgcaaaactcaggatgtccttgttccaaattttcaaagtccaaaatgctctaaaaatcttaattttttgagtaccagtatgatgtcaaaagttccacacctgatgctagctattttaaataccatcaaatcacactcagacactatgtacaaggtgtacatgaaataatgtatgaatttacataaatgaattttatctttgtaactgagttccaactcaagatatgacattaggtgtatgtatatatttcaaaaagttacaaagctcaaaaatccaaaatgctagtctcaagcatgttggataggagatattcagtatattgatggtattatagacattacatggtaaacttcctttagtatagttagccaacaggttcattttgtatccttgcttgaagtggtcattatcttcttttttgatcacttacaggaaataatcaaaaagctaacattaaaaggaagaaattgtgagtaggaaaagtccagagtgtgtcaatcaatgtaagcatacaaacattagaatccgaatccctaatccaaatccctggcctcctatacacctgaaatgattcacaaagtatctctgaactttaatttctttaagtttaaaataagtctcagaaaagtactttgtttataactgagtatgagaaataataaatggaatgttttgttaaatgctttgcaaattatgaaactttatggcagtgtaaattagtgtcttgatcaaatatataaagccaaattttacgtccaataatagcaactgttaaaaccttttcttatccccttttattaatttgattatttgtatattatatgcttatgtagtatataatttaatacaggaaaagaatacagattataactgaagggaaaggctcaaaatgttaaagcttcctttatcttcagaagaaattattttctaagcatcaatgtatgtcactatacatgaactcttgccaaccaagaaactcacatttcttgacattaaatttgtgattgatgcttgattatatagatatgattgattgaattgttgcccatatacttgaactcagccttgagattaactgattttacatggctcaaaggctctacccatatgatattgttggtctttctgttatgactgatttccaacattaagactctctggtatattctatcctttccatgatgaaagcaatctgaaaatataaggttattcaaagaactaaataataaccaccacaactatgaaacaaaatattgtttagttcttgattggatggagtcagaaattttgacattattcaattttgactatggggatactaatcaggaatgagatgacattaagattgtggcagtccactgctgaatgtcattcattttattactttttttcattggccacactatggccatcatgttcaagaaaaaaacagcaggaagaatggcccttccttcagtgggttttatctaattcttggctattttgttttcatctatattgggccatattaaccatttaaatcctaccacaggtcatgtttatgggtcaccacttgtaacaacttactgggaatatgaaatatttattttattttacttattatcctttagtccagaatatcaatatgtattatgagatattttagatttgcaaatactgtagtgtttgggaatataggcaaggaaataattccaattattaaaataatacagttcaatctgtcctttattttatgtctaggaactccttttgaatttagtatgatgccatggtatacctataatcaaaatcctgatattaattaaaggcatgacaatttgccaattggtacatcttagtaagtgctaaaattaattcagaacctatgtgcctacaagtccaagcaatcatctttcttttctatcacatagtcttatacaatcatacaatttgggtttccaattagagtgttattatagtgttctgctttaggtttgtgttggcaggtcttgcttttcagtgctaaggttgattctggaccttgcacatgctaggcaaggactgcaccacttagctatatcttagcacttctgcttcttattttttaaaagtatttttaattattctgcatatttcaggggggcagaatccttttcccagttcatatttatgtttgtgccaacagagaatcccaactcagtatcatcaagtttaatggtctcccaaatgtgataaattttaatttatttggtttgagaaccctaagcttaagtcaagtttggtttaacaataacactggcaactttgttgaactcagaatcactgttgcttctttttacagttgtccaaaatgagcaagggtctcctctgcacatttatttttttgttttcttttttagatagggtcttgctatgttactcgggcaggtgttaaactcactgtttggatcaatggatcctcctgcctcagcttttccttaatagctgagtctgtaagcataccaccaaacagatctactacaaattaaaaacaaaacaactagacttcaaacattcagagctgccttttatactggtcactgggtgccactggtatctatatgtaaccatgctagtcggaagatttttggagatatagacaatagctgaagcatttcaaagagtactgatgaactatgatatttagaatatgctctaaagtatgctccatagtgatttttctttgtctcattaccaactatgcaatgggctcatacattatagatgatgtgattttttttctaggcactgtataaaatgagggaaagtcctcatttgcatgtataaccaacagttataggataagagccattcccctgagcctagcatcacttgtcttccactacaatcaaggcacctgatttgatctgaaacactcacataggccaacaaactcagtgtagtactactttaaatagagccctaatttcatattcctattcctaaatgtaagtcatcaagacatatgaattagagaagttaaatttataacagaaactcaggcggacttagcaaatgcagtacagcacagcggaacttgatgcaaagtgatatgaaagtaccagcatcattctaatatgccctgtaaaacacacagtgcagagccagttagtatagagggaagaaagaaagctttctgggtaattcacattgacatggtatttaaacttcagttgtcttgtgggggttgctctacaaagagagagagagagatcagcctccaccccaaaatatgatttgaatgctgcccatggactaaaaagagtataagatgatttgttactagcataattagttgtgcttttttttctttttttgagatagaggtggctttcaagccacagatatcttgaatgaagggaagggtgaatagctttgaattttacattggttggtgattcgtcctgtgctgattggttgtgcatgctctctgaatttgcatatgagcagtatagaaaaaagagaaaagcctgaaggagcttgcaaccccattggaagaacaacagtgtcaaccaaccagacaccccagagctcccagggctaaaccaccaaccaaagagtacacatggagtgacccatggctccagccacacatgtagcagaggatggccttatatggcatcaatgggagaagaggcccttggtcctgtgaaggggaatgtgagggtgggaaggcaggagtgggtgggtgggtgggggagcacccatatacaataaataaataaataaataaataaataaataaacgaacaaaaggggaaaaaacagttcccactgctgacagttcttagcagttgtcctaatgtggcacaagggagagaaggaaattgttagaggggaataaaagagaataacaatagcttaatatgatcaaaatatattatgtgcatgtatggaagtgaatttcacaatgaagttcattattatgggaagttaaacatttgaaaataataaaaacctcttaaagggaaataatgaagattatggcttgaaagctgctaacatcaaaatggtagtcaggctctttattaaaaatttgaatctctaaaaataaattccagtgtcaccagttaaagtttgccagataaacaagagctctattaatagtcttagatttattcttaagtttatcagcattctttttgctgttatagtgaaaatgatgatttagtggtaagatccatttcctttcctctatgtgattctggttttagatgctttgatgtgatgctttactttcaaaatatgcccctttatttctaaagacttcttatctgtcttagaataaaactaaatattgtctcaaagaagacaagacctctggcccacatctatgggcttttttctacactgtattctaactgtgctgctttggggaagacatttaagctgttcatcagcttcttcatgttcctttcataagatagacattacaaagggtggtgagtgtaccaacataagtaagttttctccatgtttgtaatatgcttccaataccatagacactggtaattgccaaggcagcagtgtgcgtatgctgctgggaattatctgggtaatattttaactgaattactgggaagggaataaattaagaaaaaccatgttaaactactttgagatatataaagtaaaataagatcacggatgcattttcctaatttatcaattttttgcaattaaatatttagagtgtgtggtattcctaagttatctatttagaaattgggaagatttgggagctgtgttggttgtatttctaagattcatttttagttcctaatggttttattttccagaataaggaactgtgtgttcctcttgccacaatgactaagtgctgctggcacaaataacacaactgtgaaattttttaatattataaaattatggcttccaaagaccccaactgcccctgtagagtacaatttactaatccttcttatgtgttcttaattagtccccttttctgctgacagtggtagctattgcaaactttactgtatcctttctcatcaacatgtttccatacattttctctgactcaaaccactccctttgttccctgtcttcctacatactctgagatacagtatctgtgcctcaaactattaagtgggctatccatgctgccttatagctctctccatttctatagactatttctgactgaatgccaccaccatacaacaaactttactaatcccctttctttccagattcagacaacatatctcaaatttgtgaggccttcttcggcagctgaagtctagttaggtccttccttgttctaccaccaggcatactttctgctagcaaaaaacagcgtatacaacattctcttgtttattttcatatctgtctcttgtaataaactataaaatcctaaagaacaggtaaggtactatttaatttgtctctgagttctctgaacaaatatagtgttggcacaaataactatttattgagattggaaagagaaggaaagagaataaatataagaagtatatacttctttcagaacacaaaccactttctttcaaccttttaaagtaattttcaatggcatacccatttacattttccctcaacctttacaaaactttctttgcatttaatagatacatgctgatatttttaaaaggaacttcaacaaagacagctgtctgacagctgtacaccatctgtgcttttcagcctgagtaaaaacatctggctactcgagaataggagctctgtactaaagaagtttcccaggctggtgattattagtattctaccaatgtgctttgctttgtcccactttgacataataatttatacaacttgtccatctggattatgaagtttccttttgcttacacacctcgacaaaggtaaatgtaaaacaaacaaaaaattaaacagaaactgtagcatgttgctttatttcttccatgagtatcttttatagtaaaagttaatatcatagaaaatatctacatgtacatgtaaacttgtacatttgtgctttgggtcaataatctccatggattatgaatctccagttaaacaaagttagttaaattttaaatgtctttttctttctttccttgatttggaactacttcaggggctgtgtccaacaggacaaaggagagatcttaatttgagagcaatggaattgagatgtcatgaaaaaagaacagagaactatttggtgagaggaagggaaccagcaagagtggaacagaagggttggaggagtgacatagaggagaaggatggatgaaaacaaagtatggtggcatatgcataagagagagagagagagagagagagagagagagagagagagaggagagagagagagagaaagagagggagcataacttcatatgcttattctcaaaaattaagaaaaaagaaaatgtaaaagaaaaaacaatccctaggtggggcagtctctggatggcctttccttctctgttctgctttgtccctgtatttcctttagacaggagcagttctggattaatatttttgagatggggaggtggccccatccctcaactgggggccatgcctgacctctggatatggtctctatatgttctatctccctttttttgagtacttgagctaatctcatccccattgggtcctgggagcctcttgctttcctggcatctgggactttctggtagctatccccagttccccatcctccattgctacaaacctctgttcgatttcctgaccctctgtacttcatccctatctcctcctgtatctgaacgggccccccttttccctctccctcctatctccctcctagatccctctcaccttctgcttcctgatataattttcttcccccttctgagtaggactgtatatagtactgtagccttcacactttggtgtggtcttctttcttcttgggtttcatatggtctgtgagttgtatcgtgggtattctgtgcttctttttagctaatatcacttatcattgagtataaccatgtgtcttcttttgtgactgggttaaatcactcaggataatattttcaagttcaacccatttgcctgcgaatttaatgaaacagaggactgccttattaggcatcagtgggaggggagtgcattggtcctgtggaggctcaatgacccaaggtaggggaatgctagggctctgaggctagagtggatggacaagtggggaaacaccctcctagaggcagagggagggagaaggggatagggggtttgtcgaggggtaactgagttcgaggccagcctggtctacaaagtgagctccagaacagccaggactatacagagaaaccctatctcaaaaaaaaaaaaaaaacaaaacaaaaaaaaacaaaaaaaaacaaaaaaaaacaaaaaaaaacaaaacaaaaaacaaacaaaaaaaatgaacttataatagcagttgggactaacccatttacaacacagtttttactgctgagttcccgttgatgttttcagtaatacatactttatatatagatgtatgttgtagtctgcatttgtgtgcatgttcatgtgtttgtaggcacatgtgtatgtgtgtgcatgctaatagaggccagagggcaacctcagctgacagtcaagttctgtccactgttttgttggtttgtttgtttgtttgtttgttttaaaagatagagtctctcgatagcctagtcagggtaggtagccagtgatcctgagggatattcttgtctctgactccttagtgccccgcgggattacagaccgacaaagaaacccagcttttaatgtaggttctggggatctaatctaggccttcctacttgctaggaaaccactttactgacagccatcaccccatctccttttcaatatatttctctagcatatctttattgtacaaagtcgcttgtatcatagccacattctggaatagcagtattattgtgataaaatatatgcaacacaaaagatttcaaccatgtgaagtattaatattatttaggaatccatattgtaaatcatgaccactgcttatctttattactttttgtcttacaaaataaattatttgaacatacttgacaagtctgctattatatgattgtattattttaaaactggaaactttaagtttttatttccagaggtagtttggttttaagtagctcactaagacactgtgttgtatctgaaaatacatagcttctagatggtctacaagacctaaataatggttgaaggacttggacttagaaaacaatagtgaatagcaatatattatttagttttgaaaggatagaactagagtcaattattgagaattcctgaacaccatgtttgggttatagtaagaagatgttttctagcatctgggacatttcagagtgtagtgtaatgccttaaacactgaatgtatttaagcaatgattaccactgggggggttatatattgtatgagagattagattaagttctatcatccttcgaattatattaaaggttagacaggcattgaatggtagtcatgtttcctgttgtatcagatgtcatatttgcctatcaactaaatacttaaagcattttgtctgtccattggttaccaatatagtgtttgctatttttgtttgttgcacccagaaattactttccttagatctacaaacaatagcattacttttatcactcagagtataaatgtatcacttcagatatgccttctttcaccattttatttaaaataatccacccctatcccaccattgccgtctctaattaccttctagcatattgctctgtttatttccaccagagaagtaatcagtctgtaattttcttgtttgctttttcccgtcttcttctacaaaaagggaacctaactttggcttactcaaaagtaaattcatattttccagaccagtggcatgcatgaaataagaatttggtaagcatttgttaaatgaagaaatagagacctctccatgggttaaggtttctattatgttaaagcactctgtagaagatgcttgctcagagacattttgcatttctccataacacaaaatcaggtatttggatgtccaagggtgataatttttcagtttttcttatctttccaaaaatttccttctgttagctattttcaatgaaactaggttttatgaattataaatataagaactggggcattcatgagaaaatattgtaattgaattttgtgggtatttaagagtaaatgatgaccatcacagatggccatttgcaaacatatatatgagtgcttagttgcttggacttcatccagtgatttgttataacttaattacttaactgatagatcagaaatcgagacacctgggacatgataacatctgcttctgaaaccataatgaaagtgtgctttataacattctcatctccaagatccattgaagctacttacatgcttcccttggcttgcttttctttaatgctcactagttgtgtttcattttcttgcttcctaatattaatagtttaaacagctcatttgtcagttttatgtgggtgttaatattaaaccacctttttctttttataaattccataagagcacatatcctttaccaaaccttttcatttgcaatgaccctgtggtagtttcccattactttcttttttctatattcaacagtattgcataatgtattttggacaggctgtttgatcagatttttttttccaggcaagtatttctagtaagatttggcttccttctcattttatcactatattctttcttgtttagccctgccttttcatctttcttcttcccaagtcacttttttctattatcttaaattgttttctggtgtgatgaattaatagtgataaaatggtttatatcaataaatggcttcttggatttactgaaatttttaaatggtttcttttcttttataaagacaaaaaaaaaaaagctgttcattatccatatcagatcatgtaagctccagattccaggtcctgtggaaaccatgaaagagtagtcagcatttttaaaagttatttgtgcacaccagaatacagtcttattataaagtatttacttgttgaacacgttatacataatcgtgtatgttatcatgtcaacggaagatccaagaataaggaattctacaactcaggtttggcagggttgggtaggagaaagcaaccaattctacataaatctcaaaatattgaacttccacaaacattattttcataggtattatgtgagacagggacttcttatgggccctagactggtctcaaatttaaggcactcttttcctgaaagaaaagtaggaagagaatgtggtaagggaaggaaggagaggggagagagagagagagagagagagagagagagagagagagagagagagagagagagaaaggagaagaggaagaggaagaggaacagagaactaaaggcagaagacagcacttgagaacctgctctcccctttcaccatgagtcttgggtccttgaggtcacccagttctcagtctcgttggcccccttacctactaagcccccgcactggctcagaatatttttttagatatgttgtgaaaatgctataaagtgagtagagcaatgtttgatatgaagtgaacttttagaaatgaccaggctaggtactgcaccagagtgtttctcaaatgcatcagttaaggtcttgaatttctatatcatggcaacttttaccaaactttactctttggaaccctagcataagaaaatatttcaatagttttatttgagggaaacaagcaatttcataactagcagcttgggaattgctgcatactttatgtattttgagacagggtctctctatgtaacctgactgtcctttagctcattatctaggcccagctagcttgaattcatagagatctgtctgcctctgtctcccaagtgctgtaattaaaggcatgtgccaccacattcagctcattcatactttttttcacttagatcattatacatcatcacactaatggcagtaaaaatatgcatggtttacacttactttagccattgctttcaaagttgagaaatccttttactatggatcatacattagtatgttaccagacattagtttggggaagcacaattttgagaaacaaatagggcactccccttgtctttagctggacaaatcattctttttaacttacaattgcataatgaggggagtagagaaatggtttagtgattatggtcttatgctgcccttgcagaggacctgagtttgggccccagaactcctctcaggcaactcacaaacacctgtgactccagcttcacagtgttccaaagcctctgccctagggagacactggcaatcctatgtacatatccacacagacagacagatagacacatatccacacagacagacagaggcagacagagagactgtcagataaagacacaaacacacacacaaatttaaaaatataagaaaattaaaaatttaagaacctggataaagtctgctatacctcattggcaaattggaaaaccaaactaacatttagtgttgttgcctagtgacattctctagtctttattcctacaattacaattattccttgatattgccacacaactactgtgctactgcttatcctggcttttactttggtttgtttgtttgtttgtttggtataatcatcccatgagattatacaacattttgttgtattaaagactagtgcttgcctggcactatgtaagagactcataaaccattactaaaagttcatagaaacaataaaaaatggagttttaacagctttgtatagtcattgcacatttttaatattgattatgtttttattctcatttccacttactctctataccatgctatagaaagctttctatgtgataagtgacttaggtgaaagtcaatatctgcaattagaagtgtctgttttgcaatttatttgtcttagtgataccaggaaatgcaaatcttttcaaacaaagaggccatccaaaggcactgatgatgtagagagtcaattctttccattaccacacctttgaaaggctcaattgtaagacctagtactgagggaaatccagttgttcttctaattaaactctcaaagatacccagagacataagaaaccgatcctaatatgctcactatttttcttccttccttccttccttccttccttccttccttccttcctttctgtctgtctgtctgtctgtctgtctttcttccttccttccttccttccttccttccttccttccttcctttctttctttcaggtcaatactgtactttaaaaaaaaattaatatgtagttaaatcattttcccctcccttccctccctccagcccctccctatcaaattcatgacctcttatttttaattattatcacatatgtatatataaaagtgaataaatatataaacataacctgtcgagtccatttagaatagtttgtatgtttatttctttattgctgaccacatggtattggataaccatttaaaggattcacccctggggaaagactaaactaaatctcctctcggtagttgttcattgcctagagctcttcatccagggttgaggccccataagatttcccccattcatcttggcatgtcagttgatgctttcatcgtttaggtcctgtttaggcaaccatattattgatattttatgggtgtgacttacctgacatatatggtagacacaatcttgcagcagacttcctgatcttctggcctttacaatctctttatgctccctcttctattatcttccctaagccttaagttgtaaagcagggattctcaacctgtgagtcatgacccctacagagattttatatctgaaatcttgcatatcaaatatttacactatgattcataacagtagcaaagttacagtcatgaagtagcaacaagaataactttatggttggggtcaccacaacatgaggaactgtattaaagagtcagtattaggaaggttaagaaccattgttgtagagactatgctgtaggtgtctcaatagggcaaagattgagagtgaggtaggacaacaggagatatggtggaggagattgtagagattaccatagaaagcagaacctcttatccccacatgatttcattggaccaagggaatatgcttaaatatcaccccccataccaacttggaagaagtgggtttgatataaatgacacatagaaggtcacacacactctgcagtcaggtgagaggccagtctgacacaccaccaaattctttatatctctctattaataaattacctccttaaccatccccttgctctgtacaagataaaatccagaaacaaggaatgttagatttacgaaataaatgtcatcgagaacactggacagagtagaatggaaggaaaagaattccccttcccacactatgggctaccacaagcaaaagaaaggaggaatgtctctgaagcaaactgtctaaaaaccaaactctgaaaaagagatctgcacaaggcccagcagtagtcacttagagggtacttgcccagagctgtgcctccccttcctccaaagctgggacaaaagaggaagctgttcttgaggccttgctatcaaactgctctgtcagaaagagtagaaaatctggcactataaaatctccaacccctagtaccctttccactatttaggccagcaatgaccctgacaactaggaacaaaagaaatgagctgaacctgacatagactcatgaatgcaaacatattcaggcaaaggctgtgggtcacaggtttggaaaagttgtctggggtcctagagcgaggaaaacccagaggcaaaggtaaatacaagaatgggtgccacccctcccacacattcaccataaaagccttagatagtgacaaccatgcatagaaaacaatgtgatcactcagcacagcagagagcaggcagtaactggtaggggcacatggaggactaggaaattcctaccaagggccagggtggagggctgattcttgtgcagcagagacattctggtttaactagttttgaactgcatagaatttagcaaccttcttcctacctgcagagtcagctacaaaagacaacctatagggtaggagaaactatattcaccatacaagtaagaaatatagattggttggttggttggttggttggttggctggttggtttgtttgtttttagctttatttttcatacatttcacatttgtatgttggttttgggggttggggtttatttgtttttagctttttcttgcttgaataaaatcttataactgacctttctttttctacacctaacctatagtaatttcgctcataccttcatctctattttactattttactcctgtttccctcttccccgttcccttctccttttgcttcttaattattaatattgaatatccttaaaaatacactacatttatcctaatggtgttttagttccattttctaatcttattggggatataattgaagtacacaaataatttttactgtatttaagtacagccttgctgtcaaatcactgtttcagttacagctgcctgttccacacactaaatggcagtaggactcattacctcaactaaagactatacataaaaaaagacataaagtaaagggaataatgaatgcacagaggaactcagaatgtaactcagtggtagatttcattcctagcatgtgcaagccagtggtcaattatcaatagtgaacaaaaaagtgtaaatgtaataataaaaataacagctggagaacatatccttctcaatagatacacaaatcacaacaaagagacagaaaatatatgagaaaacagtacttctaaaagtccacaagacctcaataatagagaacaaagataatgaaatagccatcatgctagaaaaaatagtttagaatactgctttttaaaatgttccatgatcacatagcagacaaaaacaagaagatgaatgaaatatggaaatcaattcaggacctagataagaaagttagcaaagtagatgaaatatagctttttattgttttgaaatttcctacaaaggcagacacatcacagtaatatcacagccttcatcagcaaccctaaaggccaggaaagcatgcaacgatatatttcaaattttgacaataatcaacttccagctaagattgctatatacagcaaagctatcttttaaagttggcagcaagatacagtcatattaagccaagcacatgaaacaatgttgaactgaaatttaaaaaaaaaaaaacttggagaaaaaaaattgagcaaggtgattgaaattttgggaaaaaaaaaaaaaccaaatgctagaaatgaaagctaatcaatcaaataaaaaggacatgataaaaccttaacccacaagattaatgagggggaaaaagaacaccaaggatggaaacaatgtcaaggtaatatttcgttcaaatatcaataaataaaaagaagtatatacagccacaacacctaagaactcagctgttggatcaagagaccaaacttaagaatctatatgacatgaagaggaactgagattaaaacaaaaacacagaaatatgtttcattgaaattatatcagaaaatttctcaatcataaagaaatgaatatccaaatacaagaggcatttaaaactacaaatagacacaactagagaagaaccttcccacaatgcaggcaaggtgacatctgtagtggtgacaaagaaaaaaaaccacatacctacaaagctataaaggcaaatctatcagaatagcaccaggcttctcagcaacccaaagccaggaaaagaacatactgatgtattttgagtcctgaaagtaaataactgccaaccaaggttgctatttccagcaaagcttatttaacattgaaggaaagatagggagatttcaagacaaatgcaaactggagtaattcatgaccaccaggatagcactacagaagatgtttgatggaatcctaaacacacaggagaaatacagtcttcatcatagagtacaggaaagaataaattttataaaagaaatggataaataaaggagaacaaggaaataattcatcaagccaaacagaaccctaatcctagtagaggaaaaaaggaacaaacaaaaatttaaccaaccagaaagacaacgaacacaattggaaaaactagacacatctctttcagtaattgaatataaatggcctcaaatctccaattaaaatatgtggaccaggtgactgaatccaaaaacaagatcaagctatctgttgtctccaaatcatgtgccttgctgtcaaggatacttaaagattgtcagaggatcgaaataaatttatcaaacaaattgaagcggaaaaatatctgtttttgatattcaaagaaataaacctcaaacaaaaattaaacagaagaaaagaaacacctcatctcttaaagatacagcaattataattgcacattaggactactagttttatttaaaaggtgaaaataaaatgtaacacaaatcttgattaaaatgatagtaatttcaatatccacttcttatctgtagataggtcatccaaactaaactcagaattaaactacaacatatcaagtgagcataacaagtatctcctggtttgtgtattcagcagaatcagaatgcatattagtattagttacttttctgttgctgtgatttaaaaaaaaaaacaagttggtaaggaaggggtttatttggtcacaaatccatgtcacagttcatcattaaagcatgacagcaaaaattcaaggcaggaaccacaaagaagtgtagagttagggtatatgctttgagttagagtttaatatggtagtttatcccatagctaggattgacaggtctagtgacccataaggaaagtttttacttattatccctgggatcttatgctctagactagaagttttggttccagagtaacaaccacttctgccaagagatactggcagactaatcacatggaagctagaactatctcccagctatttgggctcttgatacccataagtcaatgggataaaaagggaatagtattgttaggacaggtgattcgagactttcagtaattagtttgtttttttcacagtgaagataaggaagattatgtctagagaacagtagattctttagggtttctcttggtgttaccatgtcttgtgataaaaataaaaaataaataaactggaaactataaaaatccaatccagacaggatgacaaaggggctagaccattcagtgatgaaggtataggtcatccttccagggaaagaaccatgacctccctacataggagcttgctgaaagtagaggaaatatagaatggatagtagagcaaggcagataaataccagataaagccacatgatcggttgcagaaacaaggattataattgacatgagtatttttctaagaacatgtttgtgcagatatacacatatattaaggtgacatttgcatttccctctttttctttatcatgtaatgtaacataaattgagataatatcagtagttaagtgttgtaagtctatagtatcatatttaggttatgagacactgaaagacaagtattcctcaatggactttgcaacctagtctaaaaatatatagtgtgttggcactttcacatgcgatagttataacatcataattggaattatgaccttatttttttccatttaaaaatgaagcatgacataaaaaatgtgattggaggctgttagtggtggctcatgcctttaatcccagcactcaggacagaggcaggtagatctctctctttctctctcttttttaattagatctttatttacatttcaaatgttatcccctttcctggtttcccctctgaaaacccccctatcccctccccctccccctgctcaccaacccactcctgcctccggaccctggcatcccctacactggggcctagaaccttcacaggcctcctctcccattgatgacctacaaggccatcctctgctacacatgcagctagagccatgagtccctccatgtgttttctttggttggtggtttagtccctgggagctctgggggtactgggttagttcatgttgttcctcctaaggggctgcaaaccccttcagctccttgggtggcaggtagatctctgagttctgttacacacacacacatacacacacacacacacacacacacacacacacacacacacaaatgtgattgggcgtcatgttgataaaggatggacttgtggtggatattcttagttgtcaacttgactggttctagaatctactgaaatataagaagctggcactccttttaaggaactttcttgatcagatttttttttttttttgaagaagggagatccatcctaaagtgggtgacaccttctggtggcaaccaagataaaaggacataaaagaaaactttggcttttttcttgcttgccttcacactcactggcaagttctcctatcttgttttagtggcattcattcactaatatcagaacctgcttattcaaactttcattgtttcctgaagaccaacaaccctcctaaactgcattctgaaagccaatctaaacagcaatttttaactacttacaaaatcttcctttaaaagaactcattctaggccagaaaccaagctctaatgaatacaaaagaaacaaataatttcttatatcttatcaaagcatagtaaaacaaaaccagagatcaatagcatggaagaaatgaggacactatataaacaagtggagaataaaaagtatacatttgagtgactagtgtgtcattgaaggaaataatttttttaattcctaaaatcaactaaaactgaaagaacaatttatcagaccctttgggatatagcaaacgcagtcataggaaagctcataggtgtagatattcacattaaaagaattaaagtcatctcaattaaagaacttaatcatgaacctcaaactcttaaaaaagaaagaagccaaactaaaacctagtagatggaaaagaataatgaagatgagggtgggtattaatgaaatgaagactaaaaaatcagtacaggggattaataaaagaagaaataatgtccttgaaaagtaaacaagactgacaaagccccagctaaactaaccaaagaacaaaaaaatcccaggttaataaaattatagataaacatgataacattacaacaaattctcgtgagatccagagggtcattgaaaactactgtcctgaaaaactgaaaaatcaagaaatggataatttcctagatacaaacctaacaaaatgaacttaagagtatataagacattcaagcagatctttactaaacattggaaatgaagcagtaatattctctcaacaaataaaaattcagagacacacaggtttactgcttttttacatatcatcatcgttgttgttgttgttgttgttgttgttgttattattattattatatttgcatcccaaatgtttcccccttcttgtcccctccttcagatcattctccctaaccccgagcccctttgccttctagagggttgggacaagaaggggtaaacctttgggtatcctcccaccctctggcatcaaggctctacaggattaggtacatcctctcccactgatcgcagtgccagggacttgggagcagcccttttggttggtggctccactctgggagctataaggggtccaggttagctgacactgttgctcttcctatggggttgtcatccctttcagcttcttcaatctttcccctaactcttccataggggtcccaacctcagtccaacgttaagctgttaagtatctgcatctgtctcagtcagctgctggtaaagcctctcagaggacagccacgtctgcaagctcatctatcttggcatcagtaatagtgtcagggtttggtctctgcacatggaatggatcccaagttgggccagtcacagagtggccttttcttcaatctctgttctactttatccctgcattttcattagacaggaacaattttgggttgaaatttttgaaggtgggttggtgtacccatccctccactgggggccctgaattctgctttaaaaaaaaaaaacatttatttttttattgttactgtttttggtggtggtggtggtggtgatggtgtgtgtgtgtgtgtgtgtgtgtgtgtgtgtgtgtgtgtgtgtgtgtgtgttaggggtaggggaggcaatgtctataaacatgcgtataggtgtgtagacaggtgccaggcacagagtgcctgtagaggtcaaaggacaacatccatgagttaattgttttccctcattgtggggattccagagatggaattcaaggactgtcatcgggcttttgattaaaaacattaaataaacagaagtatatggtttctctttttaaaaaaaaaaacaatggtggaattttcttaatccattgcagcagttctttagcacttccaatttgttaattggacccttgtagatacttaaatattagcagattgtctttaaaatgtatttcatttatcttaaataaaagttgttggaaagtttttggtgccaatgaagatctaattgcactaggtttggagttaagaggtcagactcattgtctttttttctatttgctggctgtgtcactcatctgagaatgataagagttgcacttcttcccttgtataagacaggtgctttgtaaattatgaagttccatacatgcggtgggatcagaagaaagtcattaaatttatagaatttaaataccacccctttgagaaaaaagaaaagcaagagttagagacataatgaaaaataaatacagattgtcctaaatattatcctaatttttggttcatatgcactaagaacagatccatggtctaattttgactcaattaagggggagagtttcaagggttgaggaaatgttgaatagtctcatatctgttgaaaatagactgttcaaaatatgtattgattgctatcactattttctgagttctgaaaggtacaaatggacttttaattagcccatgttacagcactgatgggatatgagctttcccactgctgctgttgtattatcatgatcaagctgtttgtgtacttgttgcaatttcatgttcacaagcatgttgggaattttgtgcattagcagagccactcagcactcctgggcattgtaaccctgttcctcaaacttcatctttgaacagtattgaaatataataaattaatccataagattcccataagcctaaaggttctagaagaggtcctagaagaatgtccattacacgtccccatcctttaactatttgaggttggatttctgaccagcactgtcttagagtttctattgctgtgtaacactatcaccaaaagcaacttggtggggggggtattttattacacttccatgtcattgttcattatggaaggaagtcagttgggacaggaactcaaacaggccagcaacttggaggcaggaactgatgcaaaagccatggaggggtgaggcttaatggcttgcttcacaagacttgttcagcctgctttccttataacatccagaacactagcccagagatgacccaacccacaatggactgagccctcctccatcaatcactaattaagaaaatgcctgacagctggatcttatggaagcattttcttaattaagattctctgctttcagatacctctagtttgtgtgtcaagttgacataagactagccagcaccaccacttattttttctatataagaatatttgtttagctagaacatccccatatgtgcttgtgtctccaaagtttagcaagcacattttattcgatcctatataaaactggcaggaaatgataataaaacctactgtaataataaccagtgatttttgcccaccaccacctgacattattgacatgtgctacagtccagctccatccattctttcccagaagtggcctcagaagaagtacatttgtcctcttcaggcttagatgtgtttcttctgaaatatgtaattgaagtcttgatgatttgagaaggaaatgagggatgtgaaaataaataattaccaccagttggtaacctcataaaacttagcttttcatggaacccataaaatagcatgcaaagtgtattcaacaatagatactctcttaaaaatctccagacatcttcaaacacattcatgtattggggtaactttagttcaaacatagtttaacatgaataaaatttcagtaggcatctttaattggaaacagaaacgttgcttctgtggcagtttgtggagaaccattcacaactagttttgttacagttcattttagtgatttttctgtatatggcagcagagatcaaatcaaggctttgtacattctaggtaagcactcaatcacctatgctatagcttttaaaaatacttcctttatttttgaagattatagtcatatcatttcccccttacctttcttccttctaagccctcttatatactccttcttgttctctttcaaatccataacctttttaaaattaatttttgatattgttgttattgttgttgttgttcttatatgtgtgtgaaaaactgaagtagcccgttcagatgatgataacagtggaaattgtgcctgttttattggttgactgatgagttgaagttttcattaaaggcacaaagcttatgaatgggttttatgaaaaagagagtaccgtgataaggattattcatgtttactaagatatctaacccaaggctggggagatggctcactagttaagagttcttattgtgcaagcaagaaaaccttagttcaaatccccgaacctacagaaaaagccaagcataatcaagtgcatgcctataactatagccctgaagagggcggagacaaggagattcttgaggcttgctggccttcagtctaactataccttgaatgagaggtactgcctcaagggagtaaggtggagcatgacagagcaggtgccctcctttgacctctttgtgggaatgtgcacacataacacacatgcacatacaacacacaagcacacgaagaattccaagccagaaatagagaaaaatgcacattaacatcaatgaacaaagttttaaatattgccagcctgttcgtagattatgctatacatatatgtttagacaagtgttatttataaaatactgggagaactaaaaaaaatcaacatctgatttttgattaacatggaataaaataaggtttgctaaggggcgtttcatgccttaataaagtttaatttatatatagattaatttaactacagcactaatcacttctaccccctccaaaaaaactgtttcatcctacctgcttatactcatattaccttgacttcccttcccatggctaacctcttctccattgttttcttttcaaaatatagaaatatgtacaactgtataaacacagcttgtaatgtttaagtctgcactagttactttttggttgttgtgacaaaacaccatgaccaagacaatttataaaagaaagctcttaattaggattacagtttcatagtgtgagagtccatgatggtttgtgtgttggcatgattgtaggaatagctgagagcttatatctcaaactctaagcaggagacaacaaccgggaatggcgcaacacttttgaaatcccaaagctcaaccccaatgacacccgtacacacaaagcttcacctctttatcctttacaaatagtttaggcaacaggggaccaagtatttaaacatatgacccatgggagccattctccttcaaatcaccacagagatgactgtcatgaagcataatacctttgagatttctctaaacttttgcaactaacacactggaggatatctagggatttttttccagctttgggtaattatgaatagaattataaaacattcaagtgtatttatgtattttcacttctctgggataaatgcctaggagtagaatttctggcttataaggtaagtgtatgtttaatttcaaaagaaactgccaaactattttccagaggagtcatttttcattaacactggtagtacaggagaatggcaattgtttcatacttttccaaatatttgatattctcaatatttttcctttaattttagccattgtagtgggtagttaatgatttgattttaatttaattttgcatttaatggctaatgatattgaccagttcttcttatattaaattacttacttttactttgtaagctaagaggaaaatttaaattttgatataaataggaatttagaaaaattttggttggacagcttcatgtatttatgtaataaattttagtcattttaaaaatctttcacccctctcctgctggaacccttgacaacaagtcccatactacttccatgtcttttgtttgtgagtcactgtgcttaattagtttttgttgttgttgttgttgttgttgttgtttgtttgttttctcagaacatgcctgggaagttatttattggagtaacttattatcagtggttataatactgagaaaaaatggcacccctctcccaacaactattaattgccaatagtacctcagggaaagtagggcatcaccaatccctccatgaatgggcatttttaacatcaaaaaagtaaatagaatcataatggtgatttctaaaattagagagaaagagaagagatggaggatgggtagaagattctaaaataaagtttgacatgaagaatggagtctagtattctaaagtacattaaggtaaatatagatttcaatatcttatgtattatatgcataaagccttaaagataggatttttgtagagtcagaatataaagaaacattaaatattaaagaaatggaaatgctgactaccctttgatcattacatattatacatgtatccaagtatcacactgtatttcataaatatatacaattttgtgtcaatggcatttttttttaaaaaatgtaataaataaatgtgccttcatcaaaggttcagggcatcatgttgactattctcattttaccccaggctaattgaaatttgattgtgaatcaacactgatctactgacaagactttagaaacccaactgttcagtaccaggttttgttttgttttttttttgttttgttttgttttgttttgttttcttttttacattaaccttattgctatcagaaaatttagtgaatcccaccagagttaccacatgttgccaggaaatttagggtccttccccaccgccaacttcttaatttcatgaaggaaataatttaaaatggactgaaatgaaaatgaaaatgaaaaagacaatattattattattagagtttaaatgaaaatccccccaagtggatcttggcagttgcccaaggagggaaatggagaataagaagagtgaaatccatgctgtttttaagcagccacattgcagacaaacaggtacaaggcagaaaggaggacttcaaagaaagaggaaaaaccccaaagaaccaaagaaagcagacttgggctgtgaaagagaccaaagagagaaaaaaggaaatgttatatctttctgaaaagtgaacaggcttaacacactctcatggtgactctatagcagctacacccagaacagtgtttctaggaaggacatgtctatttttcctgtccgtttagcatggcttcaaagtgaacgtggcttcctgatgggtcatgcctttgccaggaactgactggtaactggattaactcttaagagagaaaacagtagactgcttctacccagagatagacgccattctttttatacagaaagaccctcataggtcttcagtactactgtaacaatgggtcaacacagttaattcagttttactttattggctctgtgcaatttaccagagtcatatgcaaactttctaccatgatggctgaagtactttataatttttctttctattctttctatataaaaatttccttcccttttgagatacttgggagggggaggcaaaaggatcagaagttcaaggtcatactctttctacatatgtggcttgtggatagcttgggatataggagactctgtctcaaaacaaagaaaataaaccaacaagaaataaataaatggatactaagtctgaggaaggaattcagatccttctggccttcttacctgcaacatatccccacatagtaccccctattattctctcagccacatacctcaggactgtacacaagacctaaaaatcagtagacaagtgtcctcccagtgtactatatctgcattttcccttctgaaacagattcttgctatgttgtccaggttggccttccactcataatcctatctcaacctcccacctgctggaatcccaaatccgtgccaccacttctgactctaccttacttactttactgtctctatgtaatcccagcttcatctgtcgtttggaatgttcagcaaacctgcttatatcttactttgttaaactgttagtgattcacacagtatattctaaggagcacttgcattggaatatagtggaatttctaagtgtatgggctcctgtgccttgctatattgaagtgctcaattagatttttcagaaatgggtctcataatgtacatttttattggatattttctttatttacatttccaatgttatcccccttgccctgtttcccccagggaaaccccaacaatcccctacccttaattccatgagggtgttccccccccactcacctgccccactcctgccattccaccctggcattcccctacactggagcatcaagccttcataggaccaagggcctctcctcccattgatgcccatcaaggccatcctctgctacatgcccatcaaggccatcctctgctacatatgtggctagagctatgactccctccatgtgtactcattggttggtggtttagtttctgggagctttgggggctctagttggttgatattgttgttcttcctatggggctgcaaaccccttcagctccttcagtcctttttctaactcctccattgtggaccccgtgctcagtccaaggttggctgcgaggatccacctctgtatttatttgtcaggctttggcagaacctctcaggagacagctatgtcaggatcctgtcaccaagcatttcttggcatccaacatagtgtctgggtttggtaactgtatatggggatggaaccccaggtcgggcagtctctggatggcctttgtttcagtttctgctccacattttctctccatatttcctcgtgtgagtattttgttcccccttctaagaagggctgaagcatccacactttggtcttccttgttaggtttcatgtggtctgtgaattttatcttgactattccgagcttttggtctaatatccacttattagtgagtatatatcatgtgtgatcttttgtgattgggttattttactcaggactatattttctagtttcatccatttgcctaagaatttcatgaaaatgtttttaatagctgatttaaaacattgtgtaaattgtccattgtgtaaattcctctgttgaaggacatctgaggttgaccacgctcctgtggtcattgccctactgcaactgaggcggcacaaactggactcagtaggttatagaaaaaaaaaggatgtaaagttgggaggtggacagtatatttgggaagagttaggggtaaatatgatcaaaatatattgtatgaaagtctcctacatttagtaaagtattggtatttaactactgtaaaaaaaaaaaaaagaagaaggacatctgggttgtttccagcttctggctattataaataaggctgatatgaacataatggggcatgtgtccttgttatttgttggagcatcttttaggtatattcccaggaggggtatagctgggtcctcgggtaagactacatccaattttctgaggaatcctcagactgatttttagagtggttgtaccaccttgcaatcccaccaacaatggaggagtgttttctctttctccacattctcaccagcatctgctgtcacctgagtttttaatcttagccattctgactggtgtgaggtagaatctcagggttgttttgatttgtatttccctaatgactaaggatgttgaacatttctttaggtgcttctcagccatttgatattcctcagttgagaattctttgtttagctctgtacacccgtttttaatagggttatttgattctccggagtctaacttcttgggtcctttgtatatattggatattagctctctatcagatgtagggttggtaaagatcttttcccaatctgttggttgtcgttttgtcctattgacagtgttctttgccttacagaagctttgcaattttatgaggtcccatttgtctattgttgatcttataaaataagccattggtattctgttcagaaaattttcctctgtgcccattggatttgaggctctacccctctttctcttctattcgtttcgatgtatctggttttatgtggcggttctttattcacttggacttgagctatgtacaaggagataagaatggatccattcgcattcttctacatgataaccaccagttgagccagcaccatttgttgaaaatgctgtcgttttaccactggatggttttagctcctttgtcaaagaccaattgaccataggtgtgtgggttcatttctgggtctccaattctatccattgatctacctgcctgtcactgtaccaataccatacatttttatcgctattgctctgtaatacagcttgaagtcagtgatggtgatttcccttaaaagttcttttattgttgagaatagtttccggtatcgtgggtttttgtttatttgttatttcaaatgaatttgcaaaatgctctttataactctatgaagaatttaattggaattttgatggggattgcattgactgtgtagattgcttttggcaacatggccatttttactatgttaatcctgccaatccatgagcatgggagatctttccatcttctgagatcttcaatttctttcttcagaaacttgaagatcttgtcatataggtctttcacttgcctggttagagtcacaccaaggtatatcatattatttgtgactgttgtgaagggtgtcatttccctaatttctttctcagcccaattaccctttgagtagaggaataatcctttgagttaattttatatccagccactttgctgaagttgttcatcaggtttaggagttccctggtggaatttttggggtcacttaagtatactattatatcatttgcaaacaacgatattttgacttcttcctttccaaattgtatccccttgacctccttttgttttctaattgctctggctaggacttcgagtactatattgtataggtagggagagagtgggcagccttgtcttgtccccgattttagtggaattgcttcaagtgtctctccatttagtctaatgttggctacttgtttgctgtatattgcttttactatgtttagatatgggacttgaattcctgatctttccaagagttttaccatgtaggagtgttgaattttgtcgcatgcttcctcaacatccaatgagatgatcatatggtttttacaagtgacacatatatgatcattagacacaactgaatataaaattccatgaatctagatgtacatcatgtatgactctcagtcacaacaatttctcctttctatgaacaatcaaagtctcttttttatttacacatgtcagtaatcttgtttggtcatttcatctgttgtattgttttacaatttaaatgttaggtgtgacttaatttataagccactgaaatacagggattctcttcatatcttgtttattatgttgcttaatatagtgtacataatgtgtatatatattaaaaatttcatatatacacataaaatagtgtgtgtgtgtgtatatataaactttgtacacatttcagtagtggagttatgagatttaaggagaacaattgtttttaatcatttttcaaaggcatagttactctgtgaacaatggtgatgtaaagctttgagaattttgcctttgattcaagatagtttgtactccaagtgctaaattgatttacgcctttgaatattgcattgacacttcaaaatatcttaaatatttgtgatatgaaggggtgatggtgtaccatattcgttccacttgttctttgctatttcaatcataccatcaacattaccatccaccctcccttgctggcccatgcttttcccattatacaagtcccacagcagtttccatctcctctgacttattgttaccacttaggcccacaatccacatgattccccttaccagtgaatctctaatatttcctgttggtggttctgttttgacacctaacatactggttggtaacttgctgacttttcctcctactcattcattgtgaaactctccacaaattaatagcatgatgtgcaagctaacacaggttcctggctgctaaaggttagaaactacttttttaatgctaaagaaattaactaaacttgagataattgttgatgggtagatagcaaaagatgccgcaattcaagttttcaaagaggaaaccaccatggaaatattaaacataggcaatctactggggcattgctacatctacatgcacttacaataagattcttaatttgtactttataatgaataatgatatgagggtgtgattgaagtaatatctttttgttttttggtttttttttctgaatggtaatctatactaggcatagtcaaactgttcatttctggcatcttggtatttaggaatagtttttgtatccaaatccatcatgtgatgagtctcattggttactaatacaatcctgaaaaacagatggcttttgctttggcctgctggtcacaaatttggaggtgtggcttcatattctgaaggacaagatgatcataaatagtatcactgtggcttgttagtagaggtgatttgactcagattatatataaaattataatattatatattatgtatatgctatttttcaaggtacaatggaataggaatggtgtgagcctctgtcacttcaaattttctttaggttagaggatactttatccaacccacaaatctaggaatcacatttagtagttcctttctctggttcatttactctaattacatctaataaagtcctgtgctgtctaactccataccatctcttaattctgtgctctgttcccatatacccttactgctactttcttacttcatggttttctatttcaccaagattggctacttttcagctcttggattgatagaataaaatttgggcaaaagaatacaatggctttctgcttaagcatagtagatggacttcctgcttctgccatttactagaagtttaaaatagaaataaatggataaaaattcctaagaataaagagatgagaagaaactgattcacaaagaaaatataaggaagatggaagagagcaagtattaactacctgttatagaaaacaatacttcaaaacttagtgatttaaaatggcacaatatttagagctctttcctctgaatattgaatttcatatgaatcatttattttcctactatataggaaatggaaaatagatagtatttgacagtcaggaatctgatagttgtttagtctggcacttcagactgaagattgtgcacaggaatatagtgagaatagctatagtcatagataaagctggagaatctacttctaggttccatcataagcttctttgcaggaagcctcagttcctcaccacatgtgtctaatagacagtcagcttgggtcatcttacaacatgacacctggcttctaacagagtaagtgatggaaaagacaaacaaggatgaagccagagtactcttcaaacctcacctttaaacttaacagcatcatgtccgctttattctgtttattagaagaaagtgattaaatccaactcacacatgagaaacatcaagtttcacatactgaatgaaggaatataaacactcgtgggcatacattcaaaccaccacatagtggcaactaagttagcagaatataataactataatatagatgagttcacaatgggtacttattaaaaggagccaatttttccctgagagatttttttcaagcattagcttctacaatttagagtgatgttcaaggctgaaaataaagcattgcttgaaatccacgtatgagagagctgatctctcatgtctcttcacctccacacaaaccacatcaccactagcaccattaggaaggagaatggagctttagtctctaaaacaattaggtaaaaatctccatgttaagagatgacaaactggatgctagtcttctcttaaaatgctgtgcattaaattatattccttaaacctcttttccatttcctatgtagtaggaaaagaaatgaatcgtaagaaattcaatattcagagaaaagagctctaaatactggtatatatacccccaatcaaataaatgtcagtttattcctaatactcccacagaatgataatccatcggcagttccaaccgtgcacacaaggcatataaccaaggattagcagatagttaaggaatccttaaatcctaaaaataggctaaatatcactgaaacagaacaaaacagttgttggatggtacaggaaattgcaaaagctattacacatgtgtatatatctctacaacacacatatgtatatgtataaataagataattgtgtaatatatttaatattggattaatatgtatttggggatgataaaaatggaattagctggctgtgatggcacatgcttataatcaaggcacttgggcattggaggcaggaggattgggagttcaaggacagcatgggctacatagtgaaaccctgttttacaaagtcaaaaactaagggaccaagctctaaaatttggataatcctaatatatcattgcaacaactgacagctgcatttatgttgtacaacactatcattctacttgattgtcttaaacaactaatggattgacctgacatttctgctctgttctgttgtgttctggaactagcttattaaaactaaatttaaataatatattttgattatattgttttccatcccccaacttttttccatctacatattcacccaatttcgtgttctttctctctggacaatgtgcagagcttggaagactttggaacattcagttctaagtgagctctttatcacacccttcccctcaaggctcaggaatctatgtgaaaaaggaggcagaaagattataagagtcagaggtagtggatgtatccaaggaaacagcatcatttagacacagagggactgagcccatatgaactcatggagactgtgggagcatgcataagacctgcacagattcaaaccagacaaaaatctcagcacagaaaaagaaggggaagtcaacacaaagttgcaaccctggccaagaagctttttctgttctttatttacagtatttaaagaaaaatcttcgtgtgtttctacgcactaatgtaagaaatggtttctaggaaggagctaatttaattgatctttatttcactgttatctttaatgcctactttattgggataatttatatacagacatttagctttttaattgtacagttttgatatttgaacaactcatagagccatgtaatcagccttgcaatagttgtataaaattaccccatcacccataagttttgtcaagacccttttatagacagcttttacacctatcatcagttctttataaacacttatccttttacctctaggttcaccttttccagaccatcttaaaagcacacacatagtgtatactgttttatgcatctggctttttcatgtagcataattcatttgaggtccatccatgtaattgtgtactttaactattcatcatttttgttattgtatgagattccactttatgcatacaatgcattgattatcagttcaaggatatttagactgtttccaattttttggggagtgtgtgtgtgtgtgtgtgtgtgtgtgtgtgtgtgtgtgtaggtaggtagatatttgtgcatctttctgtatgaaagctaaagaacaatgttgggtgttttcctcagtcaagtaaactagactgtctggccccaggaagcctcctgtctgcacatacctagcactgggattacaagtgtacatcgccatattaggacaaacgctttactgcctgagccatcttcctagccccaagctgtttccaactgtcaatgattataagtacagcttttataagcaaccatgtatgagattttgtaagcataatttgtcatttctcttgtaaatacataggagtagcattactagattgtatgaaaaatgtgtgcttaattttagaaggaaatatcagctattttccaaaatgaaaataccacttatgtatctatgaagaaatgcataagagatactattgctctttattgtttccagcactaaattcttagctttttgttgagcattattattagtacaataccattcaaaaattcctacttcatgaatcataacctcaaacattttaaaatctacttgtatttctattgcccatttttaatatttaggtttgtttatactgagttttgagagtccattgtttgttttcttttcttctgcttttctagatagaaacaaaccctttaaaagacatatgatgtgtaaatattttgtttaagaaaactcttgttttcttagaagtgactttagaacaatgggattatataatagttttgttggtacggtgtctcactctgtagcccaggctgaccttaaactcctagcaatagtcctacttctgcccattaactgtgaattatatgaaccaccacctggtttgtcatagtaagaattttgttgaaatcagttttatcaagttgaatctcttagagattgcattttggatattgtatcagttttggtgtgtggtgtgatgtgtgtgtgtgtgtgtgtgtgtgtgtggtgtgtgtgtgtgtgtgtgtgtgtgtgtgtgtgtgtgtgtgcgtgcgtgcacgggcaggcattcagaggccagaaccaagtctcatgtattgttccccaggaaatgtgcacttagtttttgttttgtttttaaatcggatcttctagaacctagagcttaccaaatagtctaggctggctggctagtgagccccagaggtgagtgtgtctctaatccccagtggtaagatgataagtgcaaaataccacacccagctttttctgtgggggctggggatcatacgcaagtgctaatgtttgcacagcaaatactttacctactgagttctctctcagccactatgtgccaaatgaggactacacagattttctttttagttatctatttatatctttatttgatacttctttattttaatgtaaatataattgcttcattttctctcttccctgtcctctctccaatgtcttctattcccactttcccccaactccctgtcaaaaatttaattctgcttatttttttgttattaacacacacacacacacacacacacacacacactggtggaatgagatttcaccaatgagagagagagagacacagagagagagagagagagagagagagagagagagagagagagagaatataaatatgtatattgtgcctggttatgagaatgggaccagctaagctacaacaaatggaatataaaccaaattctttgtcctattgagttaatataggaaacacatatgtattgtcattaatctttttagacaaaagaatgtttttgctagtcccttgacctaatcaccctgtactttggaaagcttggctctcttacacgtaggataagtgaaggaccatattgagataagaaatatctcatccttgtcctgggtaggtgatataaaaaggggggagggtatctccaacaacaactgggtatagcctgtaaattcctggtgaggaaaccagtgttgaaaaagccacccccatgctggcagtagtgtgctaaaggagatgggacatgaacttgctctctgtgcatcagaaaatcctcaaggtgtggtataaggcaggagtgactttctgcctcaatgactgaattctatcatttgtggtgacttgcctgataagaaactaaaccaatggatatcctatccatgaagacctagagtggcaggcttagaaatcagtatatatggctataaataaaccagagggaaagatgggtttatactagaaaattgcagagaaaattagacagaaatgaatagaagttttgaaaatttattttgcattgagccagactcctttcaaagaggaaggtttctggtagcgtctagagccatggttctcaaccttcctaatgctgtgacccttaaatacagttcatgttgtggtgactcctaaccataaaattattttcattgcacttcataactgtaatttggcgactgttatgaatattaatgtaaacagggtttttttttttttttggagatactggtttgccaaaggggtcatgacccaccagttgagaagcactgatctaagagtctgttctcttcagcattacctctgccccctactgtggcatgtttagtatacttggatgaaggatcttcactcttcattcactgcttgaagcaccaatactatatgcagggaccctcttggtgctcactatttcagtttagcagcctttacaaacagtgatttttgactgctctatcaggctcctgtcagcaaaatcttgctgctgcttcttcttcttcttcttcttcttcttcttcttcttcttcttcttcttcttcttcttcttcttcttcttcttcttctcttctctctctctctctctctctctctccctctctctctctctctctttcaagacagtatttctctgtgtagacctggctgtcctggaactcactttgcagaccaggctggcctcaaactcataaacccacctggctctggctctggctctgcctcccaagtgctgggattaaaggagtgtgcctccacaccaggccttgctctttcaattagatattttctttatttacatttcaaaagttatctcctttcctagtttcctctctgaaactcccctatcccctccctgctccccctgctctccaacccactcactcctccttcctggccctggcattcccctacactggggcatagaatcttcgcgagaccaaggaactctcctcccattgatggctgattaggccatcctctgctacatatgcagctagagacatgagtctgaccatgtgttttctttgattggtggtttagtcccagggagctctgggggtactggttagatcatattgttgatcctcctatagggctgcaacccccttcagctccttgggtactttctctagctccttcattagggaccctatgttccatccaatggatgactgtgagcatcaacttctgtatttgccatgtactgtcagagcctctcaggagacagctatatcaggatcctgtcagcaagcacttgttggcatctgcaacaatttctgggattggtgattatatatgggatggatccccaagtggggtagtctctggatagtcattccttcagtctctgctccgaactttgtctctgtaactccttccatgggtattttgttcccccttctaagaaggaacaaagtatccacactttggtcttccttcttcttgagtttcacaaacagtgattttttttttttgattccagaagtaccaggagaaaatggattgtttacattggagaaaacagttaaatattccccatttgtcattacattccttttcagtggagggcaatgactgatattaatctggtggtttagaacagacaaatgcctctgttaaggggtaagtctgtctttaagacttaaatttagggatgctttttgttaatctgtttgtactgacaagtctcctggtgtacctagtttacaacagaaatagtgatgtgaggatagataggttactggtttcacctgtttatgaggtcttggcgaagagatgccatttcactggcttcaatcctgctcaatttatgtaaagatcataatcttgctttccttgaagaaatctctctgtatacaaaacataacaacagccaagtacaatgtcatgttagttctccaaagagcctttgagttctagggtttgcttctttgctattattcaactactaaatatgtagtagttaagctttcatcaataaaataagcatatttgggcaactttaactttctcatccatctgttgaaaaatcttagcctctcaagggagagcaagtggagatggtaacaaagcccagccattgcgacaccctctactaaacaaaatgtcatggcaccacagaaaaataactaattattaaaaagacacttaacatctgatttggctgcactcttgcagctagatagattctttttgtcctgaaaaatctttaaagactagctcttagaggctgatcctgagaagttgttgcaggggagggagttccttcccagtaccccattttcactccatatccacctgtcccttactagataccgcctttcattaaaaaaagggaaaatgcctcaggccttgcatgcggggtgatagtgatccttccaaggtcactgacagcaatcatgatcttgttattttctttaatattaaaacttagagtcttagaagagatttagccattagttctatccctactagtacatcaaggctctgtcctcagcctggttgccacagttgcttagctagatttcagatccctggcattatattcttctttcatccacccaaatcaatttttctgttctttgccccagctctctttactataatcacaatgcctaaggatctttacttgaagggaggagatttgtgttattatttctctttaaagttaattcagcattgattccatttttaaaaggctgtatacgttgccattggaagatctctcgaatagtgtagttccttatgcaatgcatattccacagattaaggcaagtatcctagattccaaagcaaaaccagttctcccatcaggagcagagcataactgcttatctgtactgcctgagaatacaagggttggccagttgctatatacacttaggtctctcattccaaactgctgtataatggtgaatagaggatacaagcaacaagtgtgtgttcaagactgtttaaatttgtattctgctgctattttacatatgtctgagggtaaatatggtctaagggtgtacaagttgagcgctggattagcctccagttaaagttttattttcattttggtatagagattacaattttcagtagaaatgctgattgacttttctcagtgaactcttaagtacctagcaaaagcctgtgcccattagagaaaagaagcatctatcatctctacagtggtttccaacttgatttggtggaaatgaacactagcagtgcatgttccctgccttgctataaagctcaggctgacctcatacttcctatgtagtctaggctgtctcaaactcatgctcctcctctacatataccatcatccttataaccactttaatgttttttaatatttctttatttgtgtgtgagagatacaaagagggagagagagacagagagagaacacacttgtcttgtctgccatggcacatgtgtagaggtcagaagacaatcatgaatgagttctttattttaccatgtgggtcctgggatttgaactgaagttgctagtttttataacaagtacctttacctgctaagccatctcaccagccctgataacaagttgtaatattagaaataaacaatattggtaatgttttgttaaactggttactgaagggtataaggttaaggttttatataatagtataatctttttcctctccctatgagcaggaattgtttacatttctcaaatgattgcctagaaaatatttccacaaaggaatatggtatttcttctatttcgcccaaccccacatggctcttatgtacttatcacctctcctgtgttttgaaaatgattagggagccagaataactggccattccatctgaattgcccacatggacaataggccatgttagtcagagaaaactcctctctgcacctcacagtccattagcttgcagcctttcccataagttaatagaaaccaaactgtgttccctttcatttgtacttgttctctctctctctctctctctctctctctctctctctctctctctctctctctctctgtgtgtgtgtgtgtgtgtgtgtgtgtgtgtgtgtagggttgatgctttttccaaattaaaaaaagcaaggtctcttctaagtgcttgtagaattataagcagaattttagataacatatttagaagtataaataacattcttaggtgtctttgatcagaaaagcagtcttacaactaagcttttcctaaatcatattgcaggtaactgagtgaaaaactgtaggcttctgcattgtatttaaaataaaaagtacattccccgtgtagcaaatagtagtaatagctcatctagtctctcaaaatggaacccagaaacataccccagtacctgtctgtagatcaactttcaaagtaaaagtgaacccataatccatatatttacaatttaattcccaagcttaatgttactaagagatctccattctgtgacaagttgcttttgtcattttcttctttcactcccacacccacctttctggagtcctcaggagcttcacagtctcagagcagaggattctgcatagggtataatgcacagacaccaaaagtgccagaaaacgatagctgccttgaattttcccagcccagtttcagaatggattctacattttcagtatcttctttataagtatcagaccaaagcccagaccaactgctacactgaaagctttcttttcttttcttttcttttcttttcttttcttttctttttttttttttgtaagaggaagcttattgttcttttaagaatgtctcaggaaagttgagccattgcttttggtgggtaagtgtgcttgcagattagtgcatgtgattgcatgtgtgggcatatgtttgtgcttcagctgtgtgcatttcacttttagacaaactcatagcccaggctgctggggaccagatgttcctaaggattcttagaagtaaacagtgacaagtgagcttctcaactcagtattggagtctggctcgaggaatgaggcccctctgtaaatcagagaggagagcaacagcagaaaagatggatatgaaaccacagatattgtaatctcctcagtgaaaaaagttgatccagcaattcccactggatccatacatgttgtaatttattattttatgactttatcttttcctttaacctttgcccattgtacttttgaaaaaatgttgggatactgattataatttttaaaaactgcaaaatatatgaatcagccccttgagtcatttttaaatgttatatgactataattagaggtttttgttatttgccttttgaagacaggtattattattttataaactccagcacaggttagaaagttcactatgaaattaactttatagcatcctattttgtgggaatttgcatgtgagatttttagagttctgagaattttatacatgagcataatatatttacatatccaaccctccctctctccccatatttctctcagagtaccttctgcatgtctatctttcaaattcatgtcctcttgttctataaatgttattaaatctacttagtgttatccatatgtacatgagtttagggataactactttggcatggactcatcaagaggctcatccctgaagaaacctgactgtccttccctcgaaagctgttggtttcctgtggatcttcaagccagaagtagggtcttttgaatctttacttcatccatgtttgaatgtctctcagtatagtctcatgctgatcttgcgcagacaagacactatttagagttcatggatgtggcatctccttcaggtccctctggctcatactatcatttttaatccgtttccattggtaataggtgaagggattatattacaaatctactgatttgggatgcacaccccaccatgacttattctctacattggatgaattacagatcactaaagaagcccgtgtctgctacaaaatgaagcttctttgggaagtgacatacatgaagcctgtgtttatgtatggatttaaggataagtatttagaacggagttagatactctatcagtttagcaaaatgatagtaataggttctcttctagtgtctatgactactccaaccacaggttcttgactaggtttatagtatcagccatgagtctcctattattgagtagaacttaacccatatcagtgagatgctggttaccccaagatattagtgctactattgcactactgaggatatcttgctagttgttactgtagttcacagaatttacaactgagtagaatcagtgatatttttttctcttctgccagcttgcatactaagtaccttaaagtaatcataggaggcttgcaggtccatcccagctctatttatccaactcctgtgaccagtgtgctatcttcagcaagagggtttgactcttttaagtactagcaggcaaccaaaactaacagcaatagcctgtattgttgagggaagtctttagtggcctgtggctaacaacttgcaaggcactgggcttaaaaccagaattcctgcgtcaagtgtatgtgagaatggttcttctgagtgagagaattggattcaattcgaatcaattcccatgcagaggaataaccttctttgaagagaatggaaaatgtgttctatgctgtctcagagaagcccacttcccaggcaccatggctaacccaaaggtcatctttaaatctaattctccaattgaggaggaaattgttgcacctccatgcttttgggcatgtaaaataaaatttcttcacataaaaaaatagaactaggtaactttgggagtcttcccattttgcacctgtagcccatttttggagttggacttgccttgaattcagagtgatgccagaagaaacatttaaaagttacctctagtttgatgatacttggaactctggacttcttgtgtttttctgataccctttatttcttacagtcttcaaatagctgcttaattttattctgtgtaattttacattggcatttagtagaaaggacaggatactatatagtaaccccaccctatgtgaaaccaggacccacctacagatgctttagacaggaaatggtattctgtaacatttttaaaggaattaaattgcaaccattttaaaacattttccagagaacatttctttgtttagacccaggcttctgtctaagattttttttctccatgaagaaatcccttctatatttattgaaatgcaggttttctgatatgacttctgttggtccttatctgaacaaaagtattgtttgatttttattttgaaagatagttttggtagggtggaaagttctgatttgattttttgttgtgttttctgctcccatgccatatggagtgtcactccatgatcggacatagtttctaacaatatgtgctataatcacctttgttttcccataggattatattttctattcctttaggtattgtcaagattttatctgtaattttaaacaatttgatatgtctatatgtttttaaatgatgtttatcctttttggcattttctaaacatcttgcatgtatgttttagagtctttcattgattttgtaaaagttttaaaaaattatttaatattaaattcttttttaattcttttgttactctacatacatatatgttaggtcttttaatatggttcctcagcaattggattttctattttgcttacttattttctgctcttactattcaagtttgtacaaccttcattggtttatctccaaattacctgaggtaattaaaggcattctttgttattttattgattacttttcttgttgctgacaagaagcaacttaaagaaagtaaagtttatttccagatcacagttttgagttgagggagcccaatctggcaacgacctgtggcagtagctccctccaaagtggctggaccatgagcctggaatggtggaggtagaactaagagttctacatctgaaagtgctaggagaagactggcttccaggcaactaggataagcctatacccagagtgacacacttcctcctataaggccacacctcctaatagtgccactccctgggccaggtatattcaaaccaacacaagtcccttcagttttgatcattgaactcccactacaatcactcattaatctctgattatggcattctaggggttctctagccccagttccaaactcttctgcattccacttctaaacttattccaaaggcctatgtagcacatagcaggtttaccacagcagtaactccactttgatactagttttctataacatttgcttttctcatcactgtgacccaaagcctaaaaagaagcaacttaaggggggggatcattttattttggatcatgatttgagaagatatcagcatcataatgaggaaggcatggtggcagacatctctaaaacagcaggagcatgaaactcagaattatcatattttcacttcattgcacagtaactagatatagaatagaaaaactaaggataggctataaaaccccaaggtctgctctccagagatccacttcctgcaactaataccacattccaaagattctacaacattcctaaatgatgtcaccatctggggactaaatgttcaaacacatgaatctatgggggggggcattttatatccaagctgtaacaattattctgtttcaattttttctggtgtgctgcccacctttttcattaatgcctataataatattatgaaaattacttaaattttactttcttgtatattatttcccaaatcaacataattcaattgtttaatattctctctctctctctctctctctctctctctctctctctccatatatatatggaatatggactgcatcaaagtgtttggtggtagttttttttttgtatagagcaatggagattgttataaacaataattgttttaaaggcagatggccatccaatatttgacaaaggcatcaaaacatagactgtggagggaggagacatcctattcaacacatgttgctgacaaaattggatatccaactacagaagaatgattatgtcctgacttttcaccatgcagaaaattcaattaaactaagccaaagaccttaatttaaatcccgcagctgttaaaagaaaacagggaatatatttcaagttatagggatagttcaaacctttctgaaaaggctctaatagaaaagaaaacaggaaatagtcctcaatgttaacaaatggaaatacataaaaccaaaaagtttctacatagcaaaagcagctatcatccaagtgaacagacaacctgcacaatggaagaaaaacctttctgagctatacctcaggtagagtgttgacatctatataaaaaccataaaaagtaaacacacactctcaaaacaacaaaactaccaatcagtaaatgggctaatgaagtaggcagttttcaaaaaaagaaacaaatagccaataagtattgttttaaatgtttaatactcttagtcatcaagaaaatgaaatttgaatgcactttgaaattacatctttcttctcaattagaatagctattataaaaatatgaaggagagtgcaatactgtgtatgaaagtagcatcatcactaaaataactatcattttgagaaataccatgaggacaaaacctaatgacttcatggttcttattgattacttttctaaggaacatgcttcattatttatatttaagagttttacctaaattgatgtgtaaaaattatttttcactgattacatatatactgctgatataagggtatgtggaaagaaaaactgttttcactgctggtgaggatataagctaatacaaccattatgggaataagtaagagtcttctctacctctgggcaagtgcccaaaggactgaatgtccctactacaaagatacatgtttatttctgctctgttcacagtaacaaggaaatggaaccagcctaggtgtccattaactaattttaaaagtttcataattccaatgagaaagcccatgcctatgagtagtcctttccagcttccagcccctgtgtccagcccttagtaaccaaacatattttctatctctatatttacctctttggaatgcttcatataaataggattgtataaaattatgatcatttgtgactgatataaaaatgaaagaaactattttccatctttatctaggaagtaaatagcattatcagcaccccattgtttcttaatgctgaacaacagtcctttgtatgcttaaaccgattttgtgtgttcatcagatggacattggagttgtttctaccttttgactattgtaagtagtataaaatagtctcatgttttggttaaatttttggttaaatacctagttcagttcatttggacacgtacaaacaattggaattacctgattatctatatttaacttttcagagaattcttctttgtgaaatggctgcaacattttgtgtttctgctattaacaatagaaggttttaagttctccaacaccagtatttattattgcctctattttccattatggtcaggctagtgggtacgaagtgatatctctggagtttaactcaaagtttctttatgtctagtgatattaagaatatctgtgtgctttttgattattgtgttatcttctccaaagaagcatccactcaaatccttgtcctaatttctaattgtttttcttttttgccatttatcttgtagcaaatataaacaacataaaatttaccattaagcatagttttgtggcattattttggaaccatctcttctatccatttctaagaactacttcatcattccatgctaaaactctaaccctcatacaccccaccctctgacagccatcattttcttttctctacagttttatataggttaacacatataaatagaatattacaatagctatccttttgtggctggcttatttaatttagcagagtatcttcaatgttcatccatgatgaggaatgaatcagaattttattcctttttaaggcagagcaggagagccgtatcagccatatgacagtatacttccccagcaacagaaatttatacccaactacaattaaaattactttggggatccttagaattcagttaagggtttgaactttggtggaaagcttattttaagagggtgtcagatttgccaacctttgtcctatttcctgaggctccatattctaataagctgagctacaagtctacttagtattggtattgctactaaaaccatctgatgggtttcttttgaaggagttacatatacctgtacctcaaaggataagcctgcacacattaaacctcacctgtccactggaaatatcaaacattctttgccgtagtccaaggtcaattgtgtgtgtacaagtattcaaagagaggtatacccctggattttggaatcagccccttccctgcctctacagaaattcagagacaagcatgtttatctgtatgtaatcttataaccagggagttctcatggaatatcccaaaatggacctgaaatatatttttagctcctctcaaccttgatttgaaaacagtctaccactcagagactttgcacactggaactgtccacacagcaagggacactatcatgctctagtaggtggagccaactttcttaccactatgaatcttgaaactgtattagtaatcagctctagctcctctcagctatggtctgtgagtagatcttcttgcttatctagggaatagtcaatagcctttttcatccatgagtacagagtaaaattcctatagatcccaggtcttagtctcagctgatgattctaaacctcccagttccagcagtccagaaaatgtacagatagctttaacctgttaaaatcagtctagaaaaattcaaagagtcaggtcacgtggtgcagaatactgaagtagaaggatcagaaattcaagccctgcctggtctacaaaggaaattccaggccaacccttgcaatggtgacagacgtaggtactgtctgactacaatgtgttgaaatatatatttcacatttccagaaagtaattaactgcccaaattcagttataagatgcatgcacacttcttgaataaccacttgtaaatgttggaatgtaaaaaaaattaactgggattatggatgctttttctgcagaacaggttagttttaggtataaatgccctccctttgttagatatgaaacaatattcagttctctttcaccttcaaaagactgacagtaggtggaaacgttgcacatgcagaatgtccttcctgagttttagtttagtagtaaacgtttcaaattccctcaaaagaaattggagaaacaaatatgtcacctgtgacccatgtcacagcactgagaggaggatgaagaagcatcagtatttattgcataacaaattgccaggcagcctacaaaacatagtgagacaaatacagacacagacacacatacacacactataactgtatgcatgggagggaggtaaaatgggagagcaataagagaaggtgtggaggagagagttgtcagaatacattataaaatgtataaaattgccagaaacaaaactaattagaaaactatatggcatggcttctcttttagaaatgaactaacaaaactatcacatttatactatgactacaggtactattgtcccaacaaagctggaaaccagtctcccacttataaagacgtaatttaatgctaggattaatgaatttaaaactgaagataaaactcattgagaaatgtagagatcatgtagaatttgacccatcaatttttaatatcaaacattgaaattaggttccccatttttatatgaagagatttcaaataaacgattaaattgtcagctcttcttggaagccagacattgtggcaatgcttgactgcttggctgctgaggagtgtgcagatcattgttcactgtgttgtatgtgatgctaaggtgcttgtctcctacctatcaatcattacagttacacttgtgttacatgtagcagtcaatttcattcatttatgttaccttcctggagccttaatcacatgtaatccagttctcatccccttatgttctctgtatttcctaagaatgccataaaagttactatgaacttggttgctcaaaatacatatatatgtatatgtgtgtatgtggtgtatgtatatatgtgtgtgtgtgtatatatatatatatatatatatatatatatatatatatacatacatacatatgtgtgtatgtgtgtatatatatatttaatatttgtttatacttatactactggaggtcagaagtccaaaatcaaagactattcaaagctgtctatgtcctttttctgtggcttagttgctgaggtctgctagcaaccttaggtatctgttgatttgtctttgttctcacaccatctcctcatgtgtgtctatacggcttaagttctcctttgcctatttcttataaggacacctggatttggatttggatttggatttggatttggatttggatttggaacttacactaaatgcagcataatatatcttaagttcgtgaacttatatctgcaaggaccatttctctaaacaagaccacatttacaggcaataaagttgtagtataggcatagttttttgtaattactattcaacccatcacaaccccatttacaaataatactgaaagcaaagtaggtttatgcatgcctgccaaatatacaagtatttgtgatagttcattcaagaatcttgatttctgccgggcgtggtggcgcacacctttaatcccagcactcaggaggcagaggcaggcggatttctgagttcgaggccagcctggtctacaaagtgagttccaggacagccagggctacacagagaaaccctgtttcaaaaaacaccaaaaaaaaaataatcttgatttcctgacactcagagtttccttttcattgatttatgcctgtattcacccctgatcaactcatgttctaaataaaatataaaacagaaacaataaatttcctttacctttgctattttgcctgtagaaatatttaagggtacagttccttttaaactttgtgtaatgctctttaagaacatgagaaataactgggtgtggtaacataaacctgtaatttttacttaggagatagaggcaggaggatttcagtcgagcatagatcacacagtaagaccttatctcaatccctgttctccccctaaaacaaaacaaaacaccatgatggagtaataagaaacaaattatatgttaattaaaatttccctgaaaaattttaagttcaaaacctagctctgtgactaacctgctgtgtaaccttgggcaggctccatcttttggggacttcagtttctgaactgtgaaacaaggagcatagacctgatgatgtctaagcttcctctacctgtaactctctggaatcccacttgtacagaattatcctcaatggggttatatagccattgtcgaggtactgtttattgcccagcttagcttttaaaaataatagtctctagcagagataatctgttccaccactagctctagtttagtgatgttacttaaatgtaatttccagtgttaggaatgagtttgtcttgaactgtagtttcaagaaatgtaatttccagtgtaggaatgagtttgtcttgattcctctcccatacccgatctttgtaaccttcttatacacacacacacatattactgtacagtagttaatgcatacaccctcatgatcatcttctgatctaggatatatgatagattgatatgtcaagccaactggcagaccaagatatcagccctgactttagatgtaatcttaaatttggtgctgatatactctgcctacctggctgctttttgctgaatttctgtgtttcagtccccttgactgaagcacatatcacgaagcctacacatgctgaaatgaagagccacaaaaattgatcttctatcaaaatcaccatgagcacagtttatgatatgatgtaaaaaaaaaaaaagtcaaagaatcttttggttttacacaaagagtatatgctgttcattggctaaggctatgtgggaaattaccacaaaacaatcttacaatcctaaaggctaatggctgagatgaagatagcagtaaggttagtttcttctgaggtttcccttattggtttgcagatggttaccttgttccattttcatgtgatctttcttttttgagtgaatactccttatgtttgtgtttctgagaacacatgccatactgaatttaggtccacattatcagccctgacacactgcttggtactaaggcttaaccctttaatatatacgaattaaggcagacaattcagcctgcaaaatgcattacactatgaaatattggagctagactttagagtttgcttacttttattttacaagccataaagattaaggtggaggacagttaagacctatcctaaggcaagtcagatgaaattagtggtagaggcaggcccagaaatcagatctctaagttcttgtccttcccagcataccatgctggcacatcatttcatctcacttattcacaccttaaatatcccacgcacttgcccttgcttgttcaccactgactattcggaataactttggcaaaagtaggaactcatatgcttttaaaactatgtttaatttttcttatacttatttagcttcaccacttatattttaaaagaaaaaattgaggttttcaacttaattgctttccctctttcttttaatacatatttttttcattgaaaataatagcaattttttccgaaggtgaatgaactcgactttgtcaaaactgacagtggattaaaagagaagcaacctcagcttttaaaaaaataaatcacctttcagatctgaagtagcaaaatatgattaggacaaacctttgccccccaccttcccctgtcttctttccgtagagcaggaattcagagcttctagaaaccttgatgtgcactcttccacctacagacagtaaatatcaggatggaactggtggggtaaaatggcctgtctttggccagaggtatttaagctcagaccttggaatctaaaaggaaattcaaaatgcaaatgcttcctgtcttcacttgtaaatcttctgtactttttttttaaaaaaaaaactgaaatatcaagagagaaaaatgaaaaaaaattgagttatacagacaggtaaaaggtctgatagttcaaaagatttatcaaaatcaagtgtactcttccatttaatcctcgaggagtttgcttttacttaactactggcagagctatttcttctcaacagcagttagttactgcagtggaccatagaatgcttaattcgatcatccctaaatcctcacttatttgcatcttgagagggagaggggtgtttaatgacaaaaagcttttcttcagctgagttcctgagtaacatggccccaaggctgccctctcaggttgtcatccactgtggagattagagagagacacatttgtacctcctgtgtattgtgtcagagccccacccttactcaggtcagtcagcaaccctaggaagtacaaaaatatatacagctgtgcctttgaggtagaaaagacattcaaaattcaaaacacttctatcaagcagactctcaataattttcactccatatgagatacaaatatagattaaattagactgatatgattttatactggtcttgaacaggggggaaaaatcagtacagaatcatataattctatttgaagttgagataataaagcaataatttctttattaaactataaagttttatgctgtgtgtatgttagtaactttgtttctatttagtaattcatttgaacacagtttctttggcctgacaaatattctaatgtactatcagaatttctttctgacttataaaatagtttatgtaatttttctaattaggttttattgtcacctgggaaaggagaacctcaactgaagagttgcctgatcggattggcctaaggacgcatctgtggggcttcttcttgcttgctaattgatgtaagagggtccagaacactaagggcagtaccctccctaggctgatgcaagtggtctatacctcagaaaggttgaatgtgaacctattattgagccagccagcaagtgctgtttctccatggtttctgctttgagttctggcttgagttcctgcccagactttgctcagtaatgggcagtgtgacctgaaggtgaagagctaaataaattctttcctcccctcagtaacttttttatcagtgctttatcgcaccaacataaagaacactagaacagtagttaaacaatttaatggaaataaaattaaggttgcaatggctgtgcctattgagcttattccctccattctctctccatttgcattttaagcagtcaggtggcgggcatcaccatattctttatgttcccagagttaggtaattagtagacacttaaatgcttgtaaagcctcttgctttgctttcttgtctctgtgcatttactaaggcttttggcagatatttgtactcctttaagttggtggctgccactcttacaatgatttttaagtgtttcttgaatatgattttacatgtaaagaagagctgttgtgtcataagaatagagctgttgagctctgcttgatgtgtctttccttaaatgtgagatcctagcatccaaaagcgcctgagaggaatatattataagaagatatgtgcaaatcacttgcattcttctgtagctcatcataggaatagaactatttcagtgaggaacacagtaagaatatatctaataggttacacatgctgtgatggtctcatcaaatggtccctgctaatcataccagtcgctgattgccatcccttgggttaccattgaaaacactcttccattgtttggtaatgaacagtccctaatctcactgctgatttcaggtaagtgtgccagacttgagatatcatcaaaagtatatcatttgtcatagcgtgttttagaattctaaaagaccatggcaaataggaaggagaccaagattcttctctttcgtttaattttttttttttttaaagaatagtctgtatctcagtctggcctcagattcactgttttgtcaaaaataaccttgaactcctgatcttcctgccctaactctcaagtgctggcattatcgaagtatgccattgtgactggccaagagatcatatttttttctgattattagaaattcaatttgttacaatatatgtgttagctatttacatatacagttagtaggtatatagagaataaatatcatgatatggtcaaatatgttgtatatagtatatattatatgtatgtgtatagttggttaactgttcctacatgctttctgcaataattttctacaaatatataactatatacatatataaatatatatagctatacaaatatataaacatacaaattaatacattctctaaaaacatcttacatacatcctctcttttaacttttaatccttaaagaatctctgtaagtaacaaaaaaaaagtaaggctaagagatatcatatatcctacaaggtttcagagccaggaagcagttgatcctgggccatttttctaagttcttactctactattttgcctgtatgccacagctatcattattacagagataatgtgctaaaatagagccagacctcctgtatttgaaacacagctattttgcttcctggtagtgttatttctgacaattttaagcatctctgtgccaaaagtttctcacctgaaaaatagggacaataagagtacctaccccatagtgttattgtaaagcttaaataagtagatttataggaggcattttgaacagtgccttgagtagttagcattctcttagtgtttgctgctatttttgtgttatctttattattcttattatgatcagcagcagcattattgcatagcatggcagctaaaattcacagtcattatgcacagactaccttcatttaaatccaaattccattaattatgtcaacttgcacaaatttctttgatttccccatgcctcggtgtcatcacaaatatatcagatactaaccacataaagctagagctgctgtgagtttgaatctgtgaaagattctgatgtacagaatccccatttgcctttttcctgctgtcttgcctgcaaactcagagctacgaggtgtcgctatggcagttatatattgtatgtgtcatatgtaactcatcagtcctctgtagtctaatcacagaagccagtggtttagttgtcatggcagtcctttggtaggaatgtatttgtcatataaaagttattttggtcaatcagtatggtatggtgaaatgaacatttgctggagattcagttctattgctaagtcgttttacaagtgaaattccagagcgtgaagaaatcacttagaaagagtaagaaataataactttctagtcatgcctgttttttctgtgaagagtggtgctatattttccagcatataatagtttgagtttatattagacaatgtgataactgtgcttggggaaaaacattccaagtttgatgtttttcctccacaattatattagaaattaattagaaaatgggacacacttagcagttacttcagaaatgacttggtaggctctgttcattaaatactactaattgggatactatggatatattcataggcaacacctcagtttatgaagtgattttattccaaaagattctaggctatttaatttgttagagtttcctgtacaaactatgttattattgtgaggaagtgcccaggttagctcacaacctgttataagacttgtatgtgcagtttacataagaatgctgctcggtgttagtaattaaagcaaaaaaatataattgagcagaaaataacacctggatgctaaaatgtaagaacagtagaattaattacaggttgaggagagagacggcagattcaagagggtctttctgaagagcacttctagccactttgagaggacattaggtgttgatggcccaggattttttggtctaatttcagttcgaaaaggatagcaatctcactaacattgctcttataactgtcagtcataattatagtcatttagggtccacaaatagaacaaaaggaccgatagagttcttgaagatactggacaagagaaaggggaagaacaaaagggtgatctgggtccatgagatgacatacaatagggtaaggtagaattagccccagcaaatgatgaaagaagagaaatggagagctcagcttttatgcaggatcctggtaaaaaacaaagacgggaacatttccataatacctgagcacctgcttaacttttattctcattctctcgtctctgctaggctggctcttaaagggcaaaatgatttcttattcatccctctgctgccaacaatagtgagtacataagtgttgaatatactagatgctaaatgaaatcagatttcatctcacaagtgaatttttttgcttgtatctgatcagagctttaaaaatctgcaaaattatgcctttgatcagaatgaggttcatagttttagaatttaccataattgaactcagagtttggaattgtggtattgcaaatggagaactgagaatccagtcacaggttgttgatttgatgaccagcaaagtcccttctgcctatttcataggttacagctcttctgactccatatctctccttgaagatatctgaccaaagtaatttgtaacactctgcacatagactccctgattgacaaaactctctgactgctataacttctcacaacatcctgtcacacacaaaaaggtgatggggagtttgactgttgattctttctcttcctcactatttttttttctgtttgaccccttccctgatgcattcctgctggagacaaaaccacatgctgaaccatgaggaacagaccgcagtgaaacaacaagctgctcccaattttaaatattgcgtgttggggcaaaggcagagttccttttactctaaagctataacattaaaaaaattctgtttgatattcagagttatttgatctggcagtttaacaactgttgatgttttaattgcttctttaaaggatttcatctacattttaagctttatttttattttactctgaaggaatgtcaatattagccatcactttgcccagtaacttaccactgcaagatcttggagtaaaatccagtaattactggcgctggtaacttaagaccctgctgagaagtttggcagtttcccttctcctgaggaggctctcttcccatggagctagcaatcttttattgttctgaatcaattttaagcaagtgttgtaccttcaagatcagctttctatgttcctctagaagagattgaggtcactctattctgagtgaaagagaaatcttaggttactcttaacatggacaaatgtacaattgtaagatgtgttaacatgaatgacttagagattttataatcccttgggggtcttagttcatttttatttgtctatttgttagtctacttccaggaccaaatagaatgcttaattggcatgctacttacatgcatgtaactatccatttaaatcctctgaacaaaactactaacattcaaagtgctttagagatgaaagtgccctctgagatcatctggtccagcctcttctaaatgctttagcttgtattcattaataataataataataataataataataataataaaaagatgcttgctttcagacctcattagatgagtttctttgtgtaatgggttgtgattaactcagaagctcacaactggttgaagtgcatagtataatgtctgtggagtgctcagttacaaataaggcatctgtatcacatccaatgcacaaggctcagggaccatctaggaaaacagggaagaaagattctaagagcaggtttgagaggagctgagcaaaacaatgtgttctgtacatgacaactgcactcatgaactcacagcaacagtggttggccggtaaaagacctgcacaaaatcaagccagtcaacattccagcatgaatgaaatagacatttcatgagctaccactagctggggagctatggactgttaaatgcttctaggagaaggagagtctattttatttaagggtatgatggcttctagtattccaaccattcttcagtgaatgaccccatacccaagagtatgtaggtcaatagattatttataaaaagaatatgaacttgggggcataagaaggtagtggtcggtctggaaagtgccgagggggaagtttgaggaagaatatgatcaacattgtgtgaaattctcaaagtattaataaaaatatttgaaaagaaagcacagaaaataaagaagtatgctagagctcacattctcatctatttgcatctatatgtcatttgaattatttacaccaagaaatatttataaaatgcttacaatattgaacccagtctgaagcaatacttagagtttgagagcttacacactaaaatgagaagcactgacaggccacatttagagaattatattctctcttctgaagcttctttatactctctgtccaacacacacacacacacatgtgcgcgcgcgcacacacacacacacaaacacagaggggggatgacgttgaggccatagaaactaatctccaaaccagttgcttttcttcatgaagcagcactgctctataagacttcctttttcaggaatacttcatccttatcaaggataatcaaaagttaatttaaaggaccagccaactggttgatgggggcaggaacccctggctaggatatatggaaagcagtatacttaaacatgaggtatattattcagtcatattatccttttctgcctatactctatctcctcaacacagaaaacaactatatgactttgtgcttagaaacataatgcctaagttttcatacttacatatcattctcaaccacccttttgggaaagtgggatcaaatactagtttaagtaatatttacaagtcagaagcttccaaaaggatctcttgactttctactgcttctttctggtatcacttcaatagccttaaaaggccaacttttgtgggtgatgatatgattttaagtcttggcatcctttcctgatagacatctctcaatctttgaaaagtttaaatattactctgtgaagaattttgaaatataaattatggtagttaaaaaaaatttacatggagctggagagatggctcaccacttaaaatcactggctgttcttccaaaggacccaggttcaattcccagcacccacatggtgtctcataaccatctttaactccaaccctagtggatctgatgcccccttttgtcctccataggcactgcacacttgcagtgcacagacatacctgcaggtaaaatacccatctgtactggctgattttgtgtgtcaacttgacacaggctggagttatcacagagaaaggagcttcagttggggaaatgcctccatgagatccagctgtgggacatttctcaattagtgatcaaggtgggaggtccccttgtgggtggtgccatctctgggatggtagtcttgggttctataagagagcaagccgagcaggggaagcaatccagtaaggaacatccctccatggcctctgcatcagctcctgctttctgacctgcttgagttccagtcctaacttcctttggtgataagcagcaatgtggaagtgtaagctgaaaaaaaaccctttcctccccaacttgcttcttggtcatgatgtttgtgcaggaatagaaaccctaagacaccatccatgtaaataataaatgaaaatttacaaatataaaaatataacaaatgaaaatgtatacacatatagcataatattaaaacttaatattttcttggattgctttttctgagtctattgatgtagatctaaccttctctgcctaagatttcagtttttgtttctgcttgatttctgtagatcataagcttgatagaagaggagactaccctgtctattttaatttttactaataagtctttattattatctcatataccaaaaatagtacttagcaataattggcattcaatattttatttatccatccatttgttaatttttgagtcgttttctcactatgtagtccagggttgtctcaaactctaactccatcctccacttctcaagcccttgaattgtaggagtgtactaccatgctcattttaatacttagctttagactggtctatagtcttagcctcatcccatgtttatgtctatctttgctctgattagatgcctctatctgaactctgggtatttattgataaatcacaagattgtgggcatttatgtttgatatcaagtatatctggtattttcccaaattcctttctatttctggagacatttctctgattacctactcttgaaactctttaagtgttctcttttcacactagatttctctcctaatcgcttctcagacttttggcaaagatctagtgtagatttctctcctaaccaattcctacccttcatttctgactcctattcctttatctattgttccctgtttaacctaggttgcattttggttcaaagcattttatatattaccatccagtcatgtctgtctcttgtttgatattctataaagaacaaactagcatttatgttttatttgtgtaataaaatacaactcctttctacctgcaatttataagcagtaaaaaggatcttcaaaaacaaagacaaaaagtagctgagtaattgttttttaaaaataattttaaaatcataacattgagataatagtgtgaaaggacttcctaaagttaaatttgtaagtttctacgtatcttcttcatttccctacatatatattgcacttacatatctaccatttgaattggattttgtgaagcttttgatttgggagttatgtcataactatgacttatagaatgtctttgtattattacctcctgagagctgggattatggcatatagtacagtcattctgtctctattcccaatcaccagtgtaaattgatagcagtaccatgaactcaggtatactggcaaacatgcaaacacacacacacacacacacacacacacacacacacacatcacagtataagttctacaatatgccttaaaaatacatcacttcttagccttttggctaagataaagtataaaaatatttatagctaaaagcaatctctttcctatttccatgcatagcttagatcagagaaaatttcaactaagtagatggcaaagttagaattgttgccttgatgacaatttcatttctcagcatgtagaataattcaagcaagtaattgctactgtgataataattccaaacgtgaagaataactatttggtgaaacagtggtgataagaaccttggagaaagaagatgtgcatcttagagtttgtaatgacagaagtggtattgatgaccattcatccttacagaaatgtgattcacgatttgactgaaatatagctttttcatcctgctactgaaatcatgaagtctttcagaactgaacaattctaatttctggacaatagacaaggaaaagaactgtctaaaatagtcaaattcaacctttcttatgtcccagtacaccagaagggatatgacatatatcactccagaaagtgcatgagcacacatcacaattttcagagaagcatatataatttaaaaatccacccaaaagggcattctcaattccctaaccccctcacaaagacataatttatctgtgggactgcacagtacattcttcaatatgtccatatgtgacatgatacaaagagtacacaaatctagttttagtaaagaacataattctaagaatagtgtcacagaggttaaagcctttcgaaaatgctaaggacctctgaatgtatgcataataaatagaactaaaaatagttctctttaaagcaagaaaaagaaagatctggtcccacttggcatcctgttgaaagtgacagctggcagtactagttgcccagacctctatcaatgagaatggtatccaagtagaaaggcatggataaaataattaagaaagaaattgaagctcaaagttagtaaaaagtatgaaaatgtatatattcttttttgagtctctaagaccagacaaactagagtagagctaagggtacagaaagaggctgtaatcacaaaaccactacaatgtgaccatccttaatatgaaaatatgaaatatacaggagcattggcataaacctataatcctagcacttgaaagactgaggccagaggatcacaagtttaagaccattcaggtctacagaataagacccctaccaccaaatatagataggtaggtaagtggatggatggatggatgaataaacatacagacacagacagacagacacatgagaaatagatacatatatttgaaatgcaaactgcactggatgctaaactatttgaaacccaacatgatactacaagtggaaaattctgtattcaaccttatgagacagattacaataaaaactggcatatttaaaatgtattacatttctttcaggtagttatacatgaaagaaatgaactttatatttagacttaagtacaaatcccaggatatcttatatgaatatacaaatacacttaatttaaaaaaaatcctagatttgaaacttttatgaccactgtaatttcaaataaggagtatttaaccagtactccagattataagaaattatattaagaataatctccaaaagacaagaataaacaaattattttttctcaaactgagaggcttggagtgatttggaaatactgtgtatctctaaattgggcaactactatcaggaaaattctaaaagtattgtttcagggaaatactttatgatgtagccagtgaagaaaatgtttgacaccagaaccttcaagttcattctctgaggataagtcactaaggaaagtatagatttttgggttttgtttgtttagtttgtcggttggtttttttgttgttgtttttgtttttgttttgttttgtttttgagacagggtttctctgtgtagccctggctgtcttttaactcactctgtagactaggctggcctagaactcactgagaaatgtgcctgcctctactttctgagtggtgggattaaagaatgcacccccaccactggctgatgcatcattttttgatagggttactaaattagacataaaaagagaccatgaggaaattctgatccttcaggggtgcacgctagagcaggttgagctgcattcgctgtaacctagagggagtatccagtggattactgtagagcattgtgctgcttaaaattcccaccaataacttggacaaaagtattgaagatttgcatattgaatatttagatcatagaaagccataaataattacatatttgaaaattggtatatataagaaaaattagaatgagataatatttgagaataagaggaagaagccaagagaagaagttgtttgtttgttttttttttttttttagtgtagaacaaatttctgatagggtttgacagtttaatatttaatattacagtggtatgtctgatatgataatgagtaccctcatttccagtagatggatttaaactgaaattagatgaccaactctcagactgattgttaatgtaactcactaggtagaaaagtttaggaaactgagttctaagatctcttccagttatgagatggtacaatattccctgtacaggctgttttgacaatagctatttctatcattcatttcaaaaactaaaattcagtaattccaaatgtcacaccacagatacttcattcaaatccaacccaatggtgatatttacatttttgtgtggaaggggtatgtcctccttggtcttgcaaatatcagacaaatttctaccactgggctataccctcagcccccatatatactctgcatggaaagctcccctgtgtggttactttcttctctcattctcctctgcttccaaatatctaaaaagggttcattaaattagtagtagaccttttgtggtagagttctacttgtttatgtctctgtacaaaacattatccctgccatcagagtaaacaataaatagacttattcttttgttttgtatatgtatatttcaaaaataaacatcataatcatgttttttaaaaagtcagtgtttcctttgtagaagcagtataggctccatttccacatctagccagtggaacactctgtcttttagaagtatggggcactgttttataatttagggtgttttctgaaagaagtctagtattctgtattaaactactgtggatttatcatttatctatgaatgtacatgaatttcttagactttctttcctatttgtgtatctagtctaattaatttctaaacatggtgttgaaaatatacccagaaagctaggtaaagtaaaatatagtttcttcagcacaaaggtttgtcactgttgcttatctcttttaacaattatcaggcccctattattgtgctagacagtttcatagttgtctgatcttttccaaaaatatctgtgaagtaagcaagcaatactcatagattttaacttcagttttcaacagtataagcatgcatgcatgtatgtaagaattacccttagatatttgctaatcatttttcaacttcctgctaattgtcttatgttcttactattttcagcagtgagtttcatttcacaagaaacaaaaagtctgttgccttttttcagggacctttccaaatgatgccttagcaaagtcttcatagaatggattatagtgttcttcggtattgctgagttaaatggcctagtcggccatcactggaaagagaggtccattggacacacgaactgtatatgccccagtacaggggaatgccagggccaaaaaaaatgggaatgagtgggtagggaagtgtggggaagggtatggggaacttttgggatagcattggaaatgtaattgaggaaaatatgtaataaaaaaaagcagaaggtgagagtttaataaattcctattattctcttccttaatatggtaccttattcattcataaggaagtttaacattttcttctgtttcattaggtatattttttttagatttttttgctttaaaatgttatgattctgagttgtagtagatttaaaacagcattacaacagttgcatgtctgtgtgcaagtgattttgtgagtacctagtgtgctagtcattctggtgggagagggaacaaaacagacatagttctcaccctgctagaacacttctgatgtacgggcaaagtccctcatgtaatcagcaataatacaatgacaagttcatatatatatgtgtgtgccaaagataacctttttagggcactttagagaaaagaagactctaaaatgaaggcatacattccaatcccacttctaatttctttctatggcttccttgtcactgattctccctagcttcttttctctctctcacacacacaaaatgaacatgttgtgcaagactgctttcaacttcttccctagtcagttaaatactcagtctcaccagtgatacataggtacaggcttttaagacagatacatggattcactccctgcatcgcaagtccaatttgtataatatgtaaatgaatatttcagatcttgggtaagaaattgatcatttttattttttaaatatttattttacttatgtgtgagtgtgtatcatgctagttgcctttaatcccagcatttggcaggcagaggcaggcaatgtttgtgagtttgaggctagcctagtctagatagcaagttccagactacccagggctacataatgagaccttgtctcaaaaaataaaatataagtcaattaataagtttaaattaataaaactttaaaataaaaatggagccaggcggtggtggcgcacgcctttaatcccagcacttgggaggcagaggagaccagcctggtctacaaagtgagttccaggacagccagggctacacagagaaaccctgtcttgaaaaaaaaaaaacaaaacaaaataaaataaaataaaacaaaataaaataaaaatggggcctttgagattgctgagtggttaagcatacatactgctcttgcagaggacctgagcacaattccaggcacctatgtccagtagcttacaactgctgtaacaccagctccaagatacctgatgtcctttggtctccatggacacttgtattaatgtgcactactcctaaatgattggattaaagcatttaccacgatatttgggctgataaaagaattatatgagggcaaatatgcaaccttggtattagaagaagacaccattttccatttgtattaaggtaaaataagcaatttataataattcttttaataaaacatacttataaaatacaatttaaaatttgccaattgttaataaaaacaaataattttctacctttgcatataccttttgacattaccagcattagaactctttggctttagtggatgctttcattgtaaagttttaagaagcatttcataaaagtccctactaaggtgcatagtacataacgggacttcagtagatggtagtccgtattatcagtatagctctcagaagtgttcactgcttataacttccaatcttgagcttatagacacctttgattttaaaattgttttcctggttgtacctcttcattaattcatttccatgttgaagcaacctttggtatgtgactgtggaaaaaaagagaaaactccctagaacccaaataaattgtgcatccattgatttttccactggctacatctttacctccttaacgagctcctacaaatttaatcagaatgatttctacttttaaaatgtgttgctacttcccactgagttattaccttgtagacatttgttcttagagattacagtgtttaaactccaaagaacatttctaaagcacagcaacctaagtgaggtccaaatgctagtgtatggcatttctaggcagagttatcaaagattaaataggatccataggtcagtgccaaactttcccttatctgctgctctcattttcataagccccttgccagaagacaaaataatctaattccatttctcctctggtcaagtaataacacatttagtctattttgtgttaataacatattaatccaagtttccatatatttcagcatttcaattttcttttgtcatgaaataagggcttactatgtacacaggctagtcctgaacttgctatatagcctagcattactcagaaatttcactgttcctatcttatcctctcttctgctttgattatagatatgcaacaccaaacccaggtaaattttaaacgatggtattattttaattgtatatatttaaggcaatgacaggatttcatataccttacattttactaaaagatcttaagcccatgtgacatggtggcatatgcttcttatcccatagtttgagagacagaagcagaaggaccagaagttcaaggccagccagcctaacttcataatcagtgtgtagcctgggctgcatactatttatctcaatcaaaatgccaatgccatccttcacagaaatagaaaagatagacttgccctttcggtcggcaccagcaccaggtcaccttgggcacagagtcagcgcataaccccaaggtcccctagaggactctccatgccgtcttaggaccactggtgagtggaacacaacttctgttccaatccaatcgcgcaggaccagagacagcattagggaagcagaaaacccggcctgactagggtcacaaagtcccttcctgtgggcgccagcaccgggtcacctttggtgcagagtcagcagacacccccaagctcccctagaagactttccacgtgatctttggaccactgatgagtggaacacaacttctgttccaatccaatcacgcaggacctgagacaacactagggaagcagaaaaccgagcctgaccagggtccaaatcccttccggtaagcgacagcaccgggacaccttgggtgctgagtcggtggagaaccctaaggtccctagaggactctccacgcgatcttaggacctctggtgagtggaacacaacttctgttccaatccaatcgcttgggacctaagacagcactagagaagcaataaacccggcatgaccagggtcacaagtccctttcgttcagcaccagcaccagttcacatgggcaaagagtcagtggacacccccaaggtccccagaggacagcttctgaggcataccccgtttcgggatccagacattcgggcaccttccctgccagaggagaggtgtccaccctgcccgggagagctttgccagagcacctggtggagccatcatggctcccgaatcccgctgagagtagtctgcacaggtgagagtgaggactacagaagctaacagcttctgggacaggccagagtgacacagcttctggacacatcctatttcgggccttcatcttctgctaggagtcaggtctgaatgccagatatctttgcaccttccctgtaagaggagagcttgcctgcagagagtgcactgaccactgaaactcagaggagagagctagtctcccaggtctgatgatagaggctaacagaatcaccagaggaacaatctctaaccagagaccactataacaactaactccagagattaccagatggtgaaaggcaaacataaaaatcttactaacagagaccaagaccactcaccatcatcagaacgcagcacccccaccttgcccagtcctgggcaccccaacacacccgaaaaggtagacccggatttaaaagcataactcatgatgatggtagaggacatcaagaaggactttaataaataacttaaagaaatacaggagaacactgttaaacaggtagaagaccttaaagaggaagcacaaaaattccttaaagaattgcaggaaaacacaaccaaagaggtaatgtaattgaataaaaatgtccaagacctaaaaagggaagtagacacaataaagaaaacccaaagtgacgcaacactgaagatagaaaccctaggaaagaaatttggaaccatagatgcaagcatcagcaacaggatacaagagatggaagagagaatctcaggtgcagaagattccatagagaacatctgcacaacaatcaaagaaaatggaaaatgcaaaaagatcctaactcaaaacatccaggaaatcctggacacaatgagaagaccaaacctacggataataggagtagatgagaatgaagattttcaactcaaagggccagcaaatatcttcaacaaaattatagaagaaaacttcccaaacctaaagaaagagatgcccatgaacatacaaaaagcctacagaactccaaatacactgaaccagaaaagaaattcctcccgacacataataatcagaacaacaaatgatctaaataaagatagaatattaaaagcagtaagggaaaaaggtcaagtaacatataaaggcaagcctaccagaattacaccagatttttcaccagagactatgtatgacagacaagcctggacagatgttatatagacactaagagaaaacatatgacatcccaggctactatacccagccaaacttttaattaccttagatggagaaacaaaagtattccacaacagaaccgaattcacacattatctttccaagaatcccacccttcaaaagataataacagaaaaaaaccaatacaaggatggaaaccacaacctagaaaaagcaagaaggtaatccctcaacaaacctaaaagaagacagccacaaaaacagaatgccaactttaacaacaaaaataattggaaacaacaattacttttccttaatatctcttaatatcaatggactcaactccccaataaagagacgtagactaacagactgcctacacaaacaggaccaaacattttactgcttacaggaaacccatctcagggaaaaagatagacactacctcagaatgaaaggctggaaaacaattttccaagcaaatggtctgaagaaacaagctggagtagccattctaatatcggataaaatcgacttccaacccaaagtcatcaaaaaagataaggaggggcacttcatgctcatcaaaggtaaaatcttccaagaggaactctcaattctcagtatctatgctccaaatacaagggcagccacattcaataaagaaactttagtaaagctcaaagcacacgttgcacctcacacaataatattgggagacttcaacacaccactttcaccaatggacaaatcatggaaacagaaactaaacagggacacagtgaaactaacagaagttatgaaacaaatggatctaacagatatctacagaacattttatcctaaaacaaaaggatataccttcttctcagcacctcatggtaccttccccaaaattgaccacatacttggtcacaaaacaagcctcaacatatacaaaaatattgaaaattttcccatgcatcctatcagatcaccatggactaaggctaatgttcaataacaaaataaataatagaaagacaacattcacgtggaaactgaacaacactcttctcaatgataccttggtcaaggaaggaataaagaaagaaattaaagactttttagagtttaatgaaaatgaagccacaacatacccaaacctatgggacacaatgaaagcatttctaagagggaaactcatagctctgagtgcctccaaaaagaaactagagagagcacacactagcagtttgacaacacatctaaaagctctagaaaaaaaggaagaaaattcacccaagagaagtagacagcaggaaataatcaaactcagggacgaaatcaaccaagtggaaacaagaaatattcaaagaatcaaccaaagaggaactggttctttgagaaaatcaacaagatagataaacccttagcctggctcactagaaggaacagggacagcatcctaattaacaaaatcagaaatgaaaagggagacataacaaccgatcctgaagaaatccaaaacaccgtcagatccttctacaaaagactatactcaacaaaactggaaaacctggatgaaatggacaaatttctagacagataccaggtaccaaagttaaatcaggatcaggttattgatcgaaacagtcctatatcccctaaagaaatagaagcagtcattaatagtctcccaaccaaaaaaagcccaggaccagatgggtttagtgcagagttctatcacaccttcaaagaagatctaattcaagttcttcacaactattccacaaaatagaagcagaaggtactctacccaattcattatatgaagccacaattactctgatacctaaaccagagaaagacccaacaaagatagagaacttcagatcaatttcccttatgatatcaatgcaaaaatacttaataaaattctcattaaccgaatccaagaacacatcaaaacaatcatccatcctaaccaagtaggtttcattccagggatgcagggattgtttaatatatggaaatccatcaacgtaatccattatataaacaaactcaaagacaaaatccacatgatcatctcgttagatgtagagaaagcatttgacaaaatccaatgcccattcatgataaaagtcttggaaaatcaagaattcaaggcccatacctacatatgataaaagcaatctacagcaaaccagtagccaacaccaaagtaaatggtgagaagctggacgcaatcccactaaaatcagggactagacaaggctgcccactttctccatacctattcaacatagtatttgaagtcctagccagagcaattcaacaacaaaagatcaaggggatacaaattggaaaggaagaagtcaaaatatcactatttgcagatgatatgatagtgtatataagtgaccctaaaaattccaccagagaactcctaaacctgataaacagcttcagtgaagtagctggatataaaattaactcaaacaagccaatggcctttctctacacaaaggataaacaggctgagaaagaaattagggaaacaacacccttcacaatagtcacaaataatataaaatactttggcgtgcctctaactaaggaagtgaaagatctgtatgataagaacttcaagtctctgaagaaagaaattaaagaagatctcagaagatggaaagatctcccatgttcattgattggcaggatcaatatagtaaaaatggctatcttgccaaaagcaatctatagattcaatgcagtccccatcaaaattccaactcaattcttcaatgaattagaatgggcaatctgcaaattcatctggaataacaaaaaacctaggatagcaaaaactcttctcaaggataaaagaacctctggtggaatcaccatgcctgacctaaagctttactacagagcaattgtgataaaactgcatggtattggtatagtgacatacaagtagacaaatggaatagaattgaagacccagaaatgaacccacacacctatggtcacttgatctttgacaagggagctaaaactatccagtgggaaaaagacagcattttcaacaaatggtgctggcacaactggtggttatcatgtagaagaatgtgaattgatccattcctatctccttgtactaaggtcaaatctaagtggatcaaggcactccacataaaaccagagacagtgaaatttattgaggagaaagtggagaaaagcctcgaagatatgggtacaggggaaaattcctgaatagaacagcaatggcttgtgctgtaagatcaagaattgacaaatgggacctcataaaattgcaaagcttctgtaaggcaaaagacaccgtcaataagacaaaagggcctccaacagattgggaaagtatctttacctatcctaaatcagataggggactaatatccaatatatataaagaactctagaagggagactccagaaaatcaaataactccactaaaaaatggggctcagagctaaacgaagaattctcacttgaagaataccgaatggccgagaagcacctgaaaaaatgttcagcatccttaatcatcagagaaatgcaaatcaaagcaaccctgagatcccacctcataccagtcagaatggctaagatcaaaaactcagttgacagcagatgctggcaagtatgtgtagaaagaggaacactcttccattgttggtgggattgcaagcatacagccactctgggaatcagtctggaggttcctcagaaaattcaacctagtactactggaggatccagcaatacctctcctgggcatatatccagaagatgttctaacgggtaagaaggacacatgctccactatgttcatagcagccttatttattatagccagaagctggaaagaacccagatgcccctcaacagaggaatggatacagaaaatgtggtacatttacacaatggagtactactcagctattaaaaagaatgaatttatgaaattcctagacaaatggatggacctggagggcatcatccagagtgaggtaacccaatcacaaagaactcacatgatatatattcactgataagtggatattagcccagaaacttcgaatacccaagatacaatatacaagctgcaaaacacatgaaagtaaagaagaacgaagaccaccatgtggacactttgccccttcttagaattggaaacaatcacccatggaaggagttacagagacaaagtttggagctgagacgaaaggatggaccatctagagactgccatacccggggatccatcccataatcagcttccaaacgctgacaccattgcatacactagcaagattttgctgaaaggacccagatatagcagtctcttgggaggctatgctcgggcctagcaaacacataagtggatgctcacagtcagctattggatggatcacagggcccccaatggaggagctagagaaagtacccaaggagctaaaggagtctgcaaccctataggtgggacaacaacaacaatatgaactaaccagtaccccagagctcatttttctagctgcatatgtatcagaagaaggcctagtcggccatcattggaaagagaggcccattggtctttcaaactttatatgcctcagtacaggggaaagccagggccaagaagtgggagtgggtgggtaggggagtgggcggagggtatggaggacttttgcaatagcattggaattgtaaatgaaaaaaatacctaataaaaaacttttcaaaaaaaagaaaagatagacttaaaattcatatagaattataacagccaacgtcaccataaacaaaaagaatagtgtgggcagtatcaccattctggctttcaaattatactgaaaagtgacagtttcataatcatgatggcactgaaataaaacagacatatatatcaatggagaaattatgttgtctccaataaatggttctaggaaaactatttatctacatataaaataaagaatatttgtggagtgcaaattggtctttttggggtttattttataaatagtgggtagaaaaggtggtgggtgggactgcagagagttgagaaaggttagtggatatgatcaagatgttgaatgtaactatgaagagactaataattttaaaatattgatagcctctacagagcacaattctgccttcctgtatttgcaacaaaacataaatttataaaaataatttgtaataacgatgcaaatcctggaggtgaacatgaacatctgcacacaaagcttatagaattgcctgaacgacaatgtaaaatgcagcattttgaaataacaatgaaaatatataaaaggaaagttataacatggtatacttttaaaataaatacttatttactaaaaaaataagtgaaggaaagaaggaaggaaggaaggaaggaaggaaggaaggaaggaaggaaggaaggaaggaaggaaggaaggaaggaaatagaaccatctccctcaccatacataacagttcatttcaaacgatcaaagaccaacacttttgacataaaatctgttctgtctaaaagaaattcagggacaaagatggagcagagactgaaggaatggctgaccagtgagtggcccaatttgagacccattacaagggcaggcaccaatccctaacattgctgatggtatagtgtgcttgcagacaaaagcctagcatggttgtcctctgagaggctctacccagcagctcactgagacagatgcagagacccacatccaaacattagactgaggttggggacccgtatggaacagttaggggaaggattgaaggccctggagggtatggctaccccacaggaagaccaacaatgtcaactaactagggttcctgggagctcccagaggctgagccaccaaccaaagagcatacatgggctggtctgaggccccctgtacataggtagcagacaggcagctcagccttcatgcgggtcccccaactggagcgggagctgtccctaaagctgttgcctgtctgtggaaccccgtctcctaaatgggctgccttatctggattcagtgggaaagaatgcacctaatcctgcaataactggatgcactagggtggtggatactggggaggggggaaccctcccagaggaaaaggggagaggggatgggaagaattctatgagaaggagttgggagggggcattattggaatgtaaattaatataaataataaagatctgaaactattaagagaaaaaagtaaggaaaacatttccaattataggcaaggacttcagttactcaagaaataatgccagcagttaacatgtgggacttcatgaaattaaaaggcaagtaaaacagttaatttggtgaagaggtaccctagagaatggaataaacctttgccagctctaacctatcaaggtcccaatatccagggtatacagataacgaaaagacaaagctgagaaattaaatgtcccaatcaacaagtgaggtaatgaaataagccagtagttctcaaaaaatgaaatacaaatggccagtatactgataaaaaacgttcagcctcatcagcctttagagaaatacaagttcaaactacactgagtccagttcatgctgctcatatacttacaaatttgagtttctgatggttgtggattttttttttaaaaatgagaacacaaagttggggatatggaatgtgggtggatctggaaagagttataagaggtggtgaatatgatcaaaatataacacatgaaattcccaaagaattagcatttttgagattataatttaatcataacattttctcccttaaatagtctttttaaaaactacattggtgggctagggagatgggtcagccatcaaaaaacctagaatacagagcccatcataatctatatcttatgggctgcactatagtatgctctcaataaatgcctattagactgaggcgggggtaactgcattgagacctaatctcaacctactcaaaatggcaactatcttggtcagtgttctattactgtgaagagaagacatgactatgacaagtcttataaaagaaagcatttaattggagcttagtgacaatttcagaggtttggtccactgtgatgtcagggagcatggtggcatgcaggcagaaatgtagctgaggggtttacatctggatccttaggcagcaggaggagagagacactgagactggcttgggcttttttgttttgttttgtttgtttttcaagacagggtttctctgtatagccctggctgtcctggaactcactttgtagaccaggctggcctcgaactcagaaatctgcctgcctctgcctcctgagtgctgggacaaaaggcgtgtgccaccacacccagctggcttgggcttttgaaaccccaaagccaacctgcagtgacacgctttcccaacaaggccagacctcctaatccctttcaagtagtgccatttcctgatgactaggcattcatatgagcctatgggggggggcatgtttattcaaaccttcacaaccactattaaggaaacaaatgttaatagaatttagacaaaagagaacctttatacagttttggtaggaatataaactagtccaactactatgtgcagcactatagtagtctttaaaaaattaggtctaccatataacataaatataccatgccctagatttacccaaaggactcttaagtcaacaaatcacagagagtcttgcatattaatttttaaatgaaatcctattcaccatagttgagctatggaaacaacctaggtatccattaacagaagaataaataaagaaaacacacatatatacatgtatatgcatatatatgtatatttatatgtatatatgtgagagagggagccttaaaaaacaatccctatcaaaattctaacaccattcttcacagaaaaactgtatatacaaagtatattcacattgtaaataaagaatgaaattttgtaaggaaaaattgatgcaaatagagataaccatattatgcaaaataagctagtgtcagaaatgcaaatatcgtgttttctcttatttgtggttcctagattttatgtagacataaaatcataatgtacaagtagaagaaacaatgtctaggggtacaaagaactaatgggagcagagacatgggatggtgcgattatagaggaaatatgttcaacaagctatatatacttatataaaatggtccttatgttaaaaaatgtaccatgtatagtaaataaaataataaaaaccaggaaatttttaaataaaaaaggataaaaaatattccagactcctgtgcaagcatgaaatatatttcaaggttctccttattttttctgtaatgtctgtgatttatagacttctatataatgtaggtgtttagttagtgttaactggctttacactgtctcatatctgtaagtacattaaaaagggagcaaataagtattagcaaaaatatacatgaatggaaatttaagttgatacatgattgtaaggatgaattagcaccaaaatgactaaattcccaatatcagaagtaaactaattcatcctttctgctaaaggaagctggattcctattgaaaatgaaaggcaatttgaacagtctgcaaagatataattattctgcctgggaaatatgagaccctgcatctctcctgcaacccccaaaagaaagaaaaataaatcactattctgagataacttgcctttctgtgaagtgacagttctttaagaaatgcatttacctacttcctacaaaggtaacaaccaagtgagttaatatcctttcagctttgtcaaaaccatttctataccccatgttagtttgtgaaggcagtcaaatctggtagcaaaatactgatttgaaaagaaaatttccagaagaattaaacatatggttctttcctaagcaactggctagattaaatctaaataaatgtatttttaacatatactggaaacatttgtgactgcttaatagtggggactgtattagattttgtagtgtgacaggagctgaaacttgataaatggacattgatgaaaacccataactggtcaataattaaccatttggagttcagaacatgggacagaaaaggcactgttgatttattatatttttgttccttctacaaaagcccattgggtgtatttacaaacatgtagacaccaaacataaccaggatcacacctgggctatacaccttctccaaactcattaactgaaaagatatagattaattggagggagttcagagaagagtaacagaaatgattaaggggcaagagggattgatttatgagcaaagatgaaaagaattttgtctatacaatttagctaagtgatgactaagggagaagggggtggggacccaactgtctgaaggatgtaaacaccaacgagtaaagagaataatttactatgcaacatgggaatataaatagggctaataagctgtaattacccaaaggaataacagaataagtagttcagggaagcttagaaccatgagactgccaacttatttcacaaggagacaccaacagacatttctagtcttatccaaattaacaagtatttcgtgtgaaataatcatttggtgtcactaagtttcctcttcctcagccttgtcaatgactgtgccttttctatcactacgatacagttcaagtctagtttaccagagttctacataatttgcttagcactggtgggtctttgagcgttttattccagtagtggccatgtaagaacttctccttttggatgagcactccttaagtactgtgaacagagctgtaaaagcaccagaacaagggctcaaacctggaggaggggaaatcttggattcaatttaggattgtaaacaagccagaattcagagtgtttatgtttgggtctccagtataatttttcaaaatgtagctcatgttgagaaaagttcaattttagcattattggaaaaaaaaggggacactaaaaataaatctttgtaagcttcatgatttgtgtaaactttggaatgtggttcttcaaaaaacaagttggtctgtgggttcctgccggctaagttatttggctaattcctagtgtgctatcatgatggtccaaaagcattgcatctaactgctccagagaagattttgcatgtcgctgcagtgaacgcagcctcttttgtatgcatacttttcctcttttcttttgtgttgagaagcttcacagcatgagtcaattctggaaatcattttgggggttgagttaaggttttcccttggtcactgtgttgacatgttcctctggttttgccttacattttatacttccttgtcatcacctttgggggcaaacaacatcttaatgcaatgcttcatttgtcgtattgaagtgtgttttaatttttacacggaggagtttgaactctgagactcacacatgctaggcaattgttgtagtactgagttattgttttggtctattttgtttgtttgtttgtttgtttgttttagagaagctttagatttccagaaaagcagtggcaaagacaccctgcccctggtgtcttttatttctatagtccacatgccacaccaaattaacattaacagaattatcaagtgatacattcttatgaactagaattcctgattgagtcacattgccttagatttgatctattatctaatatctgttttattttccagggttccatccaggaaactatagtatatttgatagtcatcatgtctccttaatttcttcttgaatgtagtaattaattagacttcccttgctttcaaaaacatttaacaattttgtagaatgacaatcaatttgattaatctgatgtttgtttcatgattaagttttggaaggaattaagaccataaagctaaaatatatagtatcaatggtacatggtttatattcagagttaaccttggtcacaaggtaatattttttaagatttctcaactctaagattattttatcccttttaaaactttattctttgtaggggagttgtgatgtccagcccccactcaagaaataaagatttgtgctccatctccttgagagtggaaatagttacatagattatatggaattatgcaaggttgatttttctgatctcatatatatatgtatatatgtatatatgtgtgtttgtatatgtgtgtgtgtgcgcgcgtgtgtgcgcacgtgcatagtagtttaaaattaacacaagcctctgtgggaatgttactatattagtattcatggttatctagagtttctttaccattatgaataacactcgtcccaaagttcccaaattaaactttcttgcttaaaccctttcaaaacaatttctcagaatgagttacatatggccattttcataaaagtatataatgtacattgaacatgtttttctcatacgtccctgtggctcctttagtcccctaattagtttgacttctactttcatattatatgtgtgtgtgtacaaacataataagtaaattatatattgtatttatattatatataataatatgtatgattttatgtatgtatataaattctatggcctacaaattagagaaaatgtgcaacatttttctgaagctggcttaaattccttaagcactggtctcaccatgtatttcagtgagattgtttcaaacatacataataagattctcttatcaaattctgtatcccaccctcagatcaatcccaccatgactttttaaataattttttttcattctgtaaggttcactctactataatgttctgtgtagtttgaaaaatgccatgtatctggtatctggtaagtgctatttaaagtctatttatcatctgcataggccatccctttctaaaatgtcatgtaaataggatgataaagtatatagagttttcaaacattttaatttattgtgggttgtgtgtctatgtgtgtgtgtgcatgagtcacattccaaggggtttgtgctggctggttttgtgtgtcaacttgacacaggctggagttatcacagagaaaggagcttcagttgtggaagtgcctccatgagatacaactgtaaggcattttctcaattagtggtcaaggggagagggccccttgtgggcgggaccatccctgggctggtagtctggggtcctataagaaagcaagctgagcaagccaggggaagcaatccagtaagtaacatccctccatggtttctgcatcagctcctgcttcctgacctgcttgtgtttccagtccagacttcctttggtgatgagcagcagtgtggaagtataatctgaataaaccttttcctccccaacttgcttcttggtcatgtttgtacatgaatagaaaccctgcctaagacaagttggtaccagcatagtggggtattcctgtgataacctgaccatgttttggggaggactgtggaagaactttggaactttgggctagatgatccatttgatgttaagagctatttcaggagtgggtgataactggtgatgactcagcagttaagagcactgactgctcttccagaggtcctgagttcaattcccagcaaccacttggtggctcacaaccatctgtaaatgggatctgatgctctcttctggtgtgtctgaagagaatgacagtgtactcatatacataaaataaataagtaaataaatctttttaaaaagtgctctgtagtatgatatgtaggaccatggaacataatgttgagaacagtgcagaagatggaggcttggcttggaaaatttcagagggatgactaaagactcttttcagggccattgctattttgattgtgaagattctgtggttttggttacctggggctgaagaatcagctgtgattaacaagataccagaactactaaagcaaaaacttttcattactgggactattgatgctggttagttggagctaagaaattagtggtgattaagaagagaccagcatcactgaagtgaaatcttctgggaagtgttttctgagagcacaaagaggctgtgttccagagatagccaaggttgtacctcctgctgcagcaggacttggtaatgtataagagtcactcaggtggtactggttttgaaggcatggaggagtcatgaagtgtagtacaatgaagagcagctgaggcttggcactgtgagaggccatggaaggccattggtaaaggtgcagactcagttgcaattgatggcccaggtcaaaggggtcatgtcatgtaaaggagttgaggcttggcaccatgaagagagcccatgagaggctattgttgaagcctagttacatcggaagacagcagtgttttggagatgccagtattataggatgaccaccaagaacagcagcagcagtggagtacaggcgccggagcctagaaggcaaagtgtgtgctacaaagggcaaggctgcagaagtgacccaagcccttggaggagcttagaagatccggaatggatcccagacattggacagttggagtttgattttgtttttgattgtgactgtaccctgataattttccttcctgaagtaagaaggtattttagtggagcccacagttaaaagactttgaatttttaaaagactttgaaatttaaaagatattggatatactaaaggaattgaaattttaatatgtaagaatttgcaaagactgcaggacttctaaaattatttagatcttggggatgaataagaaagtaagagttgaggcttaatagtgagtgatgtgtttgtgtatcaggttgacaaggagtcaattgtactggctggttttgtgtcaacttgacctcaagagcaatgtggcagtgtaagctgaataaacccttttctccccaacctgcttctgggtcatgatgttctgtgcaggaatagaaaccccaacttagacagcgttcatatggtagtcagaggatgacttgcagaaatccattttctctccacaacttgaagactagagctggaactatggtcatgagacttagtgacaagcacctttgcctacccagctatctctctgatcccaaaagtctatggaatttccaagtgacttacttacttatcaatatggttttcaggttaatccaggttttatgtgacctcatgacatactcccttttttaaaatagcattctattatatggatatatactatattatattcatatattcattcatttaaattacatcttggttgcttttaatttggataagtataggtaaatctgacctaggcattttattcatatgtttatgtgaatataaatattgaagttgttggataaatgtcattggtagatttgtacatctagtacattcttccaaaatagttctgttaataagctttatcattgctgttaccaaaataccttccaggcacaactttagaggggaaagatttattttggctcttggtttcagagatatcagtctatcatagcaatgaaggcatagcagaacgttaatgtcaatttatgccaggaggcagaaaaggggtgaagggaagccagtactcagcttgttttgtactttttcccattttacttttatctaaaccttcagtccatgggataatgccacccacattcacaatgggtcttttttatacatcatttaatccttccttgcaacacgcaagcatactgaggtatatatctcatcaatctaatgaattcttcatgcagtcaggttgacaatgaagatttacaaccacaaatgatttatcatcatttcattctcactagcagtgagtgagggtacctcctgctgtgtacccttgccaacaattggaattgtttaaaaagttttaacctttttaatggtaccttattgtctttatattacactaatgacaagctaaacttctgttttttattttgttattagatattttcttcatttacatttcaaatgctatcctgaaagtcccttccaccctccccatgtcttgctccccaacccacccactcctgcttcctggccctggcattcccctgtactggggcatataaagtttgcaagaccaaggggcctctcttcccagtgatggctgactaggccatcttctgatacatatgcagctagagatatgagctctgggggtactggttagttcatattgttgttcctcctatggggttgcagaccccttcagctccttgggtactttctctggctcctccattgggggccctgtgttccatcttatagatgactgtgagcatccacttctgtatttgccaagcactggcatagcctcacaagagataagctaaacttcttttgaataatagaaaagtaaaagcctctctctttccttccagcccccccccgtgtgtgtgtgtgtgtgtgtgtgtgtgtgtgcagtacaaacacacatgtagttcaaagatcaacattaggtatctcccataattggtcctagctttttttttttttttttgagacagggtctctcactaaacctagatctcaattcagtagcaaagtcaggaatctgccagactgtgtcccctctaaatccccagtgctaggattacagacacaccacatctggcattaatttggatgctcattatcacagctcaggtcctcatggttgaaaggcgggtgctttactaacggagcgctctctctagcttctccaaatccaacgttttaaggaatacttctactttcaccatttcttcctttatcgaaatcgaaggaccaactgtttatcaagtggtagaattaatttatataggaaaggggttgcttagcattcaggctgctacattttataactgtgtaggttttgtgtttctgtattaattagctacaagttaggcaaaaagaaagatttactaaggtgaacattaagtcactggtggcagagaatcaatcctatgtggtgattatgaagaaagtggaaggaattttattagtaagcaagatgcctataaggtcattgtctccctcttaggtccatcacaccctatacacacattcacatctcccattctccatccttaccacatgaatgtggaaacagtggtgaagaagactaaaatgaactcaggatatataccagcatgatttcttcagtacctttaattccttttaaaagttattaattaatgcctgactcttttacacacacacacacacttgtacaagggataaaactagggcctctcgccgggcatggtggcgcatgcctttaatcccagcactcgggaggcagaggcaggcagatttctgagttcaaggccagcctggtctacaaagtgagttccaggacagccaaggctatacagagaaaccctgcctcaaaaaacaaaacaaaacaaaacaacaacaacaaaaaccttacggcctctcatgcatgctagataaatagtattccactgatcagtattcccacagctcaaaaccaaattttgtttaatgtttttcagtgctaaggatttaacccaaggtcttgtgcatatcaggcaaacattatcactgaactacatcttaaattctattacatttaacactgacttaacttgtattttgtgaaatatatttagagcatctatgatttgggtagctcttccaagctgcaaacttgcatttccctcttcaatctatattatatctttatagtttcatgtaaggttaaaaatgcttaaacaaattttattttaattgttaatagagaacaatacagataacactgattggacatctgtgagcaccagacacttttatacatattctcattacacctcttgaagtaattgttgctccatcttatagattacaaatttcagaggaaaatgacatactctaaatgaggcatttgtacatgtgattccttctgcctggaatagcacttccattccatttccaatagcaaagtatcaaacctacaataatcacttcagataccatctaactccctagacagtagtctcagttcatcagaaatctgatacttacccttgtcaagagtcaccatacacagaaccatgccatctgcaaatagggatgtgttaacttttccccttcctgttggtagccttctgtttcctgctttcttctatgtccttctgttgtcttgttgctctagctaacactattctaactagggatggtgaaaatgaacatccttgtgttgttcctgatcttagtgggagtgtttcaagttcttcatttaacacaatagtgactattggtttatcatatatagcctttagtatggtaagataccccattcctagttttatcatgaagaggtgttgtattttgtcaaagatcttttttttttcatcaattgaaataatcatgtgatttctgtgtgagtctatttatgtaatgaattatatttattgatatatatatatatatatatatatatatatatatatatatatatatatgtaatccctgaatgaagataacttgtcttcccaaattttgtttgcaagtattttactgagaatttttgcatctatgttcactaagaaaattgagtaacactggtgttagttttctttgatggcctagtagagttcttcatttaacctatctggacaagccagttgggagatatttgcttgtggtgtgaacattgattaatgcagaaaaaacactaatggtccaagtgcagagagagagacttctggagagggacagtaagttttctttaagggtgtgatcctagtaggtgtaaatgctgctttcatttcttcagataaagggatgaaaggaaagctgtacccaagctgtgtgaatacacagatcaggctgagcccagagcatttccttctctgttctaaccatccctgggcctgggcctgggcctgggcctgggcctgggcctgggcctggaagtttctagcctctgtacaatctaatcttccaagcttactgattcaatcctgttgtgggttggcctcgtgttgtttgtcttttgatgttaattttgtttccttaaaaggggctgccctaactaggagtggatcacacactcaggtgattccatgtgaaccttctcccaattctagctggtcaaataaaggcgagggcctgtggttgaacagttagaaggaaaaggtagagctggaagattgagagcatggaggaagaaggacagaggaagaagaggtggaaagaagttggagcagaagcacatggcctggagaagctagcaagggacctcatagccgggaatagattagtggagtggtatatctgagttctctaggcttctaactgaattgcattgcctggcctcatactaactttggcaaaatattcgaatcttccggctccttttcattctctgactccttctgtcttcaccagtgtctagcttgttctctctgtaacttgtctctgtaaaactatcctggtcaaactgccacatagacacacctaccactaccaccccttttctctctctctcactgttcttaggtagcctctcttcccctgctgttctcatatgggttgggtgtagcttatctctgagtcattctgccaaatctttctctgattcatcactttgtcccttaattaaatgtcactttcaaacctatctccgtccttctacaaactaatcttaccttcattgttagggactaaaagtgtatactaaggacttgtctacattctttggaggtgatcccctgccagaacaaccatgttgctggattaaaatttcgttacaggtagatttattaagctccatggatggctttacacctgtgagtgtatgatcagcacaaattgaacttggtaggttattacaaaatttaaaaagaggacatgaatttaggagggggaaagagttggagatgagtatcaccaaaagacattgtatgcatagatgagattctcaaaaagttaataaaatactatagttctaaaaagaatcaccatacagatatgtatattcctattgaatttctcagtcccttttgcaaaatacagtagtttgtcactcactacatttagcaaacgaatcaggagcttatagaaatgcatttctttgttgttgttgtgggtgaatggataaatggatgtagagccacttgaacaaacttactcaaacaaatgctgaatctctgggaatgagtagaagtgaaagattaagaatgttattctaccatgaaaggggtggttttcctatgtatatttttgtaaacagaattagttattatcttgcacactataaagataagttttggtaaagtcttttggcaggtggagatgtaggcaattttacatgaggagtacttgttggggagcaggttgccatcaggaagaaggactgcacattaaagcaaacgtgagctacatagtaaatacatattaatacagttgacaaacactgtattaggatcacatagaaaattttaagaaatgtactacaaaaattagttattcacactttggttactttgatctttactgtattgaacattgctagcgatatggatatcttttagagtatattttaattcaatgaaatcaacttagtagtataacaagaaatgaagatgaacataaataatacaattccttctttcttacaacatagttaacatctagttcagttttcatcatgtaaaacctacataggaaaatattgcatgtgcaatcatgcatgtacacatgcacacacacggggggattttataaaaactatttgtttacattacatagttgggatattttgcaacttacaaaatgatttcataagagatcctaggaagctaaaattagtgatatgtgtatgtttatgtgaatatatttaaggtacattttcatagtgtgatgacactgtaagtaaatggcataatagctgctacaggattgacagctctgtctagcaaatgccaatcccactttatgtttttgcatttgaaggatatggaaaatttgtcattttacaaaagtttctagccaggggtggtagcaaatgcttttaatgctttctcaacactggaaagacacagtgaggtagagccagcctagtctacataatgagttctagcccagccaaggccacagagtttctcttgtatgatacaggtatttgttgaatacaatctcacttcttgccaaggaatgatacaaaacattttcttttttattagatattttatttatttatatttctaatgttatcccttttcctagtttcccttcaaaaaatccctatcccttccccctccccctgctcctcaacccacccactcccattcctggccctggcattcccctaccctggggcatagagccttcacagcaccaagggcctctcctcccattgatgaccgactagaccatcctctgctacatatgcagctggagccatgggtccctccatgtgtattctttggttggtggtttagttccagggagctctgggggtactggttagtccatattgttgttcctcctatgggactgcaaaccccttcagctcctttggtcctttctctagctccttcactggagactctgtgcttagtccaatggtaggcaatgagcatcaacctctgtatttgtcaggccctggcagagcctctcaggagacagctataacaggtttctgtcagcaagcacttcttggcatccacaaaagtgtctgggtttggtgactgttattgggatggattccccaggtgagtcagtccctggatggtcgtttcttcagtctctactccacactttgtctctgtaactccttccatggttgttttgtttcccccccttttaagatggatatcagtatccatactatagtcttccttcttcttgagtttcatgtggtttgtgaattgtatcttgggtattccgagcttttggactaatatccacttattaatgagtacataccatgtgtgttctttgatacaaaacattttcaagatggcactttccatacaactatatatgatccgaggtaaggtctttgattactatttcaaccattagtgtaagtcagactgaagattgggactgacccacggatgtcagtactgacatgattatttattgcttagaacttgactctgcatagtcccagttcaatgacaattcaagaccccaggaagatattatacagatgactagatttgctaaagaaattttaaaacttttttaaaggtatttaaaattcctgcttctttttggcagtgctaggtggaacttggctcatcatagagctggagtaatcaaagagtgagcaaatgataatttagatccttaggcaaacttacaagctttgaagctacagtatttctaattgcatgcctaatggctgattgacgtgattctgacaattacctcaaaatactactcttagttgttgattgtttaccagtcaccttccactcctccacataaaactctgattcacagactgacaatgatctgccagggttcaggttgtatcttgctacagtgtagattttacttgggattaaatgaaagtatttcataatttcatatttacttgaatgtatattatatggcatatattcacacacatacatatacattcttctaaagtagaaaacaccctaatacttaggactgttcttccttcttctgccatgggaaaagcagggataccggaaacattgggaagtgtggagaaacttaaaagaaagacactgctgtgaattatggccacttttgtggagttcccttctctctcagacctgctcagaaatctctggttacttcctaaaagtcagctcacaagtgattctccctaacttccctccattttaaggaaaagctctctcttccgtggctccactgagttccttcagtgaccttactatatggccctggtcccattggagtgttcagtcttaactcctcactaaattgtaagccttaaagagcatctacgattcattagatgtgcattgttgtgcacagtatttgattaagacaagtactcggtgaattgttgagaaatggatggatggttaaatggataagcgataagacaaacaaacaggaaaagtacatccattcatcaatgtccgcatacttcaacaaaagtctaaactttcttcctaatgttctatttcaggcatctgcatataggagtagatgttcactatgttgctttcaacttatatatcatctatggatatcataattttaatacggaaaaattcaatataatctacttcattaaaaatttcaggaataaaaaatcatatgatcatataagtacatgcaaataaagtatttaatgaaatcaaacaaattgtaatatacagatatattctcattcttataaaggacaatctatagctagtgttatcttgagatgaaaatttgaagactttttttctaaaatcagaaacaaggcaatgatgtctgctgtcatcacttgtagttaatgtgctagaaattctagccgaatatatagaaaaaaggcaactaattttgatgctgtttattacagtgtttgaaaatgatgctatctttatatgcagacagcatgattatctttgtaagtcataagaaagttacaaagcaattacaagaactagtaagtcagtataactagttcacagaatatgtcactattaaaaccaatcatattccatagttagcatgccacacactctgcccctaagatccttccatgccctattttcttactgtttcattgtcctcatatctgcaccttgtacgatgtaagatcttttgacatgataatccaattatttaaaatttgttacttgaagctgaaggggtctacaaccccataggtggaacaacaatatgaactaaccagtgcccccagagctcatgtctctagctacatatagcagaagatggcctagtcggctatcactgggaagaggggccccttggtcttgcaaactttatatgccccagtacagggaaacaccagagccgagaagtgggagtgggtgggtagaggagtgggggtggggggagggtatagggaactttcgggatagcatttgaaatgtaaatgaagaaaatacctaataaaaaattggaaaaaaaatgttccttgagaataattctaattcaaaaattaaataaactggttaaaactcaaaataacggatcatattccaatgtatactaacaataaacgatcataaattttcaaacactataataaaagcatcaaatttttgcaatattaaaatctcagttttggtttgcaacctcataggaagaacaacaatatcaaccaaccagacccctcaaagttcccaaggactaaaccaccaaacaaagagtatacagggggtacccatgactccagcaactgtagcagaggattgccttaactggaatcaatgggagggaagccccttggtcctgtggaggcttgatgacccaggataggggaacactaggccactgaggcaggagtaggtgggcaggtggggagcaccctcatagaggaaggggaagggaggaggggaaaaggggcttgtggaggggaaactgggaaggggtataatatttaaaatggaaataaataaaataaccaataaaaaaaatgaaaaaaaaatctcaattttcacaaacttgattttataaatgtaatgcaatcttagatttttggcaaaaaccaagaagatgattttaaaacttctgttgacaaatgatccagaatgtctaaagcataaaggaaaagttgaaggtcttatgctgactgatttcatagtatattaaaaagttatagtaatcaagacagtgtgttaacaaaaatcccaacacaaagggggaaatggacacaaaattctacccctaagaagttatttgcaattggtacatgttggaagacagaaaatcagtgttcttcaatggaacgacactgggtagatctgccatgcttcaggacaaccccatgtccaggagtagagagccaagtgaaatctcagttattttagtgctttttagtgactttttgcttctttttgaaaaaaagagggaaatatcataaagttgggtaggcggggaagagaagaggttctgggaggaattggaggacagagaagaatatgataaaactgtaccacatggaattctcaaagaaaaaagaaactgaaatacatggcataggttagaataaaatatttgcatagcacttacctggcttatatcaagacttttggataaattattaaaacctggataataaatagatatctcactattttaaaataattaaaaggattgaacagaaatttctccaaagaaatgtatgaaaagatgttcagcacattagtcactggggaaatgcaaactaagacaacattgagggctgaagaggtgacttcatttgtaacgtgcttaccatataaccatgaagacctgagttcagctcctcctcggcacctgagccaggagcatatgctagatctgttgctagagttttgaggaatcgccatactgatttccataagagatgaaccagcttgcactcccaccagcagtaaagaggtgttcctccttccccacatccccaccagccattgttatcatttgctttgttttctgtctttagccattctgactgggctaagatgaattttcaaagtagttttaatttgcctctctgcaatgactaaggatatggatcatgttaaaaaatatttctcaggtattgcatttctaattttcagaactatttccatgccacaagttttaattatgtttgttttctttatgcttgtgtgtgtttattttttagttcttcccatattctagacagtaaccctctgccagatgtatacctggtaatgatattttcccattctgtgggctctctattcattcaaatggtgatatactttgctatacataagcttttcagtttcatgaggtcccatttttcaattgttagtagcctgtgctaccagtatcttcttcaaaaagttctttcctgggtctataagttgaaacatattccctactttaacctctaacagattcaggatatcaggtcttttgttaaggtctttgatccatttgtagttaagctttgtgcaggtgagagataaaaatctagtttcattcttctccatggagctatccaattccaccagcagtgcagagttaagattctttccttttcagtgtgtattttggccactttgccaaaaatcaggtgtctataaaggaacatagacttatattggggtgctcagttttgttcccttgatcagtgtgtttgttttactatcagtaccatgctggtttgatggctgtatactataacatgaaatcaggggtggtgccatctccagcaatgcttttattgttaacagttgtattaggtatcttggtctttgctgtttccatatgaattttgagagtgcttttttaattatgtgaaaattgcactggaattttgatgggtactacattgaatatgaagattgcttttgttacagtggacattttcatgatattaatactaacaatccatgaacacgggattgttatatttttcaatcttatgttatatttttcaaatctttaagtgtcttaaagtttttattgtttatatttattcccagatatttttgaagctattgtgaatggaaatgttaccccgatttctttcttagtatgttcattattggtatataggacgccggctatttcagctgtaccactcctgagcatattccgaaaggactctatcctactacagagatacttaatcttaactccatgttcattgctactccattcacaacagccaggaaatgaaaatagcatagttgtccatcaactgaaaaatggacaatgaaaatatgatacatatacatattggttggaatttttgtcaacagataccaggatcatttggggagactgaacttcaattaagaaaagtgcctacatcagactgatttgtgggcatggctgtggagtattttcttgattaatgattgatgtgagtggaggacctgacacattgtgggcaatgacagctctggatgggctgtcacatggagggacccatgactccagccccatatgtagcagaggatggtctagttggtcatcaatgggaggagaggcccttggtcctatgaaggctggatgcaccagtgtaggggaatgccagggcagggaagcaggagtgagtaggttagtgagcagggggagtggggaggggatagggggttttcagaggggaaaccaggaaaggggataacatttgaaatgtaaataaagaaaatctctaattaaaaaaaaaaagagaaagaaagcaggctgagcaaaccatgaggaacaagccagtaaacagacttcctccatggttcatggtctctgcttcagtttattcctccaggttcctgctttgagatcctgccctgactttccttcatgatagactgtatgttttaaagtaaaatagaccctttccttccaaaattgcttttggccatgatgtttatcacggcaataaaaagtaaactaagaattgttcagctataaagaaaatgaggttatgaaatgtgcaggtaaatggatggagctgaaaaataatcattctaaatgagataggtaaaccagacaaaccatataacatgtcctatcttatatgtggatgctaactttaagatgtacatccaaattgaagtacccatagaagtcggaaaactaggaaggagtcaagatttcaacagaagagggctagagcacaggtggtatgaaagtctaaattggagttctccattgactcccttttttgccttgtcttattctatcctgttttgtcctgtttggcctgtttgaggcctactcttttctgaagggagatggaggcaaagtggatctcgggaacaggggaggtagagaggatcttggaggagtggagggagtggaaactatggttgagatgtgttatatgagagaagaacctgttttcaataacaaaagaagttttgctggaaaaaaagaaagagaaataatagaacaggaaagattaaatggtgagggagataggagattggggtaaaagagggagtatgagaagggattgctaacactaaaggcttttgaaaataccatgtagaagtctactactctagaagcttcctgaactatatatgcatacatatacaaaaagagttagggtggagttaccctataacatgtgaacaacctctctctcagataccatagtatcctccttttgtgatgttgtcttgtctgacaccattaactgggtgaaaaagcatggctggctaggtcataggtcctaaggaagaagctaatgctattactctgctaaatggacttagtattacactgccccctgaattctcatctttatgcccagagagattagtgctctttcagcctttatcggagaagcttcttttcagccgatggcagttaataaagagaataacaactgatcactttacagagactaggggattttaggatgctcaattctaattggacatctgtcctacactgctacaccaaagctcaaaaaatatttgggaagaagggaatagagttataaggagaatcagaagtttagagtgcctgtagcaaaacactattgttgaacatgacaccaccattgcacacagaattaatagggaatggataggactatatgcctccgaactctacaggctcaagcaacccaaaattccatcatgaatgggagagggggtcatgaagtcccacccctacctgaggaggtattgacaagtgacatctgctaggagagggagagagttttctttagggatatgtcccctgagaagctacccatgccccagtagacagtcctatgcccatgcatatgcaggcaacattaaagagactctaagatggaaatgaagttgggagggaaatgtggtttagggagtgaatggggatgaatttgatcaaaacacattatatgcatgtataaaattctcgtgtgtatccatgcacaatgccttgtaatttcagctcttgagagcatcgagacaggaacctagagtgcttgctagacagtcaatctaattagaactgtgaattctgcttcgcatctgcgagataacctgtctgaactatacaaggtggagagcccccatttcccctctccaattcctcccatctctatattatatcaatcgaaaggaatacacacacacacacacacacacatgcaaaacaaatatttaaacagcatggagaaacttttctgggtgttagacattgtcattattttcattgcgatgatatttttacacatatgccaaaatttaccaagttttacactaaagaatttccaggttttataagtataaaagaacataaaataacctctgtggatgaaaataaagcaggtcataactgtatccacaatttgtgttaagtttcaatagtttaagagagagggcataggctttaaggcagatgagagagggggtatgtagagatggctccttgtcaacactctttcaggtgaaatttctcaggctggtttgaatttggattgctattttaaggttcttggttaatttggaaatagccatatgattatttttatatcttataaagtagtgaatgcatgtggtttcagaaagtatgaactatgtacacataagcttataatatatggaattaactgggatccagctcaaggggagaccccaaggtctgacactattactgatgctatgatgtgctcacaaaaaagggatctatcatgactgccctccaaaaggcccaagaagctgctgaaagagtcagatgcagacacttacacccaaccaatggactgaagtcagagacccctgtggttgaattagggaaaagctggaagaagctgaggaggagggtgaccccataggcagaccagcagtctcaaccaacctggacccctgagatctcttactgaaccaccaaccagacagcatacaccagctgatatgaggccccccaacacatatacatcagaggactaccgggtctggacttgatcagagaagatgcacctaaccctcaagagacttgagaccccagagagtggggaggtctagtggagtggagggagcatcctcttggagaggggggcggaggaggaggtataggtagtggactgggaggggaataaagtctgaactgtaaaaaaaaaaagcttaaagaataaaaatattcaaaaacacacacaaaaaaccccaaaggaatagttggaaatttttaaaataatttttcattaaaatttttctctccaccaatttttaaaatagaaattatacttgtgtgattttttttcagttctctgattctgtttttcattgtattgtctatgataccataagtttctctactttcttcatgatgaatgtagttaggagcctctgctcctgcttcttgtggatgctaccctagttgtcattaattgtcaagttgacatagccccgtgtcatctaagaaaagaggcttgagaggcatttcctaggtcaaattaacctgtggatgtgtctgtgggacttgtcctaacaattaattgatacaggagggcccagcattctttgggtgtctcttcctaggcaggtggtacaaagctagcaaagcatgggcctgagaggtagccagcaagcagcgacctcccatgggtcttctctaatttcttacctgcagtttcctagtcagaagtaatgtcatgtggaatgacagttctgccatcatgttccttccttgtattcctgccctgacattgctcagtggtagattgtgagctgcaagagtaagatggggcaaattctttcccctccaagttgcttttgatcaagatgttctgtcacagcaacagacaacgaatggtaacaggcaccttccgttttcagagccttggttgcttcaatttggattttgtgctccgcaggcctgccgtgcagccctcaaccttggccttactttcattagtctctggttttaggtccactgttttctgaagctaatatatgtgtcaatctttgtttactcttacattttgctagaatatatccctgagtaactttgtaggaatagggtgtaaaatgtgaagtttgggaatttgtaaaaataaaaacatcattcttttgctgtcagactcaattttgagttaagagacagattacattttcaaaataatttcccttcagatagttgaaggtgtttctctattgctttctcttaaaaataggttttctggtaagaggatcaatttattcaaaatcttgtccatttaactgttgatgtttttcctttgtgaaagctcttagggacttgtttttttcctttctgaaagctcttagggacttgattttctgaactgttaaaatgtgtctacttgttgaggaaagtgcctaccatactctgtatgaagcctgcaaggcaataaaccacacccatctctatagttgttaggcttgggaacttataaaggactctggaactgtactcttcatactgtgtgcctcaattctttcacattttatttaatctctttagaaaaagctttctgatttgtagggggaacacttggaacgaaattcctgattactacagattctatacatggggaaagaggtgactgttctgtatgtagatgctcagtgaattcctcacatcctcacaatcacacccttttttatggttctgtaactccaggtctacatgctccatgatacactgtgttcccaggacctcaccctcttttcatttgtcctttccaaattttaaactactccattgtctctttgggcaggcccatatctccacaagctctaaactcccccttctattttctctttattagtccatctttattatccagaactctacctactttctgtgtttcagagacctattgaaatctcttttctgctgatatcctgtattgcttcgttatctgtttaatatcattttaatttgagtcttgggagccaatggtgctaacatggcttggttagtcagcttccttgtctatatgtgtatatccctgttaaatgttagcttttattagttttcttatgattcttttgaaaatatttgcaattaggggcaattaggtatgagctggacaaatctacaccgtttacccatcagtagaaactagagaattcattagggtaaaagccctgtgagagattagtagacagtggtggaatctgattctccattgctttgtgggaagatggctttctcctgaaaactaacaggcaaacataggatatacataaaattaactctactgaaactgttgttatacttcattttatcctaatttttatcctaatttcttttcaggggctagctctgctgtgatactatggggaaaaaaagttaggagacaatagtcagcaagaggctttcattgtgcagtggtgtggccacaaatgaaaggcaggaattttcctctgatcaaacagagttttccatagacacagtctagaagtagattctaatcagcagccatgttgaattttgtttcttcttgtctgttatacagctactataacaattttggcctgccattatatcccataaccagttatttggtatttaccaccaggaggcctggcccctcttggacagaggaggaacaagaatgccaagctgactgagaactgaactgtaacttcggatttgtctaatctcacagtgaaatggtctttctttatacccttgcaactttcttgccaatccctttataccacttgtggatctcattttacagtatttaaaatggtgaatttgaggcccaggtcttctactacttttttctaatcttttggcttgtttcagactattattgtgggctgaatctctcctaatcatatcactagtgattaacccgcctgtccttaagatatttatatcttagactccatcttaccttccctaacctttctctttgaagttatcaactgatatctgagatttctctctccctccttttcttcccccccacaccctctttcctgccctgtcttctctcttcatcttcccttccctccctctctcctccttttgtttcaccctctctttttcactctccctctccaccatcatgatcctcttaccctagcctttcaagtacttggattgaaggtctgcaccaccatggctcttgagatttgttttctattttctcattttggaaagccagtttgggattaaaactagttacaattgattttagcatcaacttaaacagaatgtgatttatgtctccctaaaatcctctccgcttaattttcctaagatatctgaaacatttgtttctgtctcagcatcagtagtgacctgtgtcttactttgattttacctagtcctcactgataagttcttatggttatcactttatagtcacaggctacctcactttacccttcttccatacttgatttttaatatcatggccaaatatattttaatttacatagtttacagggcttggggctctataaagaacaaaacagattttgtagaatgctgctgacagagaaattttgaacaagcagaaaagttctagtttaaaatagattatacaaacaatctcattttgttcaccttcgtgctctgacctgttagtccagctttaggaagataaactataacaaaattacacaatgttcagtctttaattcacaatcaagaggatgcacttgaacttactttcttaacccagagtgcaactggtttataatatggtcctactccaagtactacaaatggaggtgcttctttcctttaatatgccaatgtgctttgatctttagaagtatgaggaattacaaattaaattagcaaacaattcctaagggaagtaagtgatagccactatatatcattgtccttcttaattaagtatgttacttctaaatcttgaactgaaagtcctctctatatgacatacatagatacaaactactttttgatttatgcttgcagatgctatttgtacagtctgccactgcctgtatgtctctgttcaacttgtggtcagctaaaagcctttctccaaaaaagtttccaaattccatattagattgctagctggtctcttttgctattttacccagcaacccacagctatgctgtgttatttgaagctatgctttagtgcatcctttacaatgcgtcttatgttctgcctgtttgtggttatgctataaagctcgccataccaaagatgcttgagtatccttctgtcattgtgtctccacatatgtcaccaatgaacatagctttaatgctgatagaccagctgaactttcaaaatcccagtagtggtggtcctctcttgccatttcacattaagcatgattctgactctaacaatagaatagatcaatgagataaatgtgacatctgtgctggttatggatttcaaagtcatataaaagctgggcatgtttgtattgtccattgatacaaatcagttcaagaagcttgtctttttccacctctgttttgaacataggatatggaaaggtgaaagcactgcattcctccctctttcattagtagtcatgcttttataatagccctcctttcccccttgatatgcatcataagcagatttcacacttgtcctacggacaagtctaaacatattctgaaccctctttgaggtgcctataaagagaataaaatttatattaaaatatataaagcattatttaataaaggttaggtaacttgttcaagccaaaactgagtaagaaaaaaactaaacattgagctggtttattatgcaatttaacactgataccacactaagataatctccctaagcagaggtactgtactttctaattttttttttatttttcagtaacttgcattgtttgacattgatgttttttagtcaggctgcctaggaagcagtatccagagactgcatttagctctatgtgtgatgaaagtgttcattctgtttagctttactacataatttcacatgccttccagtggatctattgaatggatgaaaaaaacctagcatccccatcagagatactcaaggagccaatttcacttcgtgtataggcacactgctaccactgccaccccaactcagctggtggtatctcctatgggatgacgctttgatcaatgttgaatgcccttgtttgcttactcccagaaagtagcacacagcactgcactctgttcagcagtcagcaaatactgtgcctttcttcttaccattgagttggaaacatttttatctccaattaagtactatcattccacttcaaataaattgtgtggtttgccctttttctacatatgtttagaatattgtctaattcagaacctttcatgtgctatgtacaaaatgtttgttcaaaagacagcactcgggtccgagacccgccgaacttaggaaattagtctgaacaggcgagagggtgcgccagagaacctgacagcttcaggaacaggcagaagcacagaggcgctgaggcagcaccctgtgtgggccggggacagccggccaccttccggaccagaggacaggtgcccacacggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccagccaccgtccagaccggaggacaggtgcccgcccggctggggaggcggcctaagccacagcagcagcggtcgccatcttggtccgggacccgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtccaggacccgccgaacttaggaaattagtctgaacaggtgagagggtgcgccagagaacctgacagcttctggaacaggcagaagcacagaggcgccgaggcagcaccctgtgtgggccggggacagcggccaccttccggaccggaggacaggtgcccacccggctggggaggcggcctaagccacagcagcagcggtcgccatcttggtcccgagactccaaggaacctaggaatttagtctgcttaggtgagagtttgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagacggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgaaaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaactttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctgcatataaaattaactcaaacaagtcaatggcctttctctacacaaagaataaacaggctgagaaagaaattagggaaacaacacccttctcaatagccacaaataatataaaatatctcggcgtgactctaacaaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccatcaaaattccaactcaattcttcaacgaattggaaggagcaatttgcaaatttgtttggaataacaaaaaacctaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggatctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatgaaaaaaaaaaaaaaaaaaaaaacaaaagacagcactctgaatgaccctctccagacctgtttataatcaaagcgtattaagtgtccttaataagattaaaaatgtgttcagtaccaccttttgattcattttctatctaagatgtgttaaccaagttcagtgcttcactaattactacaggaatacccctatcttgctatgatggaagcacttgaagattttgttaagcatttaaaatacagcttagtagtagaatgcttgcctagcatgttcaaagtcctgctcaatccctagcacggcaaggggaaacaactcacatttcagagaataaattatcttatttttaaagctgtagagtgtgtgtgtgtgtgtgtgtgtgtgtgtgtgtgtgtgtgtgtgtatgtgtgcacgcgcgcacactcacgcacatgcacacacgcacacacacacctgttgagtttcaaagagggcaaatgatcccctggaatggggtaataggcatttgtgagctcccagaaattggtgcaggtaactaaactcagtcttctgaaagaaaagcaagcgcttagccactaagtcttctcctcaggccctcagaacgtatgacattttaatgtttcagaagtctcagctgattattgatagatgataatgatgatgagatgacattggctataataggaaagatagattaaataaattaactccagaatattgaaagagaaaactttttaaagtaaatgatgtactaattttagaaagtctgatatgcacatgtctcctgttgagatggagtattgactttttataacctgattaagattgacagaagaaaaggtaaaaaaaaaaaaaaaaaaaccactagctgtccaggaacccttttttactaaggaaaagaaagacaacttaaccttttcagtctaggttataaactagtttcagaacacacaatacagaagtctcttgaaatgtatctcagtgattatgtgtgttgcgatcccctaaagagcaaatttgggtcaggttcttggatttcacttcaggtctacacaatctaaacttagtggaggatggggatggaggcctgggattctatacttttaatattcatatgtagtgattctgatcaagaatgtataacactcacctacaaagtctctcagttttagcatcctatcaatttcattcattattaatcatataagatttagcctgtcccttcctggttggtctccaaaacaggcccaattagaatgaaatcatactgtggcttcaagaagtgtgtaataatacagtttgaatgtggagtccctaaaatttcaggtattgctcgtaagatgacatcatcatatggcaggactctaagatttaattaggccatgagagtaccttccttataaatgcgattaagtccatataaaagggtcttggtaaaacagtctgttctccttcccttcttctttctaccttccagcacacagtattccttctggaggatgcactaataaggcaccatcttggaaatgagtgcaatgctcaccagtcatcttaacattaattttgccttttcagcttccagaactatgagaaaatgaagttctgtgctttataaattactcaggtttaagtgctttgtgttagcagaaaaaaaaaaacttgactaaaatcgtttagattattctcttaacacggagatatttcttaggggcctactgtgtgctaggaccaggtctaggcactagttataaaaaaattggatgagctgtgctccttccctcaaaaggcttctgagtcatttcctgtgaatcagctagtacaatccagtatctttgcaatgaaatagaaaatgaattaaattcaattcagtctatgtcgagtgaaaagtatccaataaatttatagggtttgctattagaaaaaaaagtttgtagtagtaatccttggagagtcactacaataatgtatgtagcctttgtgtctcactgttagcaaattgtttctagctgtgatccctgtaatctgcaggtgctgtttaccatgtaattttaccataagaaacaagaatgtaatcacataataaagtgtaaagaattagattttcttccccttgagcaaaatgcctgactgtggccaacattcctggtgctctctccttgtgcaataggaaagcaatatgctgaaagagaagactattttgttcatattctacaacgtgcctctggagaccatactaatgaatgcagaactaaagctagaattcaggattcttgtgtgagaagctactgatgggttttttttgtctttatcattattctatatagaatatagtttccctcctgcctttaattgaggctcaaatagggcactgtgaatagggaaacattttgattaaaacgtgttttgtgttgttttctttcgttgtttgagaaaatatgacatattcaaagaattttcatgttcaagcaatccctttctaatgaatacttgacttatgaatatcctatactatcaacagcttctctttgagggactttgagatactcctacacctgtggaaattggaattgtttctgttgattgcataaatttgtctctcccccagcactcctgttttggaaggttgaattcttgtaagctgtcatcagacactttggaacaagtgtgaacaactttaatatgtgaatgacttctctttctgccaccaccaggatataagaacgcacaaaattccataccagacctcacatagaagttgtgcttaagaggaaacccaaagcacatgaagccatgtctgggagtgtagttggcaatggtaaagaggtgctccacttacatttggagtcctttatcccagaaataccattgtactttaataacatacccttctagaatttgggtatagacagactcatattgcagccacaattgaagcagtaagcaaatggtctctaatacagtcaatgtgcatcttatgaaagcactattcaaaactacactgcttcttgtttattgtttttacatgagcttaatcggtttttaattagatgatatgcctgtagccacaaatttgaaggatctagagaatacattctaggtgggtgacttgaaatctagtagttgacaacaaggtgacagtagaaaagaaagttaagaactcaaaaaacagtcataatgaatgtttcatatctatcatgaatgaataaaataaaaattactgacattaccaagtattagtgaagatggaaaacaccaagactcacatacattgatggtgggcacatacagtgctgcaatcactctagaaagcagtttagtacctatcacataaccctgagggccaactcttagatgtctttccaggaaaaatgaagatgtatctgcacaaaacttacacataaatgttcacaactagaagtaaccgagatgtacatcagtaagaggatgcacttaaagagtgataaccctatgctgcaaactcggggatattttaatatcttggaaagaggggttgaaagaacatgtgagttctggaaaacacttttctggagaagacatggatataacactcatgaactcatagcatctgcagttacctacataggatctatatgacacaggacccattaacattccagcatggatgagggagggccatagataaccttaggagctattggtagttcatggctactggatgagaaggagtcttttttgttcagggtttagccactggtaagaaggccaaactccattagtaacaccacacccatgtacatgcaggcaaccccaatgaaactcaaaagagttaaaaagagaaataagaaaaagaaatacataacactaggaataggacatgtggggaaaagctttagaaagaataggaaggcaataagagaaagaaatggggtaaatagaatggaaatacattatatacatgtatgaagttgtcaaagaaaaacttttaaaaattcaaaggacagagtcttatgataaaatactactaattactaaaaactaatggaatgcttatacatataacaggaattaatgtcataggcatactgaatgaaaaattatgcatatgcatatgtgaaagtttattctaggatgggagaaaccaaactgtgacaatagaaatcagaactgaagtcaacttggggcagaagatactagagaatgactaaaaggggcaaaaaggaaacttgtctagtcatggaaatgatctatattttgagttgagtagagattataaggattgtacatttgtcaaatctcttgctttaaaataacattttttattataggtaaaatatatctccattttcacatggcaagaattttaaggaagaaaaaaaacccttcacctgaccccctcctgttgatttggcataaattccttaacctgatccaatcccataacgcccccctgttcatctctcaccattcctctctacctcctattctaagttacaagtagttttacaaactgtgtttgtttttcttcttggaatttcaatacaatgttcctttcatctggaattccttttccatttgtaattaatcattaaatcctttccatcattcagggcctatgatgttacatcttctctaagaagcctcatttattagcaatctgtagtaggtgcttccctcttgctcaccaggtgatctcaagctcctttttaacaaagcatgtatttatttgtaatgtgattataataacaaaagcccctcaagattgtagtagactggggtcatttagtttacaagcaaataagccttcacttattctgcaaagccttgaaataaaagtaaattctatccaaaatagctcaggttctagtactcaaagttatagaaataatggataaatagttaggtagatagatggagagatagataaaaaagtactcagtgttaaaaataataaataaataggtagatagaataaagtactgttataaaaattaaataaataaatgtgtagatagatggatggatggatagatagatagatagatagatagatagatagatagatagatagatagatagataacagcttgttctatcccaagattattggcagtctttctgattcaggagtttgctttgagtctttattttgtttatttatttgattgtttgtttgttttccagacccagttttattaagaagcacctgacactgggtttatgatcttctgtctcagcctgcagagtgctgggattatgaatatgggccaccacacctggcaagatcaagatcttactttaaatgccagtttgatttcatattattagtgttgtattagctcatttatatggtggtttaagtaacatttctgtgggcttaaccagatttttttttgattctatggaaaaaatacattctctattacagtcaagtgaccccaaaatactaaccagttgaaccatgcgagtatgcatgtgtggatgtgtgcacgtggaagctccccagtgctgggatacgtataaatatacatatttagaaggcaacttgactgcatgttcatttagcaaaacatcaaaatagtaagcttccatctagggcctatgatttccccaatatggacttttgagcacgtttgcagtatcaagcatgcatttcctcctacgaggtaggcctcaaatccaatcagaaaacaacatgttgccctcagctaatgcaccagtgggcaaatcttgtctgaatagtcagttttgctacatgcagggttcttagctggataagaccattgatgacttttctccctaaatagcctgtatagcatctttcaatactacgaaagctactaccaagcagtatgcttctagctaagttccaacttcatttctctgtgtcctctaacctaggtgtgttctgtcttcaacaacagggtcataccatctacttctgataggtaattaagagcaattggcaatagcctgtattgttttaggggagtctgtgggttccctggagaatagccacttcatgtggataaatgtaaatgttttgaaatgtaacatgattaataatatgcaggttacatatattcatttattcattgatacttaataaaagaatctattctcctagatgactgtgcttaagtctactggatatagttgtttgatataaacaatgaatcataggaacttaaagaaagtttatatagactgttagggtttccatggggccagcccattttttttaactaataaatgcaccatacatgcagattcaggaattactatttttccagctggcaatagaatgaaaatgcattcattttaattttcaaaatcattaaggtatttaaacatagtaatatctaacttttattgagtatatattatatgagataggtcctgtgatggtccaataactgctttaggagtaaaatgctattttcaaatgaggaaatggaagcttaagaaatttgtccattctaaggaagaatgaagtatccacccttttgtctttgttcttgattttcttgtgttttgcaaattgtatcttgggtattctaggtttctgggctaatatccacttatcagtgactgcatatcaagtgacttcttttgtgattgggttaccgcaccgcactaaggatgatatcctccagatatatccatttgcccaagaatttcataaattcattctttttcatagctgagtagtactccattgtgtaaatgtaccacattttctgtatccattcctctgttgagggacatctggattctttccaacttctggctattataaataaggctgctatgaacatagtggagcatgtgtccttataaccagtaggagctaagacgaaaggatggaccatccagagactacccaacccggggattcatcccataatcagccaccaaacccagaccctattgcatatgccagcaagattttgctgaacggaccctgatatagctgtctcttgtgaggctatgccagtgcctggcaaatacagaagtggatgctcacagtcagctattggatggaacacagagcccccaatggagaagctagagaaagtacccaaggagctgaagggatctgcaaacctataggtggaacaacaatataaactaaccagtacccccagagctcatgtctctagctgcatatgtatcaaaagatggcctagtcagccatcactgggaagagaggccccttggtcttgcaaactttatatgccccagtacaggggaatgccagggccaagaagtgggagtgggtgggtaggggagctgggtggggggagggtatagggaattttcgggatagcatttgaaatgtaaataaagaaaatataaaaaaaaagaaataaaaagaaatttgtccaaggttacacagcagtagggtacaaatctaaacctctgtgcactgtttaccttatgcgcatcttctcacctcaagtatatacttaatgaagctatggttatcattagtgaaaccagacccattcacatagcaaacatataagcaatgattagaagatagcagagggccaaatatcaaaatgagtactttttatacaagatttattttattcagatacattatcttataaaaacattagtagttgaatgagaataggtttatgttttccttaaaaactgccaaacagaatgggaaaaataatcaacttttgtttttcgctaaaatgagtcttctagactacatgttctggagtttgggaaaaggcagagagttgttgtatcctttaccatatcttaactcccataagacaactgacatactggtaccctagtattatgctctctgctctagaaacaagttaaaagcagagcataaataacatgacaaaatcagatgtatgtgataatcaaatccaaggggtaatagaaaatccaaggctaattctggatagctatcagtaatgtggaagaaaaattagaaatttattgcaaatcccagaagtttgtggacaaatgtaacctacgggacttctgatagtgctattcagagcaaaatagagaggcttcagatattaaccaaaacttcatacctacatgataagaacagcggtgattaaagtcatttgaaaagtagaaggaaagggaggcttagactttagatatatgaaatgtaatggaaagatggaatatgtattgaaagctagttggttggtttttttatgtaggatatagctaacaaaggccaacctttgatacatctacttgttaattttacagatggccctcctgaatttcttctttcctgatgaaaaggcatattctgaagaggaaagtaggcgtgttcgccgcaataagagaagcaaaagtggtgaaggagcagatggtaagtctactcaagtgatcttttttccatgatatactaataaaaatattcttcattctcatgtattatccaaagatcatggatttctccagcctaacctgataatcaatcttttaacatagaactaacaatagaaggatccttcatcctctaattccagataccttcagtctttttcagtatgtttggaggccatgctagcatttatgtccctcaaggttactctcaacaaggacctcctctctcctggggacataccatatcagctatgtccaccaagataatttgatcctatttttgtaactgatagtgttttcccatgctggcaatttatagtatgtattgtttccaatgataattataacagttttggtatctgttactatgtccaaatctaaaccaaagcatgtaacattactctggaagttccttgaggacaaagatcccttccccttacataaccctataatatggcctagtatttgtctcaccggtagtatcgtaatgtaacttgacagtgtttactgtccctttggctaggcagtgattcaccaaggaaaaccattcccattatgggtgtaatagctttgagttaactagtagtacattcaggggatgacaaaatgttgtgggagctcctgggcagggactttgaatcgctgtatttcagtgttactctgtcagttgacagaatgctacccctttggcacagaggtttataggatacatagctctgggctgttgaaaagccatctggattcaaagacaatgtgtctggctacatctgctgatgatatgtgtctgtaggggcttacaaagcaatatgattttataaagatgaaaatgagatttttaagctgacatttgtcagtgtgagtaagggccaatgatggaagcagttccagaaagtggaaacaattgaagaaatggaactagtactgccttagagttaaggataaagggtgccaggggattgtgaaatcgtctaagatacttaacctttcacctgggaggctatagaagcatttctttagatgtgatgagtgtctcaatgagttaaaaggtagcaaagcaatccaactttccttttggaaagctattcatgttattttgctggctatggacagtgtttgtcaaatgcattctaaaaatatttactgagtaaacagatccaatttatatcacagtaggatagaaaaa

SEQ ID NO: 573 - DNA, 425280 bp, mus musculus
tgggcgtcccggccgccccttgaggcatggggcggggtaggtgaggacctcctccctcattccctctctggccgcgccgcccctctcgcccgcccctcctcctccctttcccacccctcggagtggagctgcacatgcggctgctccctgttctgtcccgcccagccaccgtcgctcaggaacgggtccctgcagcccccagccgatggcaggacagtagtcgcctgtcaggggtcgtgaaggactgaggcagaggcagaggctcccgggcctcagatagtggttgtctctggaggccatgggctacccagaggtagagcgcagggaacccctgcctgcggcagcgccaagggagcggggcagccagggctgcggctgtcgcggggcccctgctcgggcgggcgaagggaacagctgccggctcttcctgggtttctttggcctctcgctggccctccacctgctgacgctgtgctgctacctagagttgcggtccgaattgcggcgggaacggggaaccgagtcccgcctcggtggcccgggtgctcctggcacctctggcaccctaagcagccctgggagcctcgacccggtgggtcccatcacccgccacctggggcagccgtcctttcaacagcagcctttggaaccgggagaagatccactcccccctgactcccaggaccggcaccaggtgagtcacctaggaggggcggcggccttggaggccccctcccctgctcggttgggcgggggcctgggcctcagggctcaggggactctgccactcagagccaagttccagggcaggagctgggagtgggccggagtgctggggagaggttgtccaggtcaggttgttctcggttcctgccttggctcatccagaccctctccggtcccgtggagttggaaagcccagcctgcacgcgccgcccccggggaggtgtgggctgcttagcgaaaagttggcctgccttgcacccatccgggcgcggaggtgcctgcgccgcccccgtggccgtctaacggcgagcagcttggcccctcgtgccccctggtgagtttctctgcccgtggtgcttgtttcttcgtgtcccgagctgatgccagcactagcaggctcctctttggagttggagctgtaaacagctgtactaactgttccacgcccgttgaaacaacttttaaccatactttcagcgctggattcttgtgcgctgaccaggacctgagcttttttcacacttacctgcaacttgagacggattctcttctgcgttctagttaggatcagcgcccctgaggaattctggtagaaatatgccgtcttgctagacaacttctgaacagcaatttaaaaaatctatggaaataaaactcaccctttgcatgccggttctgacactcttgtagatggagttgggtgcagtgggtgtgaagagttttcattattgctgcctttggaacaggaagttggatttttgttttgttttgataatctttagagggtttgtatctcttttagcaaaccattatcgtagttgtttttcttactcgttattccagcaaatttagtgtacttgatattaagtcttcctgtggtttccatagctgtctcacacttgaatcttaggcagaacatccaagaatctttttgaggtggttaaagattaatggtgaatttgtaacttctggagaaaacgacactttgtgtaagtaagctacttgaggtgagacatggaagccttctgtacttggtgctatacccatagttattgtcacaactctttaaacattatttgtgttgctttgactttccaagttgtacactttagaggtgtcacattcataataatactctagtgtcagaacacacactttctcttcttttcctttctctctctgtgtctctcttccttcctttctttcttaacaatgtgctttgtaaaattgcttcagacctaaaatgtctttcaaagacactcaaatttatataactgcgtatcaaagaagagaatcagtagacgggcttctcatacttgaaattttaaacaccggggctaaatgacaatgaattaggactctgggtcttttatttactacccccctccaggatcctagtagaggtacttagcagctgcaccttgatattctctctctctctctctctctctctctctctctctctctgtatgtacacacacacacacacacacacacacacacacacactcactcaaaagaaatcaggaaattactcaaatggtggtcaaggatttttggcaatcaggatggacagagcgctggttagagattgtgggacagcagtatactagagcttctgtgatggcatgggactctcacagctttgcaatggcctttagttgcttacatcagatgtagcaaaaatacttatgtgtttcagcacagcttcttatctgctatcctttagtctattttagtctatggggcagtcaaagcaatgataccagttctttacattcattagcattaattggaatttatgttttccagatttgtaaggtacctcctgaatctattttattgattcctttggagaacatacaggcctcaagggagaagtaagtggcccaagatatcctagcttgagtcaaaactaggatgaaggtgctctgccatcctccagtttagtacacagtcctccataatatagtgtctactgagaaactttgtttttgaggggggcgatgaagggacaacaggttgaaactccatagtaggctttttacaaaatgagaggctcagatctgtgtcactttgttctgctctaactaattttgaccagactaagtttaatcacatattccttattcatcttgaatttcactttcaggagaattttagcccactgaagacattttatcccagattcaactaatttgttttggtgatattagccttagcatatacacaaacaaacaaacaaatatataaatgaatgagtaaataaataaaggaaaagttgattggctaattgatttacattgctgtgctatatcttgggtaacatttctagtgccctgctgcaccctctgctggtttttcggtgacatttaatcgtaggtagtatctgctgacagtcaaaattctaagttgtgctgacagattctgattcataaataaggaagtgaataaccttgtgggacttggccatgtaggtcttattttatattttagtttttcaacataagcagatgttgttacagcaaaccttgtatgcagaggactagaaacaaagccagcatcttccagtgggtactatacttgggtttcctaccaacatatttagaaagagtaaagggaaactgatgcaactaaactgtggtgagcccaacaatcagtggcttttcattatgagtggtcagacatgtatttaggcaaggaaaaaggtattcatacttatgagatggttggactgtgggctcttaatcatgactcaaggaaagactccagaagtcattgaaggtttgtctgtaccatactggaattaaacaaacaaacaaacaaacaaacaaacaaagcaggatatggaaagaattcaggacacaaagtaggaatataagcaattctctgcaagggagattttggaaaggtagggacatggtttcataaaaactgagaggttgacattagcgtttctggaatcaggggctgtctccctcagctgaaggagtagctgcatatggatacttagtgaagataagtttgatggctagagatgcaccagtagtgtctgattttgacaacaaataattcaaaacattgaaaatcactggataacactgtagagaagaaggtctggtcatgattatgtctctcaaatgtcaaaaacatggcggaaaaatctcagcaacgtgtcaacaacaaaacaaaccttttttttccatgaagaagatcagatgtgattttttccctacaatcagaaagaaaattctgatgactgttactaaaaaaaaaaaaaaaatcttatagccaattgataagtctccagaaacccaattgaattgatcaaaagtggggattttctagttgtcatttttccaatctggagaactagagagaagtgggggagggagggggggaggatcaaagatcagagtcttccaaatcaggagagagatgagtaacattgttggtataatttaataatctaagctcaataaataaaaatttctctgtggcagatacagtgttaagtatcagatgctggagagatggctcagaggttaagatcactggttgctcttccagaggacctgggttcaattcccagcacccacatggcagctcagaacttcctacaactccagttccaggggatctaacaacatcacacagacaagtattagatgtcttttaatgttggtaaaagttctgttgagagagatagaggtggtatctcatcaactaaactacaagcagatcaataggaatttattcaggactgtttgagatatttgagatattttcttaattatttgaggtgatatcatagaagacagctttaatgatcaacataaatctttgggtataactagctctgttattagaataccaagttttgatactcctaataactaagaatcattctgggtgattcatggcgaacataagcgatcccacaaattgtgtatatggaatctagataaaaataggctttcatgagtttaaatgcagactttacagtgtcttatttaagtcttctgaagaatggctatcataatatcactctcatttttattcccactaattttactcctggaagtcgccaaccatattctctttgggaattattctgtcgttgttactgaggttcatcttaataatctcctttctttaccttaaagctcctcagaaatctactttcttcatgattcccaacatatcactagttatagctaggtagaaatatagttgttgaattaaattattttgggacttaggtaacgtttatataaaacaaagccattttatagaacaggtctgcttctctctggtcctgctaagtctgtgaactgtcagttatgcttaggtaagtaaatagttggtatgtttcgctggttttgaaaataattgggaagtgaggtggaaatgaggaagcctaactgtgtgatctatctccgagtttcatgcctttcctctaagatggtactaaattgtttttgtaatatattgtttgaagtttcatatgctgttaggtctcatccttctctcttagatcttgtgaagaaaaaacaaaaacaaaaaaaagaactgcaatctatccgtaactatgttatagagaagatctctttataccagagaatttctgaagcaaatttaattcctaagagcggtaccaaaccttgtgcctctgactgcagctgttgtagcgaaccatctttgtctgattcctctgtaaatacccagtgcttagtctctcatttccattctttttctttacattttattgacataaaacacacatacagaaacacatgcacttcatgattgtgccatttggtgaaatattacaaagtaaggacacttatgttgcttgcacctaggtgaaaaaataaaatattttaccattctgcaaatccttaattgtgtccatctttatcgctaaatgatcctcactctccaaagataataactgtcttcacttctattatcagaaataattttgttcatttgaactgtacataaatggaatcagatagatgtatttttttgagtcttgtggttttttgttagcactatatttgtgataaccatactgttgcaaggagaattttaaaaatttatatctttgtgtgttctgttgttgaaatacatcataatttataaattccttatcatgataataactatgtatgatatttccagttcgaagttattatgaataatgtttcagatatttttatacaagtccacttattagaatttccattgactatttatctaggattagtttctgtgtaatggagaatacatattttgaagttattgatgattttctaagttatcgacaatttgtttctcaccagcaatgaatgagaagtactgtcattctggtgagtgggtttgtagtgaaattttctgtttgtatgtgatattgggaatcaaacccaagccttcaggttctctaggcaagtagtctacccgtgacttacatccttaattttatctcaaaggattttaaaggattcttcactgaagactgatgaggttgtactccttatcatgtgctattatcaatttaggcatcttcatgaagtacttatccatctatttatatctgtatctatatctaaatctaatctatgcctgtatgtagatgtttatataatatatatttgcctattttcctgtccacttacactgtttttacaaatttcttatataattaaaaatccgttatttttatttttaattatgtgtatgtgtgcttgtgtctatgtgggagtatgtgagtgcagagaatagaattcccaggagctggagttgtgagccccctgacatgggtgcttccaagtcctcttccgaagcaacaagctctctcaactattgagccatttctctagccctaaaagtctttatatacattggaaattacttcttatgctttgaaaaacagtttcaaatttgtggcctacttttataatatcttttgatgaacagaaggctttaattttaatgtgtcaactttttctttcatggatagtgtttttgtaatccgtttaagaagtatttttccagggctgaagagatgtctcagtgagtttggttccatgcacccactattagacagcccataaccacctaacttcctctctgatgaagctctcttttacacacacacaaacacacacacacacacacacacacacacacacacacacacacaccccacaaacacaaaacaagcctttttttaaaaaaagtattttctcactttgaaatcattagacatgctcttccattatcatttcgaagttttgtatttgtgccatttgcagttagaattgctagccacctgggattgattttgtgtatggtagagatatagaggtcaggccctatatttttccatgtaagtatccaactgatcttgtcctatttattatatggatttttttatacttttctacattcttactttttcatccatccattgtttatatacactcaaaattgttcctgagttgtttattctattctgttgatctgtttctcatcagtctattttctgttgctagaacaaaataattgaggcttggtacttgaaagtgaaagagattacttaggtcattttggagattcaaaaacatccattcagcttgagtgagagtacccttggctagatagcaaaatggtggagaaagacaaagagactacatgcagaaaagggaaaatttgtatgggttggcctcatttcagagcaacttacccctttgagaactaatgtactctgtaagaaaaggatgtgtaccttctgaaggcagtaccctcagtgatgaaattaccttgcatttagccttacctcttaaaagttctaccatatcaacagtgccacacagggttaagcatccctcacatgaatccttggtatacaaaaccacagtagggccatagcataccagtactaacagtgttagttactgaaccctgtaataagctcttgatatctgggaaagcaagtccttccaacttggccttttaaaaccaccttggatactcttagcattaacattttcacatgtattttaggattggctttttatgtacctcaagaaaagggaaacctcttagaattcttattgtgattacattgaatttaaaaattgtattagttaagatttcttttctattgctgagataaaacattatgaccaagagtttaactgagcttccagttccagagggtgtttatgacaaaaggatgaaagcctgaaggggtggctgtagacagagctagaacagcaccaagagctcacatttggatgttacagaacacaataggaatggggaagtcttttgaaacctcaagccctccctacagtgacacaccacctccaagaagtccatagctccaagtccttccccaagagttccagcaactggtgaacagacatgagcccatgggggaacatgctcattcaaataaaaaaaatcaacttaggaaaaaaaatcacagcatccaattcaggaacatcatatattcttccatgtctttaattcttgctcattttcctactgatattttttaatgtttatatagagtttttccaaggtgttttttatgccattgtatatgatagctatgatggaggttgtgtttcaccatgtagattccactttagaaaggcaggatttatgccctccccccacccccccaccccccccccccccgagtaccaagagtaccatcaaaagacagagttcacctgagaattgtcttctgaggcaaacttttcaccaaggaaagacctccttccttgactgcctgcatctaatgactaatcactgtagagctataaatcacttcccctttcttctaaattaggaaaacattgaagagtcatatataagccatactagttcaagagctcaatataaatttagttagggcaatttggggattgactttttccttgtcttgcacatatgtggatccccaaagcactatctataaaaagtcctgcatgttaatataagcctttcagttgacttggtaggaattccaatgtaagtctatataattaaaaaaaattttgtgattataacattattacatcatttccccttcaaaccatccatccaaattctctcatgtagcttcccttgttcattttcttcttttttttgtttaatgttttttttctttttttttaattaggtattttcctcgtttacattttcaatgctatcccaaaagtcccccatacccacccccccaatcccctacccacccactccccctttttggccctggggttcccctgtactggggcatataaagtttgcaagtccaatgggcctctctttgcagtgatggccgactaggccatcttttgatacatatgcagctagagacaagagctctggggtactggttagttcatattgttgttccacctatagagttccctttagctccttgggtaatttctctagctcctccattgggggccctgtgatccatccaatagctgactgtgagcatccacttatgtgtttgctaggccccagcatagtctcacaagagacagctatatctggatcctttcagcaaaatcttgctagtgtatgcaatggtgtcagcgtttgaaagctgattatgggatggatccctgcatatggcaatcactagatggtccatcctttcgtcacagctccaaattttgtctctgtaactccttccatgggtgttttgttcccatttctaagaaggggaaagtgtccacactttggtcttcgttcttcttgaatttcatgcgtttggcaaattgtatcttataccttgggtatcctacgtttctgggctaatatccacttatcagtgagtacatattgtgtgagttcctttgtgattgtgttacctcactcaggatgatgccctccaggtccatccatttggctaggaatttcataaattcattttttaatagctgagtagtactccattgtgtaaatgtaccacattttctgtatccattcctctgttgaggggcatctgggttctttccagcttctggctattaccaataaggctactatgaacatagtggagcatgtgtccttcttaccggttgggacatcttctggatatatgcccaggagaggtattgctggatcctctggtagtactatgtccaattttctgaggaaccgccagactgatttccagagtggttgtacaagcttgcaatcccaccaacaatggaggagtgttcctctttctccacatcctcgccagcatctgctgtcacctgaatttttgatgttagccattctgactggagtgaggtggaatctcagggttgttttgatttgcatttccctgatgattaaggatgttgaacattttttcaggtgcttctcagccattcggtattcctcaggtgagaattctttgttcagctctgagccccatttttaatggggttatttgattttctggagtccaccttcttgagttctttatatatattggatattagtcccctatccgatttgggatagataaagatcctttcccaatctgttggtggcctttttgtcttattgacggtgtcttttgctttgcagaagctttgcaattttatgaggtcccatttatcgattcttgatcttacagcaaaagccattactgttctattcaggaatttttcccctgtacctatatcttcgaggcttttccctactttctcctctataagtttcagtgtctctggttttatgtggagttccttaatccacttagatttgaccttagtatgacctctatttaaaaattgctttaagtttaactttaattgctttttgctaggaggagctagagaaattacccaaggagctaaagggaactgcaaccctataggtggaacaacaatatgaactaaccagtacccgggagctcttgtctttagctgcatatgtatcaaaagatggcctagttggccatcactgcaaagagaggcccattggacttgcaaactttatatgccccagtacaggggaaccccagggccaaaaagggggagtgggtgggtaggggattgggggggtgggtatgggggacctttggaatagcattgaaaatgtaaacgaggaaaatacctaataaaaaaaataaaacaaacaaacaaaaaaacaaatgtagtttaattttgcatatgaagtttgtatccaaagatttgataaactcacttatttatcctaataatttatttgcatgttcttttggatttttcacatgtctactaaagtgttcatggaaaatgttttaaaaatgttatttttttcctttttaatctagatagcttaaaagttttcctctgacctaagagcatgcaccacagcctggacctaggtcttctcacacatatgtagcagatgtacagcttggtcttcatgtgggtccagaacaactggagtgggggctatcccaaaagctgttaccaaaaagctgttatcccaaaagttgagctgccttgtctggcctcggtgggagaggatgcacctagccttatggagacttgaagtgtcagggtgggaggataccctggagggccccacccactcagaggagaaggggaggggggaatggagggaagaattgtgggagggagtgactaggagggggcagtgagcataaggtaaactgaataagaaaaataattaaattaaattttaaaaagttttctttgtgttggtcaattattcctgggtatggggcctgccctggagtgtagttgatatacccaatgactgtccatgggagaaacctgactttccctctgcccccagctttcagttgcaaatagattcttggttggttgaggttgggatccagagttcaccttactctctcattatggggatcctgtctagcttgaacctgttcaggtcttgtgaatgctttcacattcttggagttcattcctgttactgtaccattcctgttttgtctgcaagagacattttttttcttggagtcatctatctatctatcctctctggctcttactatgtttccttttgtttatttgacttgattttctctttttgttgttttcttagttttacacatatggatacacagctcacgagagagagagagagagagagagagagagagagagagagagagagagagagagagagagagaacatgaagtttggggggaaaggtgtggagaatctgggagaagttgggagagggagaaagaatatgatcaaaatatattatataaaaaactttaaaagtaaaaaagtttcctttattataatgtctagaaatttccagataatattgagtggaagtaagtaataggcatcgttgttcactactgatcagagcaaaaattttatttttactgtttgtcataggttatattattattgttagtttaaaagatatcagttttaaacttttagttttcaaaggtttttaaataacatcaggaatgacatcattgtatcacggttttcttttatatgttaaactagtcacaagatttttccctccttattctgttaatgtggtctgaagctaaccgtacacccttaggataaaacctctttagttccagtgtaccattcagttcatatatgtctagaattattttactaacctttcatttaaaatccttgatctttatttatgagcaagatgagcatgtaattttctttcattatcaagtttggatatcaaggttattctatgttgttattataattgtgtttattttatttgttccttacaaccatttatataacattgataatatttttcccttagctgtttggaagaattcatgaagtcattttaccctaggggaggttaaattgtgtttgatatcctaataaacatagggctttcagacaatagctaacaaaataataaaatacttagaaatacatttaatcaagagaatcagagaccagaacattaaaatctataaaacaatgatgaaagaagttgaagactgcagaaataaatgagaataggttccatatatgtgtatcagaagaatcaaaattggtgaaatgtccatactatccaaagaaaactgccaattcaatgaaaaccccaatattccaataacacaagccaggtatgatgtctcataactataattctagctcgtgggaggctaatgcagaagggttgtcagttcaagggtagccttgatggtgagatcttatctcaaaaaacaaaacaaaacaaaataatcagtgacatgttatagaattagcaattgtgaaatttatagggaaccacaagatatctcaatcgatttctattatcaattgtatatcttatttttgtactacatgactgttttgccatatgcttgtttgctttttaatgaatggcataatgtataatgttattaattatgacatatattatataaaatatttgtgctatatgcgtaatataatataatatataatgataatgtgttatttatattgtatttaatattaaaataatattgtataatacatacacacacatatatggcttcagttgcttttatctttattaaaataggatttatgtttctggaaattggcctcagatactaacattcctatgtcatcttaatccaacacgatactgagatcattggaaactggctttctgtccaaatagaagttgatttatcatttatttaaaatattgttatagtttagaacctaaaagttggtaatttttcctgggttctttctagatgggtcataaattacagttttttctttttctccactgactcccaagttcggccttttaatagtatgacatattatgtaaatatcatatgaacttttgtatagttttcttggcaggaaatgtcgttcaaattgctaatttgtccgttactaaaaacataagcaactcatcatatttatagatatttatgcattatcacctttgtaacatgtaccaaggggtacaccaatgtggagatacaactgttgacccagttagagagagttcctgcagtcatggaattctgagtcaggtgaataggctagaacaagtcaacttgatgatgaagcagtagggttaatcttacagcttggagtatctggaacacatggtaatttggaacaaaaaagatgaacacctggctcaaacttttgaaatcaagggacattttcttgatgaagcaccttctgagtttaaaactgaaaaaaaaagtcattagctggataattttatttccagtaataggagctgattatgcaaagtcttggaggtgagagagaacatggcatattcaagggatggaaaatctaatatttataaagccatcgttatgagtccattatggtactggcataaggtagacattatggatcaatggaacagaattgagaacccttatattataaccaactgattttttacaagcataaaagacagttcaccaaagtacaagattccctattgaaattaaggtgctaggaaaatcaggtacccacattttttaaaggggtgaacttaaaaaaataggcttaatgaccttgatagacatttctcaaaaacaaaacaaaacaaatagatgcacaatatctatatgaaagtaactataggaatatcactactaaccatggactgcaaattaaaatcgccatcaaagctacctccccccattacgaatcactaatatcaacaacacagactaaagataagaaatgttggaagatgttgaggagaggggactcatttcacacaccaccaggggactatgtatacatatgccataatatcaaattatgggagtgtttcaaaaattttaaagagttcacatatgattcaggagtcctgcttctgagtatatgttatagtttgaatatgaaatgccccccatagacttatgtgtttgaatacttggtctccagctggtagagctgttttgggaagggttgtggaacctttaagatgtggagacttgctggaagaaaggagtcaccagacaggctttgaggttttacagtccagctctgtccctcacttactctctgcttctgtactgaggattcagtgtgtggagccagcctcctgctgccagcagctgctatgccttccccgccttgttgccttgtgttcccttgaactctaatccgaagtaaacttttccccttctaaacgtgcttcttgtcaggtattttgtcacaccataaagaaaaataccttgtactgcatgtatccaacagaaatgaaatatgtctttggaagaggcatctgggctctggaacattatttgcaggagctaacaaatggaaataacctatgtagtactcggctcaggtgatgatgaacaggtacaaaatgtgttacggccaggtaaggctgtatgagtggtcagagttctcagacacaggaggcagggggatctcaagttcaaggccagcctggagcatagagcaaaaccctacttgaaagcaaacacacaaaacagcccacaaaattaaatagaaaatgaaaaaaaaccccgaaaatcacaaaaatgaaatcctgttatttgtaatagaataaacacagctggaaattattattaaatgaaataaatcaggcagagaacggagatctcactcacatgtagaacaacaagttaattgtatacaaggtaagaataaaaaggtgttactagatggtggggaataggtaggtgagggttgaggaggagtgaggaaaaataattgatcaatgagtattagattacagatatatggaaaaggatgatctgctatgctgttgcagagtagaatgaccatagataaagtatgtttcaaaagctataaaaaaagattttgtgtaggggctcacagacactgaagtggcaattatggagcatgcatggatctgctctaggtcccctgcatatatggtatagttattagcttggtgttttggggggtcctaacagtggaaatggcccttgtctcctgggacctttcattttcctactgggttgacttgtccagctttaatatgacaggaggtgtctagtctttttgtaacttcttatgccatgcttggttcatatccctggaagacttgcttttttctgaagggaaagggacgatgagtggatctgtggaagagggcagataaggggtggggactgggaagagtggagtgaggggagactgcaattgggaagtattgttatgagggagaatcaataaagattttaaagtttttttttcactagaataatccttgcttgattagatagatgtgtttaacctgatttaatcactatgccttagatactctggtttagttttattctcatatatatcttgcctcttagatacagtctacagtgcattcatgtgttaaaacattatacagtgtgctaataatatgtatatgttttatgttttaatctatcaatttaaaaagtttaaaaagccatgagtcaaattaaataaaaaagtgaatgttggtatatgcaacacaccatacccctgaatttacttttaaataaccttagtttaaaatgctagaacaacacttttagaagaaaacagaaaaaaattatgaccttcatattgagcaaatatttcttagacatggaaccaaaaacatagtcaaacaacaacacacagaagtgaattgtatttggaaaaatgtttttctaaagaagcctttgaaaatatgaaaagaaacatgagagtaggggaaaatgtttccaaaataggcctcttgaaatgtgatgaataagaagacaaagtagagaaaagatgcatacatttttatcaaagacgatgcacaaatgtccaaaatacacaaaaatatgctcaacactgttaccatagaaatgcatcattttatacctattagaatggccataatgaaaaaggtaataaacaatggaggtatagagaatgggaacactaatatattgctggtgggcatgttaaatgatatagtagtcttgaaaaatggttttccactcctttaataagttaatatagaattacttattgcataatgacccaattctacttgtatgcttgtgcccaaaagaattgaaaacgtctgttcacacaaaaacctctacaggaatgctcaaagtaagtggtattcataattttcatttcaaaccaaatgtctgatgaataaagaaatgtggcaaaaattctaatagaatgtatttcagccataaagaggaatgaagtttgaatatgttacaacatggtaggatttcaaaaatatggtaagtgaaaagagccagtcacaaaggcccacatcatattgcataattctatttgtatgaaatatccagaataaacaaatatgtggagaaaaactgagattagtgagtatctgtggtgagtagtaggactgaagatccactaactatggacatgagggcacttattgtgggaaagaaaagatttcaaaactgatttttactatgactagggtaggagtagtggtgctttaaagaaaatgaagcaagagatatcatgaaattacacagttcaatacaattcctacaaaaataagtgaattctatggtgcgtgaattatatcttgatgcatttgttattctttaaaaaaatcataaagtaaatgtgtaagagatgttagttgtttcagagtgatatttatcttcatatgaagggaatcttcaagcctgttcattgcaaatgcttaaaactttttccataataggtgacttcaggattctaacccagaattaaactcaaccagaagcatcagggatgtcaggccattcatttttaattggaaggactgtactggccattttgttgtgcacttcagagtaagaatctttaatttgtgggactataaatgagttagtgtagatagatgctagcatgcacaaatagccatctgtggtttgaatatctccctctaagacccacgttgaaatttaattagcattgcaagagtattaagtagtgggacctttaagtggtgattagtcaatgaggccccatgaataaatgctattatagaaatgcatcagcagtcatgggagtagacccccaattaatatccatctgtgttatattctcaatcaatcatctatcttccagtatcatttcagccttcagaattgtgagaaacaaaacaaagttctttcttttctctgtttgtttgtttctttgaaacagggttgcgtgcagcccaggtcggcctcaaacttgtttggtagctgaggagaaagtgttgactactatccaagctatcgcttctattcttacatgctagggttataggcatgtaccaccatgcctggcttaatacatttatttactttatgaattacccaatttctggtattctgttacagcagcacaaaacagactgagataaggcctagctaattacttacactacagtgggcagtaattaattctggctcacaattgttatctcttgtttcctcttctgccctgtccattactcactccctttgcctctatgcctctatgacttttattcttactttttctgatagagataggggaaatattctcagattctgcttagactctttttttttagacttctaggtttaatatatatcattcagatgaatgtgaatgccattttaaccagtgtaaagtgttggagaactttttaaaaacctacctgtgtgtggccacagcttatcccacatcttcagactctttggagtgtatctatggcttcttcgataatactgatgctcatctccatttgggaatcactgctctaaagggagaaaataaaaacgagagtgtgagtgacataagcgttgatcgccttcctagcttcagttcctttattgttggctattacacttttgccacttttgttactagtcctacctttgatgatcactgatgcaagagtttgtgtggtagtgaatgcttaatgagcacaccatttagaaaattagctaatgattgtgtgtcttttgggaagagaggaattagacttcagttgtcatctccgcagccagatgctagggctatgtgcttgcaataactgagggaaagagtagttccctgtcctttgtggcttcctagggattttcctactggtagccgctgaaaccactttaaaataataggccgctgagtaattttccccatgtatatccacttgtcaatgggcctgcacttcagagatgaagagtaatttttattggagtgatagtgtataatatagtttgaaagcagacagccacaaagaaattgattttcaaaaggagattactgctcaattttattttgtggtttacagatctttagtctttcaacctgccacgccattgacctgcaaggacaatcaaagtttaaacagcagtgtgtgcctagaagcattggatggttctagagcacttttaaaaatatttatttataattattgttggggtggtgggctgccataatgccatgcatatgtgtagaccagaagagtatcccataaagtcagttcttttcctgttatcttgctcctggggatcaaactcgggtaatcaggtcttcttgcctagctctttagccagctgagccagctcgctggccctaaagtccttttaatgtataagctaagttattaaggtggtgaaacagagggctttttctggaaggaatgttacatctttattcagactcatggaaaggagagtggcagatttcaggtgggcgtttcctcaatttttcggtgagttactatcaaggataaaaggcaatgcttgtgacagttctagttctcaaaactgatttagctagcagagtcaaccaagaagtataaacttcctttgttcttaatgacatcagacaaccctgttaggtgccattagtttctgcatggatttccagctgccacctcaaatttagttagctaaattgaattcatcttcactcttcccttcccctaccacacacactacattttagaaaattaaactgtggtttcattctttcaataaccgaggcataaaatctcagatgcattttaacctctcctcttccctattctactcagacttagcattccagttgctaaatcaattcatcttttctggtgttgatttacattgtttgtgtcacatgcatctagttgctctgttagaattctgattgtatttggtttagctggtcttcaagttgcctcgtccacatctgtgatccttcctcagcttatttcctgtagtattaattatgaaccagggagttgttttgttctctattgcaacttttcatgtctccccccccccccaactaactacctttgctctctgctctgttgcctatacagaaaacttcagagtcttttttgtaaaccttcctgaactgttctgtcccactggtcattgctcgctatctctgtgagttcagtttcctccagagcaaccccactgtcacacctctctcattcttgcctttattcacctatttccaaaagctgaatgctcaacctcttcgtggagcctcaggctctgagagcttttctcaaatcttatctttctgataaattcatccatctcagcattctaaatccttcatttgccattgtattgaattgtagattatcttgtttccttaattaattgaaaagggttttgaaggcagagactgaaacttttctttataaattacagccggttacactgacttttagcagaaacctctagttacatataaattggttttctccctttgcattcataccttcattgttgcgtcatttctcttgttaaaatttttcttttgatgatagaatactcttatatttaaggtaaaatttaaacatgtaaagccttttctgatcatttagcccttagtaatatttttctttattttgtctcaaattaatttgcatttatgacatgcttgacactctatgtggctttttaagagtttgaagggtaaaattaatccctattattagggacaggctaaaattgggaagggatatttgggtcagaggaagcaacatgatcaaagacttagagacagtagattgtatgcttgggcaaaagcctagaacccatgaattatttatttggtctagaactatgtgccattttacatcagctctgtgatagtgttctattgtataatacaaaatcggggttaatttctcacttgttgactactcagcttctgttttcttttccattttcattgtgggaagaaagttggtgactggggaaatctgggttcctatatttcacaagagaagacaaaactgatgaagacctttggagcagggccacatgaaggtcaaacttgtatgttctctttgaggactagctagacatttactttgctaaattagctcctttaagccactgttgctaaagttcctttccagggggagacataaactacatttacccatcctcccaaggttccaacaagaaagtgaggcaagagtccatcatagtttactctggggaactaatgaatttgttgagcttcagcacagagcccaagtagggggttacttacagggatctagacatgctcccccctacttcccatgcctacaaagtgttaccaagcagggatgaaggctttccatagtcacatagatgattcacctttgccccctccagtcttctttagcctctatatactctagcccttccaccaggccatgtgaaggtgaagaactaccagagtgcttcagtaggatacttaggtgagactctcatgccctattccctccatcctttcccccacctgtgcgtgtgttcgcgtgtgtaaactggccgctagcccatctgggacgatcttttgcattttgcaaaatgatgaaacagccaaagatgggtgtttggcttaaaggacagggcaatcactcaagactccttgttccagtaatcagcaactctccggaccctttatttccaggtccttgtgccttaacaaaacccaggcctaaagtcagctgttctatttgactttctcagttctacaggattggagagaattctagattagtgggactgcaaattcagtgtctagttctttctccctttgtacccccaggtcttcttgtcccctccttatctccctgccccctctccctggcttgctcctttttcacagcagcaattccatgctttcactttggtctatagagcccctgctgtgttatattcactttattttcaactggtaaatttaattcctattacagtaaaaaaaaaaatcaagattggcattaagatcactcacaaatccctttccttccctcactgttaacttctacagatggaacccataccttctgtattcctttctcaatagaggaagtatgttcttcatttcaagaccagacctttcacttgaacttcagattcctttccccccctcatctttccttagtactttttcattgtcagtttcttctgtatctttttggttttcttttgagacaaaatcgtatcatgaatcccaagctgacttccaactttcagtcctcctgcctcagcctctgaaattctgagataatagatatgtgccagaatgctcagcttcccctgtatcttccatctctctcagaagtctttattgtttatacaaccatgcttatgttttatactgtatgtgtgtatgtgtgtgtgtaaactaatttgacccagcatttttcttatttttcaattttgtcatagtctttattttattttaatttagttttatttatgtatcttttcttatctcatttaatcctacaggtcctttgtgtatgtatatagtatggtatccagtttggggctttaatttttattttattttattttttagaagattcctcagtatgagaatgagtgggtctctgtttcttttttaattatgtattttcttcatttacatttccaatgctaccccaaaagtcccccataccctccccccagtcccccacccatcctctcccacttcttggccctagtgttcacctgtactgaggtatataaagtttgcaagaccaatgggcctctctttccactgatggccgactaggccatcttctgatacatatgcagctagagacacgagctctgggggtattggttagttcatgttgttgttctacctatagggttgcagatccctttagatccttgggtaatttctctagctcctccattcggggccctgtgatccatctaatagctgactgtaagcatctacttctgtgtttgctaggccctggcatatcctcacaagagacagctatatcagggtcctttcagcaaaatcttgctagtgtatgcaatggtgtcagcatttggaggctaattatgggatggatccccggatatggcagtttctagatggtccatcctttcgtctcagctccaaactttgtctcagtaactccttccatgggtgttttgttctcaattctaagaaggggcaaagtgtccacactttggtcttcgttcttcttgagtttcatgtgttttgcaaattctatcttatatcttgggtattctaagtttctgggctaatatccacttatcagtgagtacatatcatgtgaggtcttttgtgattgtgttacctcactcaggatgatgccctccaggtccatccatttgtctaggaatttcataaattcattctttttaatagctgagtagtactccattgtgtaaatgtaccacagctaatttgtttccattttcccttaacagttaaactttaggaagtaacaatgtaatcttgctgtcttggcattttaggcactcgttgattcttcatatcctcctagtttgtttctgtgttttctttactactgagtctgtacttactagggtgacttttgagttccatattgtaaaattcagcaggactttttggttttaatttttaaaattattcttattgaaatttttttaatataatatactctggtcatacatttccccttccccaactcctcccagatcctccatacatcctgcaggcatccaattccatatcctttctttctcttcctattttattttaaacaatacactagcaaacaagcaaaataaacaaagcaagccccccaagcccaagaaactctcatatacgcccacaaaaatggaaaccaaaatatacaagcaaatgactaagacaaacaaacaaacaacaacacaaaatgtctataaagataccattgagtttgttttatgttggttatgtactgcctgacatacagcctatcggaagtgtggttaatacactcattgaaactccattgagaaaattaagttttctttttttgcaagtggatgtcagttgcagatagctttttggttttgtttctgtcacaccagataatgtccagtcttttaactttcatttaaaccttcaataacagatgctacaatgtagtggtgataaagttagctcggtgattaatgtttctcagtgaatatttattgaatgtgagagttaaattatattttaaatgttgaaattgagatataattcacacataaaactcatctattataagcatagcatttattgattttagtgtatttacagagctatataactgtcgccactacctgattcaggaacattttcatcaccctcaaaaaaacaaaaaccctgtgtctattaggagtcactacccaattcagccctatcagccacaaatctactttaaccactaatctgcagccttaatgttttgcttattgtggatattttacataaatggaataatatgttctcttttgtgtgtgtgtctcttttcagttttaataattttaaaggttctcccatgttatagcatgcatcaaaatttcattctttttatgcctaaatatttcattattattaatgacaataatatgtatttacaacatttttgtctagctactcatttattgatgggtatttgaatttctttctgatttgggctattgtgagtgaagctgctatggtcagagttgtataactgattaaatactgtttttacttgttttactttatttttcattctttttgagagtttcatgcatgctacgtgattactctgccactgaattatagccccagccctaagtaatgcttaaattctttgaggtatatacctatgagtgaaactctaggtcatattgtaactatatgcttaattctttgaataagcactaaattgttttttcataattgctgaaccatttatattcttaccagtggcatataagggctataacttcctcttttagtttcatttctattattataatgcaaaacagctttaaaggagaaataatttatttgacttacaatttcaagctatagtctatcaaagtgtggaagtcaaagcaagagctaaaagcagctagtcacatcctcagttaagaacagagttaatgcattcacgcctactgctcagcttactttctccactctttttttttctttttttattagatattttcttcatttacatttcaaatgctatccccaaagccccctataccctccccccgccctgctacccaacccccccactcgtgcttcctggccctggcattctcctgtactggggcatctgatcttcacaagacgaagggcctctcctctcaatgatgactgactaggccatcctctgctacatatgcagctagaaacacgagctctggggatactggttagttcatattgttgtttcttctatagggttgcagacccctttagctctttgggtactttctctagccccttcattaggggccctgtgttccatccaatagatgactgtgagcatccacttctgtatttgccaggcactggcatagcctcacaagagacagctatgtcagggtcctgtcagcaaaatctttctggcatatgcaatagtgtctgggtttggtggtactttctccactctttttttttttttttttttttgttttgttttttttttttctaatttccatttctttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgttcttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagacttaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggagtattttacctttgatgagtatgaagtgtccttccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgaatccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttgtctgttattatcctttgaagggctggattcgttgaaagatattgtgtgaacttggttttgtcgtggaatactttggtttctccatctatggtaattgagagtttggccgggtatagtagcctgggctggcatttgtgttcttttagagtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggagtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcccgtgtgggcccttgcgggtgttgggcaagactctgctgtcaaggtagcccggggctcgtgtctcgagtcgagcggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagtggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtcacgagtcgagcggaagggacttgtgccactttctccactcttaacacagttcagggaactctgtccagggaatgatcccactcacagtgggtgagtctttccatcctaattaaagtaatttagattattccccatagaagtacccatgtagacaatattcattaaatctttctttcaggtgattatagattttgtcaagctggcaacttaaactaaccagcatactttcccacatctttgttaacatttgttatgatatatcttttggattacaaccatcctactaggtgtatggtggtatctggctgttttggtttgctttttcctcaagactaatgataccagacatctttacctgtacacagtattatttagaagaacctgttcaaattctttgctcatctctaaattgttacttgtttctatagtgtgaacttttataagttcttaatatattctgtatactaaacacttagatttgcaaatgttcatttaattctctgcacatttcattctttaaatttcttcttcatggtttatttaccaatgagtattatttttttttcctaaatctctggatttttttttctcaagttctcatagaagatccttttcttctaatattgtgaatgtttattatcccacaaccaggttatattgtcttggtatttcatacactgcctgcatgtgtgatctcttaattgaactcatattttaactgttatctctatatgactagctttgaggtcaagatatcttttctgtgccttatgctgactgaactctaggacattttttctttgtctctttttggaattgttcctttgttttgagaatataatataattatgctgtttcctccttcttctgtcttcctcaagtgaccaccccgtataccccttcttgcccctccttcacattcatgaccttttctttcattaatttttgttacatgtacatgtgtgtataaatatatctaagtgtaacctgctcagtgtttagaacgttacttgtatgtatgttttcagggatgaccatttggcatatggttttccattaaaaacatttaagccaggtgcagtggtgcacaccattaatctcagcacttgtagacaaaagaagctggtggatctctgtgcgtttgaagccagtctgatctacatagtgagttccaggtcagcctgtctcaaaacacactaaatttttcatataatatattttggtcatattttcctccttcccaagtcctcctagagcctcctcgcttttctgcacacccaacgttactttttctctttatccctctccatttctctctttcaacccccaaacaccaaaataaaataaaaccacaaaaataaaaatcaggacaaacaaggaaaatgaaaaaaacaaagccaaacaaagccaaaacaaaataaacaagatagaaagaaaaaaacaaaaacaaaaaacctagaacattccgtggagtatgttctgtgttgggcaactactcttggacacagggcctaccttgctgtgtggttgaataatggtgtccttatcttttcagtgtcacgaggccctattcattgttgattttagtgcctgtgctgttggtagagaacaattttatgtgatgcatttttcagggctgggaactgaaaaacagggctttgcacctgctaagcaagcactctgtcacccactaaatattcagtcctcagttcaatttttattggaaatgctctcagaatctaataggaaacttaaaatcaatttatcataaattacattcatgtatcccccaccttaatgctacttctattctgttcatttgagtgagtagcaccccagctacctacttctccaagccagcaatgtgctaattgctttggattatttcttcttgcacttccttacctgcagtataatgtctattagaatagattctacctttttaatgttccctcaatatattatcctattttagtgcccttcacttcagatattaccatgtcagtttgctttttcacctcaagtttcaatctacataatgaaaaaaatccttgactcttcttagccaggtctgaaactgtaatgatttcaatgataacggctcccataggtatatttgaatacttggtccccagttggtagatgtgtttgagaaatattaggagttgtggctgtattggcagaggtatgtcattgggggtatgatttgagatatcaaaataacataccaagcctacttagcttgttctgtttcctgtttatggatttggcttagaagctctcagccactgcttcagaaacatgtctacctgcctgactccatgctccaccatggtggtcatggacttaccctcagaaactgtaagcaccaatgaacccttttctataatttgctttgttatggtgtctcttcacagtgaaaagtaagtaagacataaataggtgcttttgatgtgctcctattgaatccaatgcttaataatggtgttaaattataatacatgctagtctataactgttatttagcttacctgccttctccataaaataaagtatttctgtagtagtccttgttttatatgactttacagttatagtgtctgtggcaaattataaacacagtagttactcaaacttgactatcacttatttctgatattatcttttttgaaagataggagagtaaaataatttattattcatctttggccatactaaaactcaagaaaaatatttttattgctaatataactttgggttatcatagatgtttattgagagaattctgttcttagcaggaccttgacctctgtggacaaatgaagatgaattatatatactcctctggatatgcagtctttcctccttatgctccggtggtgtgttgcaagattttggccttgtaattagtgggacaagaattgaaaaggcaggacagtagacttttaaaatagcaatattttaagcattgtctcaggaagctacataaaagttgagctgaaagagtgtcaagaggtcatcttgtcaagctactttacctttaagcgggcaaattctaaaggattcatggcaaatggtcaggcaggagctcctaattactcattgcaaagaatactcattgtgaaagggaagaaagggcataaagaaatgaaataaaagtttaaggtaatgaatatgctaattcccctgagttgatcattattcaatttgtacttgaatgaaaaaacccacattgcacttgcacttatgttctgtgtggtaataagaaagaatttaaaagaatatacattaaaatgcaactattaatctaggcatttggaaagctgaggcaacagaatggcctaggctaactgggaatacattgaagtttctagtccagtctgaaccattttacaagatcctgtctcaagaaaataggctcatatatttgagtgcttggttaccagttagaagtgtttgggaaagattaggaaatgtagccttgttggaaaaggtatgttactgggagtgggctttgaggtttcaaaagccctgatcaggcccattgtctctctctctgcctgcttctggatcaggatgtaaagctcccagctactgttccagtgccatgcctgtctgcttcctgccatgattatggactaaccctctaaaactgtaccaagcccccaattaagttctttcttttataagagctctcttggtcttggtgtatcttcacagcaatagagcagtgactaagctttatcttcaggtgtgtgtgtgtgtgtgtgtgtgtgtgtgtgtgtgtgtattaaagaaggctatgtaaagaaatgaataaagagaaatgttctctataaaagtgtttaacttactgaaaaattactaaattatttctcataatcattcacttgttagttttaaatgtcactttacacaacctcgaaacccctgtgacaagagcctcaatgtgaaccgtgtagataaggtaacctgtggggaatgtctgcaggtgattattcttggttgacttaattgatgtgaaaagacacagcccattgtgggtgactccagtccctaggcaagaggtcctgagccatataagaagaaagaaaactagttaaacatatataaatgagtaagcacacatgcatttattttctttgcatttggatatcatatgagtatttatttcaagctcctgccaatgtgacttcctttttatggtggactataacttgaaattgtgaactgaaataagctatttccccataaattgtttgttggcagaatatcttattacagcaacagaaatgagtatgtaacacatattctttgtatctcaccagtaatatatgaggattctgatttctctacatatttgccaaaagttattatatctgtcttttttattgttttacttgtcttactgaattgaaagtactagatcattttggttttgatttgtatttccctagagacagaggacattgatcatcttttcatgtttattggctatttgtgtatcttatttggagacatgtatattcaagatttttgtccatgtttgaatcaggttgtttttgttactgttgatttataagagttaaccatgtgttccagacaataaccatctatcaaatatatcatttgtaaatatcctctctcatcctacaggttgctttcttgctctgttcttagaattgttagatgcactaaaaattaattttaatgtagtccactttacccatatcttttgttgcctgtccttttagacatcatgtaaagaagtcattgtaaaatctaaattcaggtaagctgttagtttttgcctaaaattttatagttttatgtctataccattttgagtaatttatttatttatttgttattgtatcactaaaacccagggccttatacatggtagagaactttccctaagctatacccctagtttgtgtcaatttttatgaatggtataaggtaaatgtacagataatttcttttattctggatatctaacttacataatatcatttgtttaaagattttctattccattggcacccttatcaaaatcaagtgaccacatctgtgagggctaatttctgggctttctgttttattcagagacttgcttttgaggctttgttacatacagtgtggcaatctgtgggtagttcaacttctctagtaaaaacctcccaatgatggaaagttttgataaaggcagacatttaaaaatttttttctactatgtcactggtgttgaaatcaatggttgataatacaaatgatagtagtctcttcagatgatgaatgacagtaaactatttctgaaagctactgaaaaaattaaataaaacaacataaagcattcagcatacatcgtgtgtaagaaaggattcttatttaaaatattcctactaatagtacccatgaatgaatagaatgatggatgcttttatctccaaatatgagaaacacggtgttgtagatctagagatacctggacttgagtagctctcagctgtttgtgtgtgtgtgtgtgtgtgtgtgtgtgtgtagaggagggatacacaaggactgggcacaaacaccttacttcctcataaattgttaagactggcttgcttgtttctagcatgctataaacactaaatgagaactagtgttgagatgccaaaggagaaaatgaatttagggtgaagtagaaggaaagcagacatttggcaggcagctttatagttctaaaggagcaacgtctggaacaccatgaagcacatcaccaggccaacctaagagattagaggtatttacatagatttaaatctaatcttcctgatttttctgcaaagtagacattatccccattatatagacaaggaagcagactctgagagattattagagaataggtggtaaatggcagaaccaagatttaaacctaggtttatctggaccccaaggcctgtaatctgaagcaacatagattttatttagtttctttgttaaatgtcatccttattggtaagtgtaagaatagctaagacaaatttcagaatcatttgatggttttttttcattgttatttttctggtctgtaactagtaagcctttaaaaaattaatatcctgtactgctgatttaactggcagattagagtattcaaaactgctggcaaagttactgtaagaatgtaaattttctaagttataagcctgtgtatttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctatgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggatgtgtatttttttataatttgcagtagcaacagtaaaatgtaatagcattcttgctatttgtagtttgttgcatttgacaagatatatggtagagtaggtggatgggtatggtgtgagtctctgtctctgtctcatctccgtctctctctctctctctctctctctctctctctctctctctgtctcatctctgtctctctctgtctctctgtccctgtctctgtctctgtctctgtctctctctctctctctctctctctctctctgtgtgtgtgtgtgtgtgtgtgtgtgtgtgtgtgtgcatatgacaagagtagaaacatctgagtcaagaaaatggaaaggtacattaaaaatggttcccagttaaaatcatgtaattctagtgctaaaagacagctgtttctttcactctgcttctaagttcagccagtcatttttataatcccatgttgttcgttgcaaggtaataagagcagaaaatatagctagtttatccaagttaatacctttgtattacctttgttataacttgccacagggaggtatctttcagtacaactgatgccatcttcatagaaaaagtatggaattgttcggatgtatttgtgggcatgtatagtggttcagaaagaattgtattagtggtcccctgagtacattcggtgaagtctaggagaagagttcagactgtagagctgaaatgtgtggttttgaatccttgttcagatgctggcactgtgaccttgaaagatttacttaagggaacaggcagtagtggttgcttatttcaaaacaaggtcttactcatcatatagtcctgaattccttttcctcctacttttgccttcagagatctgggattacagctgtgtctccctacacctagctaggtttgaggtttatatgaaaagtgtgaataataacaggatgtttaattcagggtggcaataagaataaaataatacatgaaaagctcttagaaatgttcccagatcctaaagttttcagtaaatgccagctattttgtttgtcattgttgattactgttattattgttattattatgtgctgagaaataagcaaagagaatagccaaggttttttctttgtgctcttgcaatgtgaaatatagccttttctttgagcttgaagaaagttgtagtccccatcatagagaaattctttaaaccaaagatctggaattgtatgtgattgcgacatctttatggaaatttgacttcatgatgacgttattggatttgtgttaatacaagaaaaaaaaagtcccttttggtggggcagtctaaactaagagcattgcttttgtagtatggagactggttctacttaaatatatgttttaattgttggacatttctacttcccaatttaggacaaaacaatctctatatatcataagatataggaatatcaaaaggaaatgttggatgtttcttcattcatttcttttttttttttttgagattacgtcacactgtgtaaggatggctgctctggaacttgctgtgtagatcaggttaacttcttctgcattccagctactggaattacaagtgtgcatcacaatacttggtttatttatttaattgtttgtttatttagtaaggtatttattgactaactattttgtgccaggtattgtgtattacgtgctgaatatttttattacaaccaagaaaacaaacagcatttcagatcctgatgtaactaatggtttctcagtagggataccaagtatataagaaaatacatgtttatatgtgagtgaataacagaaaagggtcttatttaattagaatgaatacacaaagacttactaaaggagaattgttataatgagaggtaagataagaaaggcattgaagggatggagagatggattagtggttaagagcactggctgctcttccagaggaccagggttcaattctcaacatctacatggcagctcacaaatgtctttaattccagtttaggagatcgacactctcttccggcttctgagggcaaaaggcacatatggtgtccagacacacatgcaggtaacacattgataacataaaatattatttaaaataacgaatggaattcagacagggaagttctgaaaaagcatgtgtgaaagtctcaaagcaaagaagatctctggacgatggaagagctaccaaaagagcagtgtaagtgtgaagtcataagggggaaagctgtgtcttatgagctcgaaaggtaggaggatcaatgtgctcctgcccacagtggtcaggagactttacctatttttctcagagcagtcctaagacagcaaagagtttggtgtgttgaagggataagaaggtgtcagtgtgaatggagtccaatgtgaataagccaaggctgataatggtgtttacttattgattgtattaaaatgggaagctgagggtttcaagcacaaaagtaattagaaaaatagggatttttaaaagataaaaaagatgtaatagtgtgcatgtgcagaaggaaaattaaagagaagccatgcgcagtagcatatgcctttaacccagcacttgggaggcagaagcagaggcaagtagacttctcaagtttaaagtctaacctgctctacataattagttccaggctgaccaggctttcacagtaagaccttgtctcctatgaacaaataagtgaatgcagatcaacataaaggctcttttatttctggattaaaatcatgttagcattgcactaatgtggtgtgtgtgtgtgtgtgtgtgtgtcagagagagagagagagagagagagagagagagagagagagagagagagagagagagagaatgaataaagggcttattttgcatgtaacacttcaaaacttaggcaaccaggaatgtaaccttccatatactcgcatgagaacagttgtggagtaacagacttggagattggaagggatgtggagattaggtaggatggtgcttgcctttagtccagcactcaggaaactgaggcaggaggatcacaagttcgcagatagtctgtaccacagtcagtgaagcattgactgtaaagtagggactgagggtataattcaatggtagaagctaataaacgccaggctctgggtttgatctctacccccaccctcacaaacaaagggaaaaaagtaaaagaggagttgatggcatcattagttgatgacaaattagaaaacattaaccttactattttccctttaaaaaaatcaatcttgctatctactccagataacttgaactcactgtgcaaccctagttagctttgaacttgctttcagtccttcagcatccacctcctgctgaacactaagcatttcaggcctattgtaccatccctggcttggaagttattaatcttgataagaacagtttcagtggtactgcagggttcaaacagtttagatggacgtatgtgtttgtaagctcctgaagataatctatggagaaggaattgatgatttaggagagagatgatgtgctgattagctttatgtcaacttggcagaagctagagtcattgaaaagaagagagccttaattgagaaaatgcataaaatctggctatcgggtattttcttaattagtgattgatgtgggagagcccagtccattgtgggtggtgccaaactgggatcgatcctggtcctggatgctataagaaagcacgctgagcaagccaggaggagcaaaccagcaagcagcacccctccatcagctcctgcctctaggctcctgccctgtttgagttcatgtcctgactttcatagataataaacagtgatgtagaagtatataaatgaaataaaataaatcccttcctctccaagttgcttttggtcgtaacacttgataacattgatagtaaccataattaagatgaatgggataaccaaaatgatgtttgaatgcaagataaatataatacagagaaaaaggagaaagcttatcctttgagagtggggaatagggatttatgtactataatagaaaataaagatgagaaaagtgtttagattaaactggtagacatagtagtgagaagggagtgtgtctgtgtctgataacaccattcttaatagcataaggggacaggatcatgagggtagagaaggaaaagcagataattttcttgtaaagcattagttgagaaaagtcaatttcagacagacagtatttgatacctatttgtagtctgtgatcacgaatttacataaagcttttcaacaagattatatgattttctacagcaacattaggctgctttggcataaattcaggacagaaaaatctctgaatttattcagtggtgagaggatttgttttattattgacagagaggaagagatgaagaagttgcggaaatgcttataaaggtagatcagtgactatgctgaataaggaaggaggacatggagggatattgtgaaagtggcatctcagtgaaattcatttgttgaatatcagacaaagaattgaaaagagtaaaaattatagaaacaaatataatattaatgttaaataccaatgtgccaatagctataaaattctacataggatagggtgacagacaagcaaatctagaagttatataatatcagctgggaataaaggatgagtagcaaaaaagttagaagaataattagtataacaaagacattgttttagagaagccaaagaatagcttataatattttcactgtcttgaatatggctagacagtcttgtgaatatcatcatttttactacacttcaagcttaaatattcccaatgaaaagtagccttactgttagatcactattcttcaccatcttgtatttgatttttgtttctgactttaatggactccagggaaaaattttaggatcaactgcttatatcttctaactgtcctatcacagctattgtgagtacacaaatctatgagagaaatgagatggaatgtgcccccaaactatgagcaaaataaaccttccttccttaaaaaaaaccaacaacccattatctaaataatgtaaatgtcttcagatatgtgccccttttcccaactgaaataaattttggcacatggagtggagtgatgtgaccaataatccttcaaatttatcacaaagcagtaggacagtgaggaagctggtaacagtacatccatggtcaagaagcagggagagatgaaggctgttgcatctttgccttcttattcactcctggatcctggctcatgggatagtgtcaccagcagttaaggtgggtcctcacaccttgattaactaaatctggaaactccctcacagacatgaacagagagttgcttccatggtgattctagatcctgtcaatatgacagtaaaatctgcattcatgtattcaaggctctgaaaggctctacagtcttgggtgacctttggctacatgtcatcttgtgtttccccaatagctttgcttttgtctcattccacagtatggctttccatttttttccagagaaggcacgctgaggaattctggtttcccaagactgtgcatctttctttttaaaaaatatttttcagatcccatcattaaatcatttcccccccaccttttgcttcctacaaacctttccatgtactcctccaccgctgccttgctctctttcaaattcatgatctctttttaattgttgtcacacacacatatgtatgcacacacacccaaatacataaatataacccattaaatctgtataatgttacttgtaggtatgttttcagggctgaccatttgctattagataaccagttggtgagctcttccctggggaagactatttagccatatgcattttttagttgtctattgttctttgtatagaattcaggcctcttgagcaccctcaaccccaatttacattagtatgtctattgctgtcgtccttgttcagttcatgtttaggctgtcatgtttttgaggctttatggttatagcttctgatgtaactagaagatgcaatgtcaaattctttgttcttctggctcttacagtgtttccccctcttctacaatgacccctgaaccttaggtaagggaattgtattatagatgtatcccttgtagtttttttatagtgatctccatctattgcaaagagacgtttcctctatgaagggtgaggactacacttacctgtgagtataaggataaatatttagaatgtagttagggattatgctgggttagtagggtggtgattgtaggtttttttccccaagatccatgactttagtagtttggggtagtcgtctaagttttcagtattcagaacagttttcctcaggttatttgaatttttagtattaaattacactggaaaccataaggggctaaggaaaagaacaaacagattttgagtgaattcactgataaaaattaggtttatattactttttaaaattctggagtgagttacagttatatgtgtagttacactcattttagatatagtgatgtttttagaactgtcataaaacggaccttatttttcacaggaactatattaccattgtcgtgtgacattgtcagtctatatttaactttgaaagaaaccagtactatgtttctcataatggatgtagtaatctaaaatccaccagtaaatatttcacactttccctttattcccatcttaatctacattatttattattcatttatatcttttgtgctaagctcaagatggcatagaagcccttatgaagtggctttgatctcatgatactcctgcctttgtataaggtacctgccttgactttttgattttccatctgagcatgtgtgtgttgtaagatatgtgttcgttgttttagtgatatctgttctgtgtataatgattatttataataatttttgtttatcattctctgattattattgaacataacttcagattacctgttagtagcctttaaaaacagtttgcttactaagtcagcatctcatgtagttcaggttaatttggaagtcactgtatagatctccattttcaactactgggattagaagtgtgtgccaccatgcccagtttctgttagcaacttttaatgtcttctgtggagaaatgtttcctcaggtcctttactcattttagatcaggttatttgtctaccattaggttatttgtatttttatagtacatgttagataattaaccctcatcaaaatacaatttttgcactttatctcctaatctacagacttccatctcattttcttggtggtaataaagtcaccacacaataatagctttggacctataatgatagaagatgacagtggtccaggctctgtgaaattgagtgcagcagcaaaaaggatgtaatgatggcaaaatgtcaccatggcttggttctaacggtgagagcaatatagcaatgactacccctctgggagtgaggagacctcagtaattcagattggaaagctaatccaaatgctgatagacaaggcactatgtctctttggcctggaacatcaattctggtgggatggcacagtttagctaagatggtagagaggcacaatatttacttggccctggaaaggatgtgtatgcatgttaccagagcctccagatccctagggtataggacatgacataaaccctgcagctagtgagatatatcaaagactcagaggctttagagtccaaggtcatgctttacctatggatttatattaagagaagaactagggtcaattgctctggtgtgctggaggcctgaagtccctcttagggattgagtcctgccttggtggaggatacaaatcatacaatacacagaatgcttgtactgggagaatggagttgggcttcaacttggccctaagggaagcatgcacttgttgtttggaatgaaggaaatgggaaggattcatggtacactggctctacgaattaagaaagagtaccatcttggctggcaatggctaccagatgggtgtatttcagtgatggcaaagcctctagttgagaggcctttatggctacttgcctgcagaacatgtggtcccaagatggtaccatacagtagcagcatgggctatgagaagtagaatacagtgttatctccttctctgggggtagcttagtatcaatactgggtagtttcagaggctgttcttccaaatgattcttgtttgattcctagcacccacacggccactcataactctttgtagctccagttccaggggatctgacacctacttctggcctttatgggcaccaggaacacaagtggtacacaagcatatatgtagccacaacacacatacacaaataaaacaaaggtatgtgtgcttgtttagtatgtatgagtacattcctgagacatatgcacatgaaaaaaacgataaaaccaactaaaaatacttacattgttttcctttccctagtagactgaaaaccacatctgggcaaagattaaattttgaaggaacatggtaaattgaacattgagcattgaacattgagtaaataacgctcctctctattagcaagataagcagaagatggtattgcatgacatgttcacttttgagaaactcatcctctaaataggttgcattcaaagatctcaatatgtgatcctaaacttcattattatagcattaaagctagaagccacttagataatattatatatctactacattttttaaggtgaagaaactggggccttttaaacaattatcatgttgggttattttcttcactgttttctttcctttatatatttattttgtatttcagcatctgtgttccaaagagctaatggtgtttttactctaggacctaagagccaaggtcattttctgaaaagggtggagctgaggaagagtaattctttgaatgtttgaggaacatgagaaacaaatgaaaaatgtggcagaaagtgagaagaaaacacagcaaaattaatgagcaatgctcaatgtctagctgctactgtttgttttgtggctttaccccacaactagctaatggatttaggattggagaaaagatagaagaaatggtcattggtcagaatttaactagatgagttaaaccatcatcactgaagttataaataacaacaacatttgtaatgaaggaagagagcttatgatttcagcaagtctgtaatagaagtaatgtactaggacacttaagctagctaaggaggaagtcagaaaaaatgtaaatggcaaagtagaggaaagatcagtgaactagccttgatatactgaaagaatggttgttagtctggaatattgctattgaggactactgtgcttatattggtgattttggagattgagtggtaaatggtcatctatggttgcttccagttgcgtgaggagtgagtggtagatgcggtatggaaggaagtcactggggatgaggaaattaatgactcagagttcagcatattagataagctacaccatacttctatacgtttatcttctctttcttttttcctttattatttttttttaaatttaatttaatgtgtatggttgttttgcctgcctggtgtatgtctgtgcaccacgtgtgtgtctggtgcccttggaggctagaagaaggctttagatcctctgagattggagtcacagatggttgtaaaacatcatgtgggtcctgggtattgaatctatgtcctctaaaaaagcagttactgctctaaaccactaagacatctttccaacaccaaggacaggatcttattagtgttcattagagacatctaaatgccagctctaggacagctattctaaactattcagagtttatcctccaaggaatttaggagctcttaggatgagtgtattagattagatgttatggtaagaaagatgtatgaattttcagtcttttcctgtctgctattctctttctctctagacatagtcagatttttttcttttaaaagctctttcctctatcttgggatataactcagtaggaaaattaacctttgacccaactttaagctttctttaaaacttctctctcaaatctattattcttttcattgttataaatatttatttattggaaatgcctaattttcactgagcaatattatggggaaaagagtaatcatcatagtatacaacttttgtcacttgggagtatacatacatacatatatacatacatacatcttatttttcttatagtttgaatcataactgataatataagagaacaaaggctttatcacacacatacatgcgtgtaaacacacattaatatttgtgctggggggtagaactcaagggtttatgtatgtaggcaatcactctaccattgagccctatgaccaatacatttttaattttgtatttttaaagtttttagcttacatttcctgttttcttcatattctgtaaaatgttcaaatatttaactttttatgtattataaatttctaatctgttttcttatggtcagacctttcaagtaattcacacgttttgctgttcctgataacaatatattctacttcatcttgtgttcatgctttttttaaactctaattctttaaaaatatttttatgtgtctctatgtgtgcacatggatctttgtatgtgcatcatatttgtgtgtgtgtgtgtgtgtgtgtgtgtgtgtgtgtgtgtgtgtgtgtgtattgaggcctgaagttgatatctgaagtcttcctcaatcactctccaccttattggaggtctcagttgaatgtagaactaatctaactagcaagcctgctttaaggagcttctgtctcctttcttagcactagatttatggggaggtcaccgtactcacccagcatttacatgggttctaactacacaacttcttgtcctcaatcttgaagacaaatatttatctattgaaccatgtttctagcccctaatttttttgttgagctgttttaagagataaattcctagaagtgagattagctggccaaagattatgaacattttccttccgatgaacttactgaaagaactgtataccgtttgccttcatgccctaacactttccttaagtatcttggaatttgtcatcagtcaaacatctttcagagattacaaagtggcttcctatttggaaaatgaatcggctcattctgaattttaagaattcttataatttataagatgtaacactttgttgcaactatcttcttgaagttctcctgtcttggttcatgatatgatatttagttctctttctaccttcgactgattctgtttcttgaatgtctgaaatgaagccttctttaggttgtgttcagtcccttccaacatgaataaactacaaaccactttctctggttccaacttctcccttcttaaattgacaataaagttgttttcatacactatgttctaataatggtttcctgtctcatcttctccttgatcctttccacctcccaacccatccaactccccaccttctttctctctcttaagaacacaaataggcaaacaaaatagacaaagataaaacaaaatgaataaataaaaaaaaagacactaaggaagaacaccagaaatgtatacatacacacaaacaaacatatgaaatccttaaaacctcaaaattgaaaaccatatatacaagcaatagaccagtaaaatgttaaaaagggagaaggcaaacaaaataatataagattttaaaaacctccacaaatacctttgcattcattttatgttggctttgtactgctggccatggggcctcctcttagtgtggtttgtatacccccagtgagattcccttgaagaaagtaagtttttctttgtgagtgatcattggagataatatcttggttgagaatgagaacattctctactgtctaccccggcactgggaccctgtctggttttatctgtgcacattctgtgcatgtgaacacaggctctgttactccatgtgtgcacctgagttctttattgctctaaacatccattgcttgtttttgtaccatgtatcactgtatctacaaatgaaataatttccactcttcaaatctgataatactatttgcatttctagagtttgaagattatgggtagacacatgtcggacccttttgccttattccatctgttctgctggttgtcatattatgttaattctaattattttacaacctctgggtttttttcatatttttatatgattctttcatttaacaaatatttttagagaactgtcatatgcttggccccaagggtacaccaggagcacaacaaaaatcctggacatattgaagatatttttattgcgggaaactatgcaagcatgaaagtaacgcatgcagaatataagataaaaagttacatgttaaagaattggggaaagtcaaaacagggtgtatatgtatgcacaattagtccaggaaagtaaccaagaaagtaacatttggtcaaagacttgtaggtagtcagaagagaagcccacagacgggaagagaatgatggttcattccagatagaagggctagcggtttaaaggttttaagagagagagagagaaaaacaaacaaacaaacaaacaaataaacaaacaagtgctcagaatggacagagtatttagtgtaaatgaatcagaatgagaaaagggaaggtaagtggggtgggcgtcagatgtaaagtgaaagaaccagatcttgtggagattttgatgtgctgtgagtgaaatggaaagtcatttgggcaaaagattgagctgacttgatttcttattgatgtaactgtagcttctgggtcgaagctagattgtatcaagtcaagggtagaggcagaaagcaagtgaggaggcagttagagcaaatgaaatgatgatgatgctttggaccagggatggtagtaatgaaagactgttggattctacattgaatattgttgcaatgtgatatttaagaggaaagaaggctatcaaaaatgacttcaaaattttggcctgaagtgaaagaactaagttcccccctctctttattttgccttttttggagctagggtctttggaattccctttatgtagcccaggctgatcaaagtcatgatgctcctcctacttcagcttccaagtgctagatctacaggtataaggcattttcacccagctgagttattcaattacttttatgtatttactctttttataaatccccggatgcttaattctgttctactctgttctgttgcaattcttaattactttttaccctggctgtgtcaatattcttgataaatgttcagtggtcaatgggatcatcctctcccagcctctctccttaatccagtacatcctcaatacagcgaagcactggtcatatattctttttaaaatcttccacagttttcagttgcacttaactccacaggcagactcttctactttgcatttaaaacctttcataatatgagctcaacctatttaaccggctttatcctttatgatttccatatgtccttcaaattaaaatggcttgctgtctctctgaagttagtgtttatcaacacctccagttataaatcatgcttagttgatataacatggtggttaggagcatagactctagctgaacattccaagtttgaatcatgtctctacatctcattgtgttttgatgcagtttacgtctacctctcaaatttcaatcagacaaacaaagacaatagttgtgtacttcatagaaatgtttgggaaattaaatgggtttatatatacagcatttgaacattgcctgacccatgtttagttctcaaaattgttagctcttactgttattgttattaatatcattttcttttcctagtctcactgtagtgccaggctcatgtaggtaaggactttattctgtatactgctctatttgcaagacctacaatagtgttttgcagataatgaacagttagtaaataaatgattgcagtttccctggcctgagattctagttgctgctgccacttctccacattcttttaagaaccttatgaacctacaaagctcatcatgaatgacgtttattccatagaacgctctggtttttctgattcttattccaaactaaatttaacctctcatttctctgaattcccgaaatatcttgtatatgtttcttttacatcctttactttccattgcctttcatcttagtcatttgtatctaatcttgcttactagatattaaggtcttaaagcacgtactgtgtcttactcattttttttattctctgtggtgttagcataatgccttgaacatggtagatgctcaataaacttttgctgattgaattgaattgaattcattctcctatttatatgcttagctttatatgaatttttagatttctaagtcatgcttccaaagtattaaatctctctgcaatttacttcttaggtatcctaagtagtcaagcttagaaagactatttatatgcaattgcaaaagaagaaactttgtctctgccaagccttcttcagatggcctgaggatttgtgccagatcacaaaattgttctaagtcagtgaaagggaaagtttgttaaatatggtaatatacagctgaaattcagtattctaataaatattcacctaaaaacccagatggagaaaaacagcttttgtgcagatgataaagtgtatggtgtaaaatatatgcacttaagctcatgtacttacaggataagctcctcaaatactaactcataatttatttactaatcattactcttaaatcatcacttttagatttacagctaacagctggggagaggtaaattataaatgctaagaaagttcacagaagatagtaggagggagagactgctgactcccatctaagagacagaaaaattaaaaaccaggtgaagaacctacagcagtgtggaactaatagccccatagagcttaccgacgccttgagggcatcagtgccttatgacaatacagtgattgataaattgacgttcataacgattcataaaagcattaaattgatacccaccacattatattgatgagataagcagtggggattaagtgttcagatttcatccagaagattaaagtacagattatattgtatataaaatagtaaatccttatctagctagctagataactcattcctgagttaagcataagttaaatgtaaaattcctactttttatgcatacctttctgtaccagtccctctaactagaattgaaatgcaatgctaaagcagaacgaggcagtaaatccataaaaatgaattgttcattcacactacatttataacataggaaatacgattatagaacagatgttgactgattgaaatgctgtatgctcaatcatgttagtgtttatttgataaggaatgccatttgtttagctttgctcatttatttagtgactgtggtctggaatttgattagatgctgtctggctgtgtatctctacccaccaaaatcctgagtcagtattagcttacaggagaatggagaagttacagctttttagctttgagaatgaaaataggaagacagttttgtcaatttaaacatctttgtttttctgtatttcacttatgtattggtatcacaacgcagatgtgactaatagtctggcaatagtccttccttgtttaactttacactgaaaattgcatcttcctaaaagtctttttagtgacaaccagggagagagagagaaccaagaatatttcctgaaatgaaatcatttacagatgatgtgtttatgaatcatgggaaagactaaaagttaattgtaaagctactgtgattctaaatagtcctatatttaaaataaactactcaactaatttttgatctcccttggagacagcaaatgtcttttctgtggcagcaagattacagcaaatgatttcatgggaacatttattcagatgctatattttattagctgataattcttatgatatacaatgtagtataataaatatttgaatgaatagatttagaaagcaggtaatttgtagtaagcatttcaaaacatggattaactttcatttctagaagtagtacatcaagctattttgtgatacattgtaaaaatcctgtttcagtgaaataaaaattaagactttacttatataaaacatttcagaaagaattttctttacatttacagaaagataaataagattttaaacacaccactgaatatttctgtgttttttccatctttaaaaatattagaaaaagagtcctttgtttatcatcatcattattttacatctatatatttgtgcttgtatctgtgtgtgcttgtatatgtgagtgtgtgtctgtctgtctctctctctttctctctctgtctctctctctgtctctctctgtggggtgtgtatgtgtgtgtgtgtgtgtgtgtgtgttggtattttgctaaaatggaagtgtggaggtcagagaacaacatgagagttgtttctcttcttccatcatataggttccaaggattaaagtcaggtcattaggcttggtggaaaacacctttactagctaagcactctcactggcctaggaaagagtttttagtggttgccaatacatatcaagtattgttgaacttaagccaggcctgttgaagtgtctgtcatcccagaacttaaaaggctgaggtagaaagattgtggcttccagaccaatctggtctatataagaaaataaatctctggctcaaagaaaacaaaacaaaacaaattagtatattctcttaaaaactacagagtaaaactgaagaaagtgcagaagaatatgaatattatagaaacataatattttaatgcagaattagaagtttcttctataatctctgtcttagggtttccattactgtgaagagatagcataaccaaggcaactcttataaaggctaaaatttaattggagatggtttacagtttcagaggtgtagtccattattatccagacaggaagcatggtagcatgtagccagacatggtgttgaagaaagagctgagagttctatatcttgatccacaggcaacataagggaactatgtgtcacaatcatccataactttagttgcaggaaacccactaccctcttctggcctctatggatagaaaccaggcatgcatatagtgtacgggcataaacacaggcaaaattctcatacatataaaataaagttaaaataataataataatgataataaacaactgcatgttaacacaaataacatcttaatgacaataactatattctattgcacagcaataacattgttaaattcaatgtcatttctttttctgaatgctggtgagactataatgtccatttgtataattttatatctgttaccttattccaattcaaagccccagcacttttctctacacccactttaaaaataacaatgtattaaggtatttagtaccataaaatttattcactaaagcagcattgcttcaactatcagattgttttatagtggcaactatggatatccaattaccccacacccctttcttttctcttgagacatagtgttgctattatacaacccaagctagcatcacattcacagtgtgctggaaactgtcctccattataagttcccaagtgcttgcatcactggcatgcatcgtcataattggctacttccacatttcaaaaaattatatttatcccagtgagtccaaagtgatatttcaattgtgcttttgatttgtattccataaatgatagtgatagaaatcatcttttcatgcaagaatctctttgcttgtgttctttggataaatttatatttaagtcctctacctgttttttcaattgaacatttactttttattattgggctataattttggaacttctaaggatttttttagtttcagctcttacattcagatctcatcatcatcactatcaccaccaccaccaccaccaccaccccttccatcaatcaccactccttccatcaactaccaccaccaccaccaccaccactaccaccaccaccccttccaacaaccaccaccaccaccaccactaccaccattttgagacagtatctggctatgtagtctagggtatcattgagcttctcatcttcctcagcctctcaattgctaaaattataggtgtgtatcattgtgcctagctgcaatccattattaaatttttatgtattatagtgaaggtgtctataatagctaatttttattgtcagcttaatggggtttagaatcaccatggaaatgtctcagagtacatctgtgaaggtgtttccagaaaagtttgacagatcacagaagacttactctacgtgtgcatggcactatcccattggctggggttccagactgaataaaaaagagcaagtgacctaagtaccagcatctgtttctctctatttcctgactgtgactactatatgatgagcacttttggcttctgcctccttgatttcctcactacaagggactgtatcctcaaactataccaaaatgaactcttaagtctttttgtcaggtattttgtcacagcaacaagaaaagtaactaaaatgtgtccacattcattgttttgctacagttgtttgaagattatttttctcctccccagttgacctggtatctttgtaaaaacataattgattgtaaatcatatatgtgtgtatcttttgtggctgatatatacggtccctgtctaaaatgtatttctagttaaaaatagtgtgtgccacgatgtatggatgtgcacatgagtgtaggtatttcaaaatgcagagatattggattccctggagctggagatataggtaattgtgagccaccaatgtaggtgtctaggaaccaaatgtgatcttctgaacaggcattaaacactcccaaacactgagccatctcttcagcccctgtttatggatatggatattgatatatggatatagatatattcttctggcagtagagcactcaattaccttgtagtttctctaaggtttatttttaatcatgtgcatatgtgtatgcttgtgagtatatatcacatgtgactaccccgtagaggccggagctctcagatcctgatgtgagtgcttggaattgaatttggattttctggaagagcaatccactgagcaatctcttgtgcctgtacttcatagttttaaaattaaagtttacatgtatgggtatgtgtgtgcacatatgtcttcactatgtgtgtgcctggtgcccatggagaccagaagagggtgtcagattctctgaaagtggagtgacagacagttctcagccactgtgtgggtgctgggattccaaccctggttctctggaagatcagctggtgctcttaatcactgtgtcacttctctagccctattttttagttttgtactcagttttgatattggaagcgtatattatttgttttgttttgtttgtttgtttcttggcttgttttgttttgttttcaaaattgtttttggagttctgtgcctctgaacttcagtatgagttttaaaattcaacttatataatgattctaactgagattttagttggtagttttgcatttgtagatcaattaaggggttattgccatctagataatattgacttccactctatgaacatgggtatctttatttaatcttattttacttgccttatttaaaaattattttgtacctgctattaaaagcctatacttctgtttgcaaatgtattcttatggattttgttttatgtttgatgttattataagtggggttgattttgatgggactggggattaaacctaggttctattacttgcaaagcaagaagagttccatcacagaatttcatccacagccatataataacctaaatttttcattttctaatagttcattacatgtatagaaatacagataatttttttacattggcatttcggacttgatgaattactttattagcattggtaattaaaaaagaaaaactttttattgattctttgtgagttctgcatcatgcaccccaatctcacccagcctccattccttcatatctatcctctgacttgcaaccttccccacccccgagaaaataataaacaaaagtaaaaaataagcaaaacaaaaaataaaatttcactgtgaaagctgtaatgtcacagtgtgtcccacgctatacccttttgaccacacatctttacttaaaatgtacattgcaatgggtctcgtgcaaggtgtctggttctgctataccatcaatattgggtcctcaccagaactcctcttggatatcccgttgtttctctgtggagcatctacagctttggatctgcaagtccagccccttcatgtgctccagcagttcatggatgaggtagatgttggggtggatcagctcaaagccctggatctgagcctgggcggtagctgagctgattagcctgccagttctcctagacccacaccaccagggtgagccctccagtactgccctaactaggtcacccagcgttgtagtcaggaagcagcagggacagctctcctggtctcatgcccttgggccagagtacctgcccccataccaactgggccagctctactgtgctgtccaggtgagtatgggggctgctctctcaagtgttgcagctggtgaggaataggaccagctttcctgccctcatgatctcagggccagcatccccacctgctgcagatgtgtagagatgaggaagtagggagggcatctcttcaaaggctacaccatctcagggcaggctaacagtggggccagctctcctgtgcttatgccctctggtctggctcacccacaagtgctgctcaggagaggtgctttagctggtgaagagcagggccagttctcccacactcatgaccccagccagctttcctgactgccacaggtggtgagaggtaagggaatgatggtaattttttaaaaaaaaatgaatactcattttttataatactcttgtcatctgaaaatagaggtaatgttatttctttttttccaaagtgggtgcttattacttattgttattcttagtttaatatggagaatagaagtcataagaagacacccttgtaaagggaaatagtatgctcgctctctctctctctctctctctctctctctctccattccaaaagttgctaccctttccagtccccccctctcaagttcttcaccaccttcccttccccccacctctgaaagagtgtcctccaaacctactcacttccaccagcattcctcttccctgggccattaagtttccacaagtttaagtgaatcctctcccactgaggccatgccgtacatgtgcccagggccatgaaccagtccatgtatgctctttggttggtggcttagtctctgggagctctgaggggtcttggttagttgacaccgttgctcttcctatgggatggtcctccccttcagctcctttagtttttcctctaactcttccatataggtctccaacctcagttcaacggttggctgtaagtatctgcatgtgtctcagtcagctgcttgtagagcctctcagaggacagtcatgccagtctcctgtctgcatgcacaatatggcctcagtaatagtatcaggatttggtgtgtgtgaataggatggatcaaaagttgggttagtcactgtgtggcctttctttcattctctgggcatttttgtccctgtatttcctttagacaggatacatatgatgtcaactttgggtctttcctagagttattgttcagctatctgaggaagttcctttctattgttttgttttaaaggtttcattttattttgtgtgtggatgttttgcctgcaagaatatctgtgcaccattttaatttgttaagttttttcttttaactatgagaattttcttacattgtcttgctgtatagcccagattggcttcaaacttatgatcctcctgcttcacctttctaagtgctgggcttgctggtgtgtgtttccatgcccagctaaggatatttcatgttgtcaacattttatgtgattattaagatattgtagtggtttaaataggtttggaaactcatgtgtttgaatgcttgcccctagggagttgcactgctagtaggatgtgcccttgttagaggaagttcatcactgttgggtgggctttgagtttttctatgctcaggttccacccagtgcaagagagaccctcctcctggctgcctgtggaagacagtctcctcctggccacctttcgatcaagatgtagaactctgccaggcatggtggcgcatgcctttaatctcagcacttgggaggcagaggcaggcagatctctgagttcaaggccagcctggtctacaaagtgagttccaggatagccagagctatacagagaaaccctgtctcgaaaaaccaaaaaaaaaaaaaaaaatgtagaactctgggctcttttagcacatctgcctggatgctaccatgcttcccacaatgataataatgaactaaacctctgaaactgtaagccagccccaattaaatgtttgcctttataacatttgccttagttatggtgtctcttcacagcaatagaaccctaactaaggcagaagtttatggatttcttcttttatctatggtacattgcattagctgattttctgatagtaaatgaacattgcaatcctgggataaattctacttggtgatgatatataattattttatgtatggttagattcatttttaaagtattctggtgctgggtatgatgccttacacatgtaagcccagaacttcagaagtggagatcagaattgccaatacgatggggcctgtctgggctatagagtgagaccccatctcaagaaaaacaaacaagccccaagtattttgatgaggaatttttatgaccatattcagaagtagtatttgtttgtgttttttctttattgcttttgtttgatttgggcattatataataatagaataaaataaaaaatgttttaccatcttaatatttcttcaaagcgtttatgagccttaactgtaatcttttactggaattcattaataaatccatggtctgagcctaggattttctttgttagtacattttggattggaattcaatttctttcttaccttcatagctacccttattttgtttttcttcttaaataaacatcactttttgtttttctaggaaaattcctacttcattttggttatgtacatagagttcaagttattccttcatagacctatgtgtggtcagtagcaatgccctcttcttcattccaaattttaataatttgagttttttgctgtatagtttttctgttaaatacacttagaaattatttgtttcttttttcagtgattaatttgtttttgacaattacacacacatatatgtgtgcatacatgtgcacacaatgtattttgattaatctactcccttattattatataattttatgatgtaatatataataaataatatgcattattataatattatctgactattttacctctccacttatcgattgccatctctctataatagcaagtctagcattttagtttagttctgtgatatctgttgtaatcttgtagtagtataataacgactcagatgctctaccaagttaccaaaactcttcacattgtgctatacaatctgtttgagcaaagggggaaaaaggcagcttgatccatctttatcttccttttacaagtttctataccctgctatcaggatttactttcacttattactgagtaacctttggctttattgttttcatttgaggaaatgagaaaactttccttctaaatgtttatcaacaagaagttattccttttggaaatagtaattgaattctgctgtcctgtgtgatgccagagatgagctcaatatttggcctaggcctctttcattttcctggaaggaagaaaatgtggtggtccttcacatgtgcctggccagcaagtgtagcatgaatctgcagtagctccatcactgacttcaccttgtatacaacgtataaagaaggaatcttgaaaagtaaaatgggatcagtgattaggtttcaataggtcatttgtagcccagtctgatgaaagtaggccataaaatgcagttataacactaatgatagcaaaatactctatattccacattccatgcaagtactgtcccctgttacagtcttggatctcactagcattcctaacttcaaccaggatatatgttattttttttctgagtcataggttgtgaaaacttctgaatggatgaaagaatgtattttcaagggatgcgccctagatagctcatctttttcattatcaatatgagcttaaggaaattattcaacctctgaagttcacttttcacatgtaataaaatatgggtagcataaaagagttgtgaaattttaatttgataatgtgtctaatacttaaaaatatacaagttattataaatagtctttgtcaaaatattttctcttctaaggtccatctggatgatgtaaacagatcattaaaacattcttagctgtatttgaaatgtcaagattgaactatctgaacttaaatctgttgacttttagtttattctctgaaactttaaagcatttgtataatgtattttgaacatatctgtccaatgctacttccctcttactatcgctgtgctttcccttgtctccatccctacttcacatcttccttttttactgttattaataacttcctaagtctaagtgctgtccatatgtgtatgccaggtgtagctaactatgtgtgctcagctgtcaatgggtcaccatatcaacctctctgacccaaatctgctgactttttaagatttttttaaaacaagagaagttattattaacaaaccatacttgtttaccccatcctgttattgaaatgtcttctgtcatactttggtttctgcccagcccctggctacacaatcattttatttttctaccatctcatgtaatcctggtatgttccagctaatatttatacttgctggaattggagtagaatctcaactcaaccaaagcatttatcctacctgaaaaatattcacttgattggcatagtactatgataacagaaagtgtctcagaagaggggaagagtgttttagattataataggaaagagatttacacccgctttggtgatattaccaaacttgcttatagacccaaaggctcttataattgaatgtataaaggttatatatctaattcagtaattaggatactagacatttattgagttttcattatatgataggtgcagtgataaatgcttacctgtatcatttagtttaatcctcacaacagctataaaacttgtttctgtttttatctccatctttaaaaatgagtaaatacatgtacagatatcaacacattaaggtttacatagacgacaaatggaagactgaggtttcaaactgacatgattctagcactacattcctaaacatagtatatggtgtttcttatgtattgtgaatgtagcttctacagaattccagaatgtttgttttagtctaccaggatggtctgaaatattgtctgtttattattttcttaaggcagccttttctgttatttgaacaattaaataggagctgagaatgatgttgaaataaaacctgatactgtatatataaactcaaagcaaataattgtctgtaatatgaatacccacttctcacattaaacatgttatccttaccaaaaataaataaataaacatgagagttaaatgacatcataggtcaaagagatgtagcaatcttctaccaaccattccagttaaacactgcaaaatgcattcttcttggtacctcatagaatatctttaaaaatagatcatatattaggatgcagagccagtcctaacaaatacagaggaattgaaacaatttattttattctagctgaccacaatagaacaaaaccagacatcatgaacaagagaaactacaaaagatatacgaactcatgaagtttgaacagcacacgagcaaatgatgaatgtgtcatcgaagaaattaaaaataaatttgaaacatttctagaatcaagttagtcacaggatatagaacagtcaagtttatactgactaggaagctttctccttgctggctagtttcaagagtaccctgtcagaggatggccatgtgggacatcaatgggaggagaggcccttggtcctgtgaattctccatgccccagtgtagggaatgccaggacagggaagagggagtaagtgggttggtaagcatgggggaggggggtggaataggcggttttcagaggagaaaccaggaaaagggataacatttgaaatgtaaatttaaaaatacctaattaaaagaaaagagtaccctgtcaactgtgataatgaccatagtggcaagatatgcacttgggtgcaatagtggcagaaattttatgtgcataacatgtgctttctgattggatttaagggagctccgtgggaggaagcacatgctttatattaaaaatgtggctgtggtagtttgaagaggaatggcctccataggctcatatatttgagtatgttaggtatttgacagggatttttaggaggtatggcctgttggggtaggtgtggccttgttgaatgaagtgtgtcactgggtgtgggctttggagtttgcatgctcaagctaggcacattgcacagtgtcatgctcttcttcctgctgcctgtgaatccagatgtggtactctgagctcctgcagcactgtctctgtagtatgcaattatcctttttgccatgctcataatggactaaacatctgaaactaaaattcatctttattaagtgctttccatcataagaattcccatggtcatagtgtctctttacagtattagaatagaacattgactaagacagtggtcaaaaagccaagttcataggcctcaggaattaacctactactattgttttgctaagttctcatagtatccaactgcctctaaattcttatttccatagctgtagattagtgcaactctaagacctcatcagaaaagtttctttgtgcagtgggtggtagttaatgaagaatatcaaaagtggtcaaagtgcagaaaataactatcaatggaatactcagccacaaatggggcatctaagtcacacaaaatccccagtgtacaatgtacaaggacaattgtagaagagaggacagaaagattataaagcaagagtccagaggagacctgagcaaaacagtgtgttctggataggacaggaccactgtactcatgaactcacaggctctgtagttggttgcacaaaatcaagccagtcaccattcaagcatgaagtgagttcttgagcctgtacccctaactgagtagatggcttctgtgggaggagggtcagttttatttaagtgtgtgtgactctacttaggagacagagacagtgtctacataatgagttttaggccagtcacagctatgcagagaaaacctttctcaaaaacataaataaataaataaataaaaaataagaacacaaagggggagaatttgggtgtagggatgtgtgtggtgggagttaaggggaggagttgtcagtgaatatgatcaaaatacattgcgtaaaaattttaaagaataaaatatgctttaaaaaagcaaaggaacagaaatgatgatttaatgattgagaacacttgctgctcttaaagaagaactgggtttggattctgacaccaacaacgggtggctttcaactcctctgtgggcacatgcatatttgggaacacacgcacgcacgcgcacacacacacacacacacacacactcacacactttgtatatgcccagtgtactggctagttttgtgtcaacttgacacagctggagttatcacagagaaaggagcttcaggtaaggaaatgcctccatgagatacacttgtaaggaattttctcaattagtgatcaagggggaaggccccttgtgggtgggaccatctctgggctggtagtcttggttctataagagagcaggctgagtaagccaggggaagcaagccagtaaggaacatctctccatggcttctgcatcagctcctgctttctgacctgcttgagttccagtcctgacttcctttggtgatgaacagcagtatggaagtgtaagctgaataaaccctttctttcccaattgcttcttggtcatgatgtttgtgcaggaatagaaaccctgactaagacacccagggagtggcactatttggaagtggccttgttggagtaggtgtgtcactgtgtgtgtgggctttaagaccctagctgcctgaaagccatctagctgccttcagatgaaaatatagaactctcagcaactcctgtaccatgcctgcctggatgctgtcatgctcccaccttgatgataacagactgaacttctgaagtcagtcccaattaaatactgtttttataagagttgcctcttataaaaacatggtgtctgttcacagcagtaaaaccctaagacagaagttggtaccagggactggggtattgctgtgataagcctggccatgcttttatttggaagaatgtggatttgggaattttggatttggaaagcaatggaatcatttaagtggggcttacactagtaggaatacggaagactttgttaccgtgagtgatttgaactatgcagacctggcccaagaggtgtcagtggagaacatttgtgtgtgtgtgtgtgtgtgtgtgtgtgtgtgtgtgtgtgtgtgtgtgtgttattttggtgaagaatgtggctgccttttgccattgtccaaagagtctgcctgaggctaaagtgaaagtgaagagatttggattaattgctttgaaaaaaggaagcctggagggtgtgggggacttttgggttagcattggaaatgtaattgaggaaaatacgtaattaaaaaaaaaaaacagcctggtataaagtctgttgtgtggttactaaagttcactcttatgaagagcattttaatgaaatgtagcaaactgagaaaggaaaaaatacaaaatacatggctcaagtattaaaggagcactgggaaatagaatcgagctgaatcctatgttctgggagataacagattaagggagtgggactttggggcaagatcccacccagctaagtttagatcaaggcatggttgtacatacctttaatcccaggagacaaacacaagcatatttaaaccatgatacatataaattctaaattttgatttgagactataatctggagtagtcaatgaagataggaatggaggaaaggatcagtgggaggctttaaacaaagctctagagaggggtaataggacccaggtgctacaaagcagacactgaggaaatgggtacgggcaaaagagtaatacagggggagaaggaggaaggacagagaaatagcactaaggatatttgaagaagctataggtaaacatttttatgagcttatttaaaaatgcatgttgtattaacctctggccttcatattcatgctacacacatgcattgtaccaatatgtacagatacacacatccacatacatataaaacacacacacagagacagacagagagagagagagagagagagagagagagagagagagagagactccaccagaaaaccttttagatctgactaacattaacacagtgattcttaaccttcataatgctgtgaccctttaatacagttcttcatgatcgggtgccccccccaaccatagaattattttcattgctactttataactgtaattttgctattgttatgaatcataatatatatctaatatgtagaatatttaatacacaaccctcaaaggagttatgacccacaggttgagaaacactgctttaacaagttgtcagtgtacaaagttaacatataaaacatagtaggcttcttatatttataacaaatatgtttagaaataaatcagaaaagcaatttcattcacagttgattcaaacaaagaaaatatcttggaacaaatttaataaagaaagtaaacaacctctatactgaaaactttaacatactgaagaaattgaagataataccagataatggaaagacctcccatgttcatggattggaagagttaatattgtgaaaatatctagacaaccaaaacacctatagactcagtatgatccccatcaaaatccctatgccgttcttcatggaaatagaaaaattcttaaaattcataaataaatgaccatggagagttaaagcaatcctgagcaaaaagaataatgttgtgtttatcaccatacctgatctcaagtaatattatcaagtcatggtaacaaaccgagcttggtattagcacagaaacaaatcaatggagtagaataacggatccagatatgaactcacacagccataaccacctgatttttgagaaatatgtatacatcatagaaaagacatcttttccaacaaatggtacagggaaaactggatatccacatgtagattaatcaaagtggatccttatttcatcccatataactatcaactctgaatcaagcactgaaactccgaagctgaaaacataggggtacaaataaggactttcccaaaagcgtaaaatcactcaggaaatagtaccaacagctgacaaatggggttaaatgtaattacaaatcttctggactgaaaaggaaaaagataattaagtgaacagatagtctatagagtgggagaaaatctttgcacactacatgtctggcagatgattaatgtttagaatatacaaagaacaccaaatatgaaacaagaaatcaagcaggctaatcagttctcaaaagataaaatacaaatggccaaaatagtacgtattcacttgtaagtggatattagctgctaggcaaaggataattatgcaacaaatccacagacccagaaaggctgagtaacgaggagggctcaaagaagaatgcatggctctccctgggaagggaaaatagaatagattttttgtaggtgtatttggggcagatggagatgggaacaggaggggtcatgcatggggctatagagggagagattactgtaggagttagagggctcaaagacaccattggaacatgatccacagaatcaactaagcatggctcataggggttcacaaaaaatgaaggggttcaccaaaacaaaaaaaaatcactggattctgtatgggtcagagctcggtcctctacatatacattatggttgtgtatcttgtcattcttgtgagacttctaacagtgggagtaagtgtgtctctcagtcttttgcctgatctttggacccctttcctcctactaggttgcttcatcaagccttgatatgagggttcgtgcctagtcttattgtaaattgtttttctatgtacagttgatatccctgaggcctgctattctgtgaagagaaacagaggaggcttaggtctggggaggaggggaggtagagggtactggaaggagtagagggagaggaaactgaggttagatgggaggcagagggccggagggacctgaatgagagaggggagggggaaggaaaaagggggtaggatcaagtatcaggggagacaggagaggatcccagagatccaggagaatgaatggaaatatgcagcaatgtagggtgagggatgggggaaccactagaaagtcccagacaccagggatgtatgtgggaggctctcaggactcaatgggggtgacattacccgaaatgccaaagggggatgggagatggaacctgaagagaccacccccagcaggtagacatggctcccatttgaggcagtgggccacccaccaatcttcaaaatttttgacccagaattgttcctgtctaaaggaaatgcagggacaaaaatggagcagagactgaaggaaaggctgccagtgactgacccaacttgggatccatcccatgcataggcaacaaaccctgaaaccctgacaatattactaatgccattgtccttgaagacagaagcttagcatggctgtcctgagaggctctcccagcagctgactgactgagacagaggcagatacagccaatcattgcactgaggacatggacctctatggaagagttaggggaagaactgaaggagctgaaggggattgcaaccctgtaagaattagaacaatatcaactaacccagacctctcagaactcctagagactaagcctactaccaaagagcatacatgggctggtttgcagcccccaggacatatgtagcagaaggctgccttgtctggcctcagtgggaaaggatgcacctaatcctgtagagactagataccacagcgaagggggatgctggggtgaggttgggtggggaacaccctctcagaggcaaaagatttgaagagggggttaagaaatctgggaggagaacctggaagggggcaacatttggaatgtaactaaattgaataattaaataataaaagaagaattataaaaaaattaataaataaataaattaaaaaatgaagttgttctgggagacttctcttatagtgtatgatcacagagaggcctctcaactctctttcttgtgcattgattaataataacaatagtaataaaataataacaacaacaaaatatccaatctaaatagccttcagagaaataaaaaataaagttctatcagaaattcattaaaatacaacaacaaatgctggcaagggtggggacaaaaaggaactcataaacactttgggtgggaatgtaaactagtccaacctctatggaagttagcatggaggttccttgagaatctaaaaatagatgtcccatataactcaactattccatgtggtgatttgaataggtttgcaccccccacccccataggctcatgtgtttgaatgcttggcctatagggagtagcacaattaggaggtgtgaccttgttggaatgggtatggccttgttgaaggaagtgtgtcactgtagaggtgggctttgaggtatcatatataagctcaaggtggaatcagagtcttctcctggctgcctgaagaagataatctcctcttagctgcctttggatctagatatagaactcttgactcctccagcaccatggctgcctgtacggtgctatgcttcccaccatcatgatgatgatttaaacctctgaaaccataagtcagtcccaattaaatgtttgcctctataagagatacttggtcatggtgtctcttcacagcaatggaaaccctaactgagacattctactggaatttgtccacggaactccaagccagcatatcatttgaatatcaacatttattgtattactgtttactataactaagttactaaactaccaacatgtctattaataggggagtgggtaaataaaatgtggaatataagtgcaatagacatttttttcaaccataaagaacaaagtcatactctttgtgcggaaaatggatacagctagagatcttcttcatattaagtgtactattaagacacttcagacaatttcagaaagacaaacattgcacacgttctcacagtttgttccttgagtatatagatacacaaaattctgataatttaacattttattgaattaattttattatatttgtttatttatgtgagtgaacacatgcattgcacaatcacacgtagaagttggaacatagcttttagcagtcagttctctccttttgtgtgggttccaagtattgaactcagttgaactaactcagtattgtaggctcagtagcatgtatgtttgccaactgaacaatctcactgccccccaaaacaaataaaaaacaccctgatactttttaacaatataatcatggagtgtttatataagaggtatttagagatcgtctaatttattttctcaatgttacagatgagttatttaatcctgctgaagacagatgaacaagattttataggactttctgaaattttacttgtttggagcctctagaataactgttctacattcttcaaaaaatgctttcaatatttaaaattgccttttgttattcctctaaacttttctcccatgctaagcaccctgaggttttcattattattattattcctttttaatatgaattattttcaggctggaccattctggacagccatcttgatacccagttctgattaattatttccttatttaaattgcagtatgcaaaactaacatccatatgcttcatatattgcttatacagcttaagtcacttattaagagatttctctagtaatgttagtatagactgctgatgctatagactgtcctgctctgtgactctttctctttcttatcatcattattttaaacagcaggtatatctgaatcatagttctgaacactgatttaataattgttttctttagcatggattgctaatgtcatgattagtctattttcttagacactggtttattggaaaaaatgagatgggaggtaaaattgtatacacattttaattcttctagctatattgattgattaaattactttttaatttttttaaattttttttccttattttaaaaatatttttattacatattttcctcaattacatttccaatgctatcccaaaagtcccccataccctggccccactcccctacccacccattccctctttttggccctggtgttcccctgtactggggcatataaagtttgcatgtccaatgggcctctctttccaatgatgggcgaatacgccatcttttgatacatatgcagctagagtcaagagctccagggtactggttagttcataatgttgttgcacctatagggttgcagatctctttaactccttggacactttctctagctcctccattgggggccctgtgagccatccaatagctgactgtgagcatccacttatgtgtttgctaggccccggcctagtctcacaagagacagctatatcagggtcctttcagcaaacgcttgctagtgtatgcaatggtatcatcgtttggaggctaattatgggatggatccctggatatggcagtctctagatggtccatccttttgtctcagctccaaacattgtctctgtaactccttccatgggtgttttgttcccaattctaagaaggggcaaagtgtccacactttggtcttcgttcttcttcaatttcatgtgttttgcaaattgtatcttatatcttgggtatactaagtttctgggttaatatccacttatcagtgagtacatatcatgtgagttcttttgtgattgtattacctcactcaggatgatgccctccaggtccaaccatttgcctaagaatttcataaattcattctttttaatagctgagtagtacttcattgtgtaaatgtaccacattttctgtatccattcctctgttgaggagcatctgggttctttccagcttctggctattataaataaggctgctatgaacatagtggagcatatgtccttcttaccagttgggacatcttctggatatatgcccaggagaggtattgtgggatcctccggtagtactatgtccaattttctgaggaaccaccagactgatttccagaatggttgtacaagcttgcaatcccaccaacaatggaggagtgttcctctttctccacatccttaccagcatctgctgtcacctgaatttttgatcttagccattctgactggtgtgagatggaatatcagggttgttttgatttgcatttctctgatgattaaggatgctgaacattttttcaggtgcttctcagccattcggtattgctcaggtgagaattctttgtttagctctgagccccattttttaacgaggttatttgatttttctagagtccaccttcttgagttctttatatatattggatattagtcccctatctgatttaggatagttaaagatcctttcccaatctgttggtggtctttttgtcttattgacggtgtcttttgccttgcagaagctttgcagtttcatgaggacccatttgtcaattctcgatcttacaacacaagccattgatgttccattcaggaatttttcacctgtgctcatatcttcgaggcttttcccccactttctcctctataagtttcagtgtctctggttttatgtgaagttccttgatccacttagatttgaccttagaacaaggagataggaatggattgattcacattcttctaaatgataaccgccagttgagccagcagcatttgttgaaaatgctgtctttcttccactggatggttttagctcccttgtcgaagatcaagtgaccatgggcgtgtgggttcatttctgggtcttcaattctattccattggtctacttgtctgtcactataccagtaccatgcagtttttatcacaattgctctgtaataaagctttaggtcaggcatggtgattccaccataggttctttttccttgagaagagtttttgctatcctaggtttttttgttattccagatgaatttgcagattgctctttctaattcgttgaagaattgagttggaattttgatggggattgcattgaatctgtagattgcttttggcaagataaccatttttacaatgttgattctgccaatctatgagcatgggagatctttccatcttctgagatcttctttaatttctttcttcagagacttgaagttcttatcatacagatctttcacttccttagttagcgacacgccaaaatattttatattatttgtgactattgagaagggtgttctttccctaatttatttctcagcctgtttattctttgtgtagcgaaaggccattgacttgtttgagttaattttatatccagctacttcaccgaagctgtttatcaggtttaggagttctctggtggaatttttagggtcacttatatatactatcatatcatctgcaaaaagtgatattttgacttcatcttttccaatttgtatcctcttgatctccttttgttgtcgaagtgctctggctaggacttcaagtactatgttgaataggtaggagaaattgtgcagccttgtctagtccctgattttagtgggattgcttccagcttctcactattttctttgatgttggctacaggtttgctgtagattgcttttatcatgtttaggtatgggccttgaattcctgatctttccaagacttttatcatcaatgggtgttgtatcttgttgaatgctttttcctcatctaacgagttgatcatgtggtttttgtctttgagtttgtttatataatggattactttgatggatttccgtatattaaaccatccctgcatccatgaaataaaacctacttggtcaggatggatgattgctttaatgtgttcttggatttggttagtgaaaattttattaagtatttttgcatcgatatttataagggaaatttgtctgaagttttctatctttgttggatctttctgtggtttaggtatcagagtaattgtggcttcacagaatgagttgggtagagtaccttctacttctattttgtggaatagtttgtgcagaactggaattagatcttctttgaatgtctgatagaactctgcactaaacccatctggtcctgggctttttttggctgggggactattaatgactgcttctatttctttaggggatatgggactgtttagatggttaacttgatcctgatttaactttggtaccttgtatctgtctagaaatttgtccatttcgtccaggttttccagttttgttgagtatagccttttgtagaaggatctaatggtgttttggatttcttcaggatctgttgttatgactcccctttcatttctgattttattaattaggatgctgtccctgtgtcctctagtgagtctaggtaagggtttatctatcttgttggttttctcaaagaaccaactcctcgtttggttaattctttgaatagttcttcttgtttccacttggttgattttgcccctgagtttgattatttcctgctgtctactcctcttaggtgaattttcttccttttgttctagagcttttagatgtgttgtcaagctgctagtgtgtgctctctctagtttctttttggaggtactcagagctatgagtttccctcttagaaatgctttcattgtgtcccataggtttgggtatgttgtggcttcatttcattaaactctaaaaagtctttaatttctttctttattccttccttgaccaaggtatctttgagaagagtgttgttcagtttccacgtgaatgttggctttccattatttatgttgttattgaaaatcagccttagtccatggtggtctgataggatgcatgggacgttttcaatatttttgtatctgttgaggcctgttttgtgaccaattatatggtcaattttggagaaggtcccgtgaggtgctgagaagaagttatatccttttgttttaggataaaatgttctgtagatatctgttaagtccatttgtttcataacttctgttaggttcactgtgtccctgtttagtttctgtttccatgatctgcccattgatgaaagtggtgtgttgaagtctcccactattattgtgtgaggtgcaatgtgttcttttagctttactaaagtgtctttaatgaatgtggctgcccttgcatttggagcatatatattcataattaagagttcctcttggaggattttacctttgatgagtatgaagtgtccctccttgtctttttttgataactttgggttggaagtcgattttattcgatatttgaaaggctactccagcttgtttcttcagaccatttgcttggaaaactgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagtgatattaaggaaaagtaattgttgcttcctattttttgtttgtttgtttgtttttagagttgtcattctgtctttgcggctgtcttctttttggtttgttgagggattactttcttcctttttctagggcgtgatttccatccttttatttttttttctgttattatcctttgatgggctggattcgtggaaagataatgtgtgaatatggttttgttgtggaatacttggtctccgcctatggtaattgagagtttggccaggtatagtagtctgggcaggcatttgtgttctcttagtgtctgtaaaacatctgtccaggctcttctggctttcatagtctctggtgaaaagtctggtgtaattctgataggcctgcctttatatgttacttgaccttactttcttattgcttttaatattctctctttatttattgcatttgttgttctgattattatgtttcaggaggaatttcttttctggtccagtctatttggagttctgtaggcgtcttttatgttcatgggcatgtcattctttaggtttgggaagttttcttctataactttgttgaagatatttgctcgccctttaagttgaaaatcttcattctcatctactcctattatcagtaggtttggtcttctcattgtgtcctgtatttcctggatgttttgagttaggatctttttgctttttgtattttctttgattgttgtgccgatgttctctatggaatcttctgcacctgagattctctcttccatctcttgtattctgttgctggtggttccagatttctttcctagggtttctatctccggtgttgcctcactttgggttttctttattgtgtctacttccctttttatgtcttggatggttttattcaattacatcacctgtttggtcgtgttttcctgcaattctttaaggaatttttgtgtttcctctttaaggtcttctacctgtttagctgtgttctcctgtatttctttaagtgagttattaacgtccttcttgatgtcctctactatcatcatgagatatgcttttaaatccgggtctagcttttcgggtgtgttggggtgcgcaggtctaggtggcgtgggagtgctgtgttctgaagatgatgagtggtcttgatttctgttagtaggattcttacctttgcctttcaccatctggtaatctctgaagctagttgttatagttgtctctggttagagcttgttcctcaggtgaataagttagcctctatcagcagacctgggagactagatctctccttagtttcagtggtcagagtactctcttcaggcaagctctcctcttgcagggaaggtacccagatatctggtgttcgaacctgcctcctggcagaagttgtgttccactcatcagaggtcttaggatcccatgggggatcctatgtgggtccttgagggtgtctggagactccaagggcaaggaaccctggtgctggagtggaccggaagggacttgtgcccctgatcaggccgagttatctgcttccttaattaatgcaatctcaggtcccgcacgattggattggagcagatgctgtgttccactcatcagaggtcttaagatcccacgggggatcctgtgtgggtccttgcgagtgtccggagactctgcgggcaaggccccccagtgctggagtggaccggaaggaacttgtgattgattaaattacaagtaccaacattttccacatttgttattcaaatttttttgaggtagactagcttgtatgccattgacatcaaataagagtgcagagctaatcattacctgaaacctaggtgatgaaaggctttattctccaagtagtgaccctctgactcacataagaatgacctaatatggaagtcaagagcatgttgttttctcacattatgctctttttcttaattctcagaggaagggagaaggtatctatgaaaggaggtgtaagagacaggcaagctcaccagagactgttacagaaaaataaaaactgcagcatggagacaggatcagtttttactgtactattgttacttgtcctttaggaggattttttagtggagaaatcttgaagactagaggaaacatgctaagttaggactttaaatgatgtcccaattatcttgtcacattaatggtcaaaatgcaaattaatatttatatatttatatattgttatttacaaatctttgcccttgacaaatctcagttctgtagaatattctcctgtctgtctatttccttatatgtgagatcaagattagaatatagagattgttttgtagcttccacattatcttctaggggagtctgtttctacttagttctttaaactgctcttaggacttcatgtactaatttgtgtaaattgtgcttacctttgttctttatgtcccctactgtattataatctatttcaggtcagtgtctagctatattttatcttcgttacatccatagcttatgaatttttaaaacttaaatattcattacaatcattttagtgactttctctaagttatgaatttatatattttttgattgtacagtgagaattttatttaagcaaatacttgaacaaggaccaagtagaaaaaaatgaaagaacagaacaaagtaagtatacctgacataagagctgaattagtaaatgtaagaaatgaaaaattatatgaatactttaaaatttaagtagaaaagtatccgtgactattttaagaagtgtgaggatgaggactgaaggatatgatttcaagataagtgaaaaatggcttaattaaggactgtagcggtactggaaaggatcaaaattagaaaagagaagacagtgagaagtcagtgtaaaagagcattcaggacatatgactgtaaaatccctaatgatggctgggtaagtttgtgcatgctcgtaattctgcactttagcagctgagacaggaatatcttgagttcaaagccagcaagaccctttctcaaaaaacaaaacaaaacaaaacaaaataaaattcgaccctgtctcagaaaataaaaacctcagtacttaattagtagcagagaaatcacagggaaccatagtggttaagcacacatgtcagagtagctgagctctgccactttctaggtgtttgaaattgatcagattagttttctttgcctttcattccctgtttaagagaatgggattaatagtgcctttcccaggatctgttccacagatcagatgaggagatgcatgtcagtgtaatggtgtaaacatttagaaattagctgttgcagtttcagttgtatcttcaagtttattttcagtagggaactgaattaagtttgattcaataattaagtgataatgtatgtataacaatttatagtgttttccaatcgagtatatcatttggtccctatgtcactttaactcaccagaaccatcctttggtggtttgactggtttgggcatctgtgcagaagagctgttagtctagagtttaaatggttaagcagccagagaaggagagttgggattaccaatcctctcacctttgttgttttccaccctctcatttcctttccacaatcattttgtttggatagaggtaaactttagtcaaaatgcttaccagagtatgagacatagtcactttgtcttttcttcctatttctgtcacccacacacagtgttttgagcagcactaatatggagcaatgttttagaatttatgtgcggagtgttgtctttgaggtttggattaaaagcatcagtgaaaccaaaggaaagtaatcaggcacataattgagcaggtggaacaaatttgttaactttgctttgggaaaacaataactgttttttaagtattaaatcaaccttaggttccatgatccttaataagaatgggaacaagggagatgataatgcattggtttctgaagacatcagagactgtaagccttgcatctaatatggttgattccaattgggggagggtgtggacaggggatgcttgtcattggctcttctataatgcagatgtttcttcaagagaaatatttatcttgtgcgtgttgtcatgagatatttttaagatatcataaaacaaggaatttgaagtataagctcaaaatgtaatgtgctacatagatgaacataatttcttttaagtattgatctttaaaactgagctggacaaatatatttagcataggatttttatttgaaaagattgatttttcacttccgttcttttaaaagaagagacttaaaacatcagagaatctttgaattagaacagacacaaaggtcatccacctcacgtccttgctgtctttgtgaatcagctttgcttgtcatcatcctaaacttgaaatgtgtcagtaatggagaacttgacctcaccagagataatgcatgtcatttgtaggctgatttagttgttataaaatatctttcttattaaattctacaggcataaattgtcttccatatgacggccaatgactagaactcccctcaattttctctaaccccaccctcaagcctaagcatgttatttctactgttcctttattgctttgaatctgtatatttatgcatcctctcaactgtgagctccttgagggcacgggccacatcatatcttcgaatgtgtctggtatgtaaaagggtttttgaatggagaacaacatagtattcaactccttcactgttcaagctactcttgtttgttctctgacttgcctgacattaaataaatatttattaaatgtcttatggtatgagacactgccagcatttagctatacagcagttaaagatatatgggcttcaagtattagatataaacaagaaaagggcaatgcaaaacgaggtgattaggatgtggtagtatcctatgtacattaggatgtatatattatatagtttccaattttgttgttaaaataaggaactattctaagtgtgctttgactagtactacttaacatatattttacttggattcatatctgcttaatgtggttttaggtgataattgcttctaaatactagtacattattgtttaatcattcagtaagaatctatttagcttctatcatgtatgatgagctgaatcaggtattgaagctataacaattattagaaatagatacactagtaagctaatgaaagaaattctcaaaacagtttaactaattttgtattctgttctctaacgagacttctgtattatatgtatttgcatattatacatatacatctaagcaaaatcaacttgtatttgtctttgcttaagacaaacacaaagttttgttccatactataattctgatgtgagctgaggtgtaggaggatgggctgggaagaaaccaacaaacaacagcttcatatgcagtacatctagaatttgtcagctggaagcaaatacaaaagatgaaggaacagaagtgtggagtggctgctctgttgttatcccatttaagtggttagaaaggattcagagaaaaatagcatctgtaggaaatgggtaaagccatgtagacagttaagagatacagctatatggagaaaagtgtgcaaaggtcttaagtctagaatgtgttcgatgtgtttggggaatcctgcaacagaagctgtgataagaaatgaaatttgatgtcatggtgatttgttgagtgttctattaagtcataattttcttttttaaatttcttttttattagatattttctttatttacatttcaaatggtattccctttccttgtttcccctctgaaaaaaaccctccctctatctcctcgcccctccccctactcaccagcccacccactccagattcctggcattcccacacactggggaatagaaccttcacaggaccaagggcctctcctcccattgatgactgactaggccattctctgctacatatgcagctggagccgtgagtcccatcatatgtactctatggttggtgggttagtccctgagagctcttggggtactggttggttcatattgtttttcctcctctgaggctgcagactccttcagctccttgggtcctttctctagctccttcattggggactctgtgatcagtccaatggatgactgtgagcatccacttctggatttgtcagacactagcagagcctctcaggagacaggtataccaggctcttgtccgcaagcactttttagcatctacaatagtgtctgggttaggtaactctatatgggaaggatccccaggttggacagtctctgagtggcctttccttcagtctctgctccacactttttttctgtaactcctcccaagggtattttgttcccctttctgagtaagacagaaatattcacacttggtttctccttcttcttgagcttcatgtggtctgtgaattgtatcttgggtattccaagcttctgagctactatccacttatcagtgagtgaataccatgtgtgttcttttgtgattgggttacctcactcaggatgatgttttgtagttccatcaatttgcctaagactttcataaattcattgtttttaatagctgagtagtactccattgtgtaaatataccacattttcggaattcattcctctgttgaggtacatctgggttctttccagcttctagctattttagataaggctgctatgaacatagtagagcatgtgtccttataaccagtaggagctaagacgaaaaggatgggccatccagagagttggagcatcttctgggtatatgcccaggagtggtatagctgagtcttccggtagtactatatccaattttctgaggaaccgccaaactgatttccagagtggttgtaccagcttgcaatcccatcagcaatggaggagtgttcgtctttctccacatccttgccaacatctgctgtcacctgagtttttgatcttagccattgtgactggtatgagatggaatctcagggttgttttgatttgcatttctctgatgactaaggatgttgaacatctcttttttttagtttttttttaattaggtattttcctcgtttacactttcaatgctatcccaaaggtcccccatacccacccacccccaatcccctacccacccactccccctttttggccctggcgttcccctgtactggggcatataaagtttgcaagtccaatgggcctctctttgcagtgatggccgactaggccatcttttgatacatatgcagctaaagacaagagctcccaggtactggttagttcatattgttgttccacctatagggttgcagttccctttagctccttgggtaatttttctagctcctccattgggggccgtgtgacccatccaatagctgactgtgatcatccacttctgtgtttcctaggccccggcatagtctcacaagagagagctatatctgggtcctttcagcaaaatcttgctagtgtatgcaatggtgtcagcatttggaagctgattatgggatggatccctgcatatggcagtcactagatggtccatccttttgtcacagctccaaattttgtctctgtaactccttctatgggtgttttgttcccatttctaagaaagggtaaagtgtccacactttggtcttcgttcttcttgaatttcatgcgtttggcaagttgtatcttatatcttgggtatcctaagtttctgggctaatatccacttatcaatgagtacatattgtgcgagttcctttgtgattgggttacttcactcaggatgataccctccaggtccatccatttgcctaggaatttcataaattcatttttttaatagctgagtagtattccattgtgtaaatgtaccacattttctgtatccattcctctgttgaggggcatctgggttctttccagcttctggctattataaataaggctgctatgaacatagtggagcatgtgtccttcttaccggttgggacatcttctggaacatttctttaggtatgctgctatatctactcatttgtattttgacctttgtaaagggttttaattttaatttgtattccagattttattgcattgtattacagccaatgtagtatgctaatctttacatctagtaatcctaatgttaatgttgtaatttggacctttaccattcttcaaattctcatatcttgaaggattggtctcaagcactattgggaaatgatataactttttggtggtgaagcctagtggaagtaaatgaaatgattaagagagtgtccttgaatagatttttagaccaatggctccccactccttgccagctccctgctgtcatgaggtgaggagatttactctactgtgtacatctggccataataatctgccacattttaggcctacaaacagtagggtaagcaacagtatgttaaaattttgaaattatgagacaaaattaatattttcttcttttaaattatttctttcaggtagtttgtctgaggaagggaaagatgattaatataagtagctacccctttttcatttaggccatatgcaggtttagtcaatgtgactttgtttgctatataagtcattaatagaaatcttgaaaagggtgaacttctcttgtttggaaattaaatttacatttaatctggaaatcattatttggaatatgctttttgaaataccacttttctcagcttcaatggagcagattaatttttattctttctgtaagtgtattatgaaaacctaccaaatatattcctaaaatcaagaaataaaaacataacttttacttggtaacttttatgacaaagaggaagaaaggagcaaaagaactccaccatttgctattggttgttttgttgaactttgtcattcttggcaacttgggtaagatgaaatatcaatttgtaatttgcatttccctgttaatacaggaaaaatctccagaagcttgtgagccagctagcctggcagatgtagtggcaaaaaggaaggaaggaagggagggagggagggagggagggagggagggagggagggagggagggagggagggagggaggggaggggaggggaggggagggagggaggaagaaaggaaggaaggaaggaagacaggaaggagggaggaaaggaagacaggaaggaaggaagacaggaaggaaggaagacaggaaagagggaggaatagtccctgttagggactatgaacaacatttgagatatttcttagacatttttttctcttgttttgaaaaaaactctgctcctttcttaggtcaatgctttgaaggagtttggttttttgagttcttcatatactctggatattaatcctttgtcagatgtaaagctggcaaaaattctgtgccattcagtgtgtttcctcatcacgctattaattgttcctttggctttgtagaagctttttagttttatgaagtcatacttgccaattgttggccttaattctctggtaaatggagtcctattcaaaaggtccattgttacgcctctattgcataggtactgtctttgttttcttctagcagtttcagtgtttcacagtcaggttgctgatccatttggagtttttgtatgagatgatagatatgtgtataacttctttcttctgcaggcagacatccagggttttcagcactatttttttaaagatgctttcttttgaccagtatatgttttaggcatatgtcaaatattaaatggctaaaattatatgtactcatgttttggtcttttgattttgttaattggtctacatgcttatttttgtgttgatactatattatttttattaaaatggttccttaatatattttaaggtctagaattgtagtccttctggaattgttctcttttgtctgtgttattttggctatcttgggtattttgtggttctatatggatttatgacagtttttttctatattgtgatgagatgggtgttttgattaataatatatataaatagtttttgtaatatggctattttaacaatattaattctacctagctgtgagaaaaggatgtctttccattttctggtgtttttttttttttctatttctttcttcagaagtttgaacttttcattgtagatgtcttccacttccttggttatgtttattcctagatgttgtcttttcttttaggctattgtgaatgggatgctatccatgatccctgcatcttggttgctggtgtataggaagctatttatttgtcctgttgattctatatcctgccccattgctgattttttaaaaataatttctagagggataaaatggtatcaaaaagatagcattttggttctgatagaattttgggaatctctcacatatgacatatcatctgcaagtagaaagagtttgacttctttccgtatttgaatccctttagttttcttctttgtcttactgctcaagcataatactgaaaggaagtgggagtggggatactggacatcccttttctagttcctgactttggtaggattgcttcaagatgtgatcatttaggatgatgatatctgtgggcttctctttatatagcttttgttatgctgaggactgttctctgtagtcctttattctctaggatttttatcatgaagacatgataggttttgtcaaggacttttttctgccttgatgatcatatgattttttttctttgtgctcattaatgtgttttatttacatatattgacttgcatttgttgaagcatccctgtattttcatggataaggccaactttcctatggtggataatcatgttgatgcatccttttttgagtattttgttaagcccttttgaatctatgttcatcagagatcttgtcctgtaatttttttgttgtgttttttttttttattagcgtgactagcttcatagaagggatttaggagtgcttcttttgtttctatttttaaaaatagtttaagaagtattggctgtaaatctttgttgttttgaaagaattctgctctgagttcatctggacctggcttttctttagttggagaattttttattttcatttccatttccacatttattatggatcagtttaggttgttgaattattcttgatttaattttggtcgtttggctgtatctagaaatttatccacttcttttaggtttctaatctaatggagtagagtttttaaaacaatattccccatcaatattctgaatttctttggtgtctgttgtaatgttttatctttcactttaattctgttagttctctttctttctttggttagttggcctgaggttgtgtcaatctgctttatcttctcaaagaaccggctcttagatcccttggttctttgtattattttctttgcttctattttgttcatttcttctccatcttttattattccttgcagatgagtgggtttggatattgttttccttactgtccatgtttttgaattatatcattaagctatttttttcactccttctgacttttcaatgtggacacttaggcctacaaataaaccttttaggtctcctttcaatgtgttcaacaagtttggctctgttgtgttttcattttcattttattccagatcatttttttcaactcttcatttctttttatcaattcactattcagtgatgagttgtttaagcttcatgagtttgtgtatttactggaaattcctttgttatcaattgtacattttattgcgtagtgttcagatagtatccaaggaattatttcaatattttttaatttataaaagtatgttttgtatcccaagatatggcctgttttagagaagcttctatgtgctgctgagaagtatgtgcattttggggtgctggagtgcaatattctatagatatctatcaagttcatttgctatatgatgccatttatttctgatgtttcagtgtttagttttttttctccagatgacctgtctaatggataaatggatgtttaaatcatgtgctattattaatagattgatgctaatttgtgtctttaaataaatattgtttttttaaatgaaatctaagtgccccagagtttggtgtgtgtacatacatatatatatatgtacacacacacacacacacacacacatatatatatatatatatatatatatatatatatatatatatatatatatatatatgcttaaattgaattgaaaatttttgatgcagtttacgattattttttaacttccatattctaggattcatttaggtaatatcattgacagtcattttttctggattggtagatattggagagaagatatgggcttgatcgttcatgttgtttctatttttgtgatgagatctgggcatttgaactttttttttttttttttgctagttttgtgtcatatgaagaaagcagtttggtcctgaggagaggatgtttgagtaggttggctctagaggtttataatgacttagaaggaatgaaattgtgtggacacaggagacaggtgtgtaggatgtgcttcctatttcaagcctggagtgttggtagatatagatctgggtttgggagagtgtacatagaggggaatatcaggcataatcactagattaggccctggagagggacttgtagtatcttggctgggtcatgtgcatgtgtgagtgagtatgtatgtatgtatgtatgtatgtatgtatgtatgtatgtatttttcctgaaacttgtgtgttaattttgtatctttccacttttcaggaaatgtcagctctaacaattttctgatggagtgtttaggttctcttatgtatacaatcatatcatttgtaaataaggatactttaacttcttcccttcttgttagtatctcctttatttctttcctctgtcatgttgctatagtagacttctagcactatactgaatagtaatagagagactctacacctttgtattcaacctgatcttagtagaattgcctttgaatttttctccatttagcataatctggctataaattttctgtaattatcttattatattgcctctatttcttgaatttttagggcttttatcataaagagatgttggattttgccaaaggccttttctgcacctattgagattatcctgtgacttctggccttaagaccatttatgtgatgtattatatttatttatttgcagatgttgaaccatccctgcatctctggaatgaagccaacttgatcatgctgaatgattttctcttgatgtaatcttgaatttggtttgcaagtattttattgagaacttttttcctctatgttccttaaggaaaattagcttttgcatttttggttgtgtctttatctggttttaataacaaaataattctggctttgttggaagagttctctactattccttctcctttatgttatggattcatttgaggagtattagtgttagctcttcttaaagttgggtagaataagcagttaatttatctgggcctacattttggtaggtgaaagatctttttaaattactatttcagccaagttgttttttatagatctactaaaattatttagctcatttggcttaactttggtaggtcatatgcatcagaaatacacccatttcctttatgttttccaatataatgaaatacaagtttttaaggtgcatgcttatgattttctgaatttcactgacatctattgtaatctctcccttgtttctaatttaattaatgattaatttgggtctttgatttctctattagtttgtctttgtctttgcctatcttgtctatcttattaaagtgtatatagactttttgtgtcattgattttgagcccgtttttacccttgtttctatcatttatttctgccctgatatgactcatttatttctacatactgattttgagttttgtttattcatattcttctaagtaccttagatgtagcattaagttatctgttcaaggtctctgtggtttttaacttatagatacttatagctgggaactttcctttcagaactgctttcattgtatcccattggttttggtctattgtattttcattataattcatgtctagaaaatttgatcttctgtttgatttcttcagtggcctagtcattattttgtaatgtgttttccattctatagaagtttgtgtatattctgaagtttctcttgctgttgatttttagctttattccattgtagtagataggatacctgaagttatttcaattttactgtttgtagagacttgccttgtatagtaatgtttgatctattttagataaagtggatggaatactgaaaagaatgtgtatttcagaatttgaaaagaatgttctataaataactattaactcttgacgtttctctgtttactttttgttgggatggcctgtttcttggtgagagtaggataatatccttaccctctattactgcttttatatttgtttcatgaaatagggtatatccatgtccaatgtatagggtatatccatgtaggcttagattgtaatatcttatgtgtggatggattgtcccttttgtcaatatgaggagaccttctttatttctgttgagtaattctgatttgaagtttgttttgttatatatcagaacagcaacatttatcttaatcttagttccattttcttagcatatcctttgttttacttttttcacactggagtaatagctttctttaacagctaggtgtgtttcttaacagaagtgctctcaatcttcttttgtctaggtcctctattttatcatcaagccctgatgttgctttttacttgatgtattgttcaacttataatgctttcccctgaatcttgtaattagcctgttgagttttttaagtccattttcatttcagggcaagttcttttaaatgtttctgcttgttgggttcgttttttaaatcctgaactacctttgctttttcatttagccttatatttgtgttttctttaagttcattgtttggtttttgtcttatttaaactccctgattattcaatgacatttatgattgattgttcaagatctgtgtcctagagtttatgaaggtagttatcgttggagaacaatttttaggtttagtggaactggggagagagagtaatattttgatatttcatgttattttttgtttttgtgatgaaacctgggcaactggatgtctttgattgattgtctgatgtggacacagttgtgcatggcagttgggaatggtatggatggggttcctcaaattgcagtgggacattgggtttaggaactgggtgccatctgaagactgggatatgtaaacctccaagacataactttgtgtgtgtctaatcctacatttaattctatcagcctctgggttttgtatgtttgaattctgctgtttgttacacatacagttagggcattgtcttttattactttctaagttgtctttattttgaagttcattttatcttatatcaatatagccatttttctattaaaatgttaatgtactggacaaccagttggtatgttcttagctgtctagtgccaaacagtcagccctaaaaccatatgtacataacattatgtggtttaaaatggtacattaaggaatatatgtatatgcatatatacatgtatatatagtcatgcaatatcaattagtgaaaaaaagaggacatgaattgggaggagagtggggaggggtacataagagtatttggatggagtaaagagaagagagagatggtgtaatttcaaaaataaaatttaaaaaaatacttaaaatgtaaaattagtcaccaaaaatgttcatgtagtattctttccgaacaattttattttgaattatctatttcactaaatttgaaataagtttcttataaagaacatatatttgagctgggtgtggtgatacatggctctattcacagagctttcaactaagcagaaggatcacaagattgtgctctgctagagctatgcagaaagttcagttgaataggctacatagcgagattgtgggatacaaacaaagaactgagaagtctaatgcatacatggtcttttctctttacccatctgccagtccctgtcttttaattggctcattagtacggtttacacgtatgaaaattattgacatgtagagatgctcaagtgtgctatttattattttttttattgctgtcatcatcatcttttctgatcttgggtcctcagacctaaggttttatcagttagctcttcctggtcttaaactccaagcaagcatttcttccttccattagatgggaagcagggcactgccacaaccccaggattttatttatctgcttgttttctctatgactatatctccttatgtcatatgtatatgtatgtatatatgtgtgtgtgcatgtacatattgcttttatcaatagttattataatatctatgatactcagatatatgtatgtctgtgtatatataccatatataatataggacacatatattttatacacatatcatatgtatatacatacatgtattatatatgcacacatcagtatatatacatatatgtatatgtatatatatgcaaatatatttataaatacctacaaaatacatatatacacacatatgtatttatacacacatacatatacacacacatatatatgtgtattatagtagtcatgttgctattaatagattattatatgtatacatatatgtatacatattcatatatacaatgtgtacatatgtgtacatatatatgtatgtatatatacatataatactagtgaattgatacatttgggcatctaattacaacataatatatgttgtttttcattttttaatttaaaatttatatttaaagtatatgttgtacacacacacagacacacacatacatgtgcatgtgtattccctagtatgcatgtggcattagaggatgtcttgtggaagtaagttctctccttccactatatagattccaaggagagaaatgtcatcaagtttgttggaaattttccttacatgctgagccattttataatatttttgtcttgagtattagatggtattataattttgtttccatggatatatattcttgctgagttttttcttctctatttctggtacttttagattgttcttgttggtttctcttgtgtttcaagaagttcccttgaatgctttttaaggctggttcttctagcaataaatccttttagtttctgttcatctaaaaatgttttacatcccctacactcctaaaggaaatataccagatacaaaaatccatgtttgacagttgtttgctttcacaacatgaaaaatattgttatccctttcccattggcctccactcagaccaaaaatccttagccttttgaattagtgttcacatatagctcaatacacatttcttttggttttctttttacaattgtttgtcttaaaatttaagaatcttaattataatgtgttctggcaagggtgtttttgaatttatactgtttggaattcactcagcttcctagatgcatggcttgtaccaaattttgaaagctttcaagtattgtttctttgaatatgccttcagcaccttatgctttccccctctcattttgaaactctagttatatgaatattgaatactttttaaaatttcttcttaggtatctgagacccctggctgggtaacttttgcactttgtccaaaagtttacttattctgtccttcataatttctgctgtagtattgaatcctccaatagtcttttaaaaatccatcattatatttttatttatatacattttattaggctttgggctcttttatgatgttaatatctttactaaggtgtttattctttccattaatttcaggagagtttttagttggtgctgaaacatttttatgttagctattttaaagttttgtcaagtaattcccagtagagtatgcaagctccaatatcttaggtatacaaagtaagtctcagaatgagagaagagcatttatctccctagctacttaattctagctcttttgtgctagtgctagagacagtgtgcacatctcatgttgtcagaggagtattgtttcatttaggagagaaatgagcccttcctatactgacctctgttgctggcatcagggattcagaaacaccaggtctatttataatcccagaatttgggaggttgaggcaggactattgcaagtatgaggatggtctggtatataatctgttaagacattgtcttacagaacaaacagccattaaaacaattgtacccaccatgtatgagtattctttttctgtgttgcaagatctcttattgttttcctattcccaattcagctcagcctcttgttacccatcaaagttattttgttttctctgtgattagcagagatgaacagagaaaaatactgtcttactcggagtagatttttagaagttctatagtgcctacctataatcatggttacattcaacagcttgaaggcatggctttttagaaaataatcaggagtatgtgtacctctctccagacttctgcccatgtctcattattcacattactgtctagacagtagtttgaaaatcttagcccgcggtcttttctatatcctggaatttatttcattttatttattttgcttccttctatgaatacttcttgtaccctttcctgtcctggattttgttaacagaggccatatggaaataatacaggaattgaatcatttttgtttttctgtctaacattgttactgattgcagtttggaattcctttttattatcttcagtgtatctcttcctgaggctcaggtcatttggacattttaggtgttttgcagatagatgccactcttgtagttatcgttggatagttctttatactcagtccactgattatgtagataattgcgagtgtcagaaaatcttgtatgtggatctcacctgtagcagtctctagagctgtgtggtttggggttgttaacctcggagcttatttcctcacctgtaaagtagaagcaacactgctgctatcaagcagaccaacttcagacttcttatagagattaaacaagataatatgcattaagctaagtggcacagttccttatagagaagaagcattctaactgtggtcatacattttaaaaaccaaggtggtagacaaattttactgttgtttctttggatacctgttgttacttctctgtgattgtatagtcataatttcagttttgagagccttccagttaggttatataaattaaagttctcagggaagattgcatatcttttaaattatgaaatatcatctaattacaactgacactcttaatacagtgctggtgatgattttcttactgagtagtaaatgcaaatattttacagtgcagtctccatggaattgatgtgtaggtgttaaattagcctttctggttaaccatccataaatatttcaaaatacataccttgtgtgggtacctagcttgcttctacatgctgcaaaagtttttgcttgttagacacttcattatgtcttacctgtatttcttgacatattttaagtaagtgtatggttgtagtacatctgcattcctttaaaaaaaatgaagttaccagacatttactttgaatcttctaagtatgcatattattatattttgtacagtatataacatgttttaattcaggtgtttattataacttattgcacctaaaataacagcagtttcaggaaggccaaaaaaggcattattattagaatagtaccagcaacctatttcttccagtacacttttccttgagttaaagctggtaatctttttaatcttggtaaattctttaggtttcatgtttgatagctataattctggaacctcccaaaactaccttaattagaggcatgttggaatgtgtttgaaatttttctgctgtagttgagttacttctggcagtattatgtaatcttaaggatatgcactttctgcagggaatcaagctttcttgctagcttttacttatttttttagtgttccattctcacccctggagagaatagtaatccaaatataaactgtcgttaggcttttgcagatgtttagaactttaggtcttgctaacgctaaccttccaatgttctaccttgtttttgaaggtcagaactgctgttgcaaccaaattgaaatttcactaagttagactctggcaacagaaagctaaatgaaatagtacaaggtctagtgttttgtttcttggtgctttgaaatgccattgtacagtagctacatagttggctttctgtgtgattttttttcatgagctgatttctagatataattttatatgggtgaaaagtgttcatcagtccctgggaggaataaagtatttgattagtagtggggcttttatgctatcctacagaactatagccacaaaaacaaagatcaaacaacctcattcctttggctcaaactacaaccctgcttgagatgttccatgaccactgtgctttccccgtttcttttaggtcactcatggcccaatttgtttttttatttttgaagtttcagatatataatgactttgagttattttcagcccctcattatcttctctcatccctcctagtcttgatgaaacctcagaaaccctcctctttccgagaagggcacatcctactttctttggtgtttatttgtcttgttgagagattggtaacgtttcattatgggtgagggagaagttcaccaggcccacctttcccaaggggatattgattgtcagtagttactgtgggagaagatgacatttgctttagtggtgcagccattgataaactctagttcatgctctagtaagtaacatggcttctcttttaaagaggcttcagttatatagcctaggctgtcctcaaacttgtgatcttcattcctcattctccgagtgctgggttacaggtatgtgccaccctgggttcatcacttggtatttcatagagaacatcaattctggcttctctgtgtgcagaatctttattttctgactgcttccatttgtgtcttgcatagagaatttcttttgtctgccaagccatttttttctggtgtcatcttgaaagagctagaaattttacctccttcattaaactctactggcctgactgtcatggaagagacagttccctgagtcatagatcatgtaaacacttctccctgtcagtttatgtagatgtttagtgttttatgctgctgtcttggtatctttgtgggagagttatatttgttttttttttttttttttagatttttaaaatcacaaaataaagaagtgctttctgactttctggttactcattattagaagtcagtatttaatacattgttcttagatggtaatattgttgggggaaagtatataaatcacttctatgaaaatatataactcatcctgcttattgaacttgcttataggcatcagaaatgatacttggatattcaacttttacattcttgctcatacaatatttactcatagtgttttagaagatttattttacttttctataaatcagtcagatgatacaaagacttgaatttaacacagtaatttttgtatgcatgatgatgttgcctttgaatttataagcctttgactgcaggaaacttaaattttaattgtttcttttttaattttgaaaataacttttcaatagttaccataaatttcttttaaaaatccttactaaactactttatttatttacattagaaaatttgccctgctttctgctctaccctgcctgagttcttcacctcatctcccctgcccccacctctgagagggtgctctctcacccactcacccattcccaccgcacccccaccaccatcccttttccctggggcatcaagtttccacaggattaggctcatcctctgccactgatgccatacaaggcagtcctctgctatacatgtgcctggggccacagaccagcccgtgtatgctccttggtttttggctcactccctgggagctctgaggggtctgggttagttgacactattgttcttcctatggggttgccatccccttcagttccttcagtccttcctctaactcttccatattggtcctggacctcaatctaatggttggttgtaagtatctgtctttgtctcagtcagttgctgatagagtctctcagagaacagccgcgccaggctcctgtctacatacacagtatagcttcagtaatagtgtaaggatttggtgtgcatgcatgggatggatcgcaagttggactagtcactggatgtcctttctttcattctctgctccatttttgttcttgcatttcctttagacaggaacaattctaggtaaaaaatctggagatatgtgggtggctctctgcctcaactgggacccatgtctatttactggaggttaactatctgaacaaaattttgtagaatacagataataccttctacaaacagagttctgcctgacttttcttctttttgtcataacctactctgagcacgatcaaactagtcatgtcccctgctcactactgtacaatattgtacctttgcttctttctgcttaaaggcacctgagtgttttcaaagcaaaaaggggtcaaatttccagaaaaaaaagatgataaattgagataagcccaacattctgtgctatgtctccttcagggcatttgccagtggaagtagtatggacaaagaaaccaagaaactaaacccagagtggtgaacgagacagaaaatgagcaagagtccaacaggcttataggctttagagatacaaaagagagttaagagatatcctgatgatccaaacctgagctttcaaattgccagagaaaaataacacacaatgaaatgaattgagtccaatattttgtattcttttcccttggactagctcctgatgtataagcgggagggacagctgtaaagctcagcagctaagcagagctttcagtaattctgtaatgctggggagacagaaattagagttcagagcctgccaacgagtaggaaccctgaataattatcctaattattcagttgggatccccaaagggctaaagtctaggagtagggatgaactggaaaaaaattccccacagagactaaagtacagatttgaattagttcaatgttggacagaattgaggtggtttgtcccttcctacttgataaaagataagtaaatctctagaggacaacaataatgtattgagctttattaacttttaacatccaatatataacatgaataaacagtcactgggtttaccaggtatattaatcttctaagactggcatgacatagtactacagactggatatcttcaaaattctagaggctgtgtccaactagattcagaatctgtggaaggtactcttcctcattcatagttgaccattctcctgtttgtccttacagtgaaggtattgcagatgtctataaagggattaattccacttaagagagtctttatggctaaaggacttttatctactaataccattgcttttcaggttacgatttcaacatggagaatacaaacatccagtaaacaacaataaaagggaagcaaattctggaattgaggattataataattaaaatatattgattgatacatgcatttagcaataaattagcagctcaagaaaagattgactaatcaactggaagataggtctgtaaaaatattctgactgaagaaccaagcaaaagagttagaaatgtcaccctttcagaaaaaaaagcttgacacaactatgtaactttggaggattccttgagatcaagatttcaaacagcatggaaaagaaacactgctaacccaatctcaggaagaggaggaaatggagggggcaagggaaggagaaacggggtggagggcaaaggcacagagagtatatgtgaatatgagaaaatgacagtgaacccaaacaatggactggcttttataggtatccctgttgggaagccgtggcaaatctactcaactaaattgtagagagaccatagatttacagggtcagacctgggtctacctcagcttcgccttttgctttcttacattatctttgatttgtgattctctaaattgcagtttcctcagatatgaaagaaagttcaattctcttaaagacttattatgctaaatcattgatataaactacaaagtcacatgacatatttttcctttatttttcttagggtgtttacattattttgagctgaaatttatagattctagagacattatctttcctaataaatgttgaaagtttttactccatccattgtgtacttaatgaaaacggaggggtgtctacacttaagtctaggtctttaaattttctgaggttatctttttgctgtgttaatcttagttttggatgtgttaagtacttaatttcattgaatattgttttcttttcttgttgtaaatataattaaatcatttcccccttacatttctgacctccaaactctctcatatactctttcaaagtcatctcctcagttttcattatttttttattcctaaatatctcctgctcagtctatataatgttacttgtatgcatgctttcaagtctcatcatttggtattgaattaccaattggtgtgctcttccccagggaagactgactgttgttccagctttcagcatactttagttgcctgtagttccttttgtagtatttaagcttcctggctccccccacccccatccactttgacatgcttaatgttgttgttcttactcagctcatgtttagtgagtcatcttggtgagacttggtagcttttgactactaggagaaacagtatcatagcaaaatcacagattctctggctcttaaaatctccagacatcttacttcttcaatgatccctgagccttaggtatgggggctttattgtagaagcatccttttagactggactccacaactctgcatttgattggtttggttttctctagtggtctatagaactttccttgataaggcatgatgactctgctcatctatgggtatgaagagaaatatttggaatctagttagggattatgctggtttaataaagtgtcaattaattttcctctgcccactttgaaatatctgttgttttgttcagctcatagttagtcatgttagtgagactttataggtatagcttctgacattactaggagaaatgatatcacaacaaacaggttcccctccaagttccaagacttcactagctctgagtaattggctaggttttcagcaacaggaatgatttccctcttgttaaatagaaagctgctggctactgccaagatatacatgccactattgcatacttagggtaattgtaacattcttgtcattggtgttgttcataggcattatagctgggtaagactgttagttgcttccttctcttagaaccttgcatggcaccttctggaatgatgaaagctactctttggggaggagtcttccaggtcagatccagctcaggtgactctgggccctatatctaaagcacatggtgttttcagcactagggacttgctttccatctctgatggaaaaccaagagcaatagcaatagcatgtatgtttggggagtattttggataagcccaaccaacagctcaaaagaggcttctcatatcttgggttgggatttgttgttgttgttatgtggtctttgtctcttggaaggagttttgtccgtccatatgagaaatttttatttaaatccataattctcaaccttctttaactttttttcctgggatggagagatggctcagtggttgagaaaactggctgctcttccagaggtcctgagttcaattcccagaaaccacatggtggctcacaaccatctgtaatgggatttgatgccctcttctagtgtatctgaagacaatggcagtgtactcacatacatgaaataaataaataaattttcaaaactttacctctaaaattttttcctattattattatttacattgggaccaaagttcccacctctcccaatccatcccccacctccttttgccacccccatccactcctcccccatttctcttcagaaaaaggcaggcctcccatgaatatcacgtaaacatagcatactcagttgaggcaaaatacagcaagcccatagccaacatcaaactcaatggagagaaattcaaagcaattccactaaaactggggacaagacaaggctgtccattctttccatatctattaaacatagtatttgaagttctaggtgaagcataagacaactaaaggagttcaaatggttgcaaatttgaaaggaagaaccctaaccctaaccctaacccctgaattttgggtgtgtacctcccacagctcaggtaagctactgaatgcagggaccagctcttaatcttcttaatgctgtgacccttttatatagttcctcgtgttgtgatgacaccaaccataaaattattttctttgcgatttcatagctgctattttgctgctgcattgttatctgcattttctgatggtcttaggttgaccctgtgaaaatgtcatttggagtgcccacaaaggggtcatgacccataggttgagaaccatgtatgtaaattattatatctatatttatacacagatttatgtgtgtgttatatggtatttttggtaaatagttaatgtcaacttatagatttgacttatttttgtttctaaaagtcaattcattcactcaacgtctgttattgtactatgtgccaggcactgtactaaaagcttgtcataaaagatgagtgatagaaccagtggggaagcacctgaacacttcgaatgtggtaagatgactactacaggagacaaaggcaggcataagtgatgttatttttttcttgggcgctgctgggaacgaaccatttgagccaagtctctaaagattggaagataagtattccatgcagaggatatagtatgtaggaacacaggacaattgaaagattggttgtagtcagggatcaagtattattttatgtggctaggatataggatattaagcaagaaagggggatgtagtgagacatcaagtgtgagtgttgcataaacttggattggcagtaatttggtaatgtgctggagagggtcgtgaagaaatataaagaactgggacgctgatgcaagaaggttctaagtaagaaaggatcagggagaatggcagtggggatggagggttgacacaaagagtaaagcacttgatgctcaagcataattacctgagtttggattcccagaacccacaaaaggccaaatgtattagtgtgtgtctatcatcccaggtatcccactgtgagataagatacaggaaaatcctcaaaaatcatgctagcacaacagcaaagaagaggctattgaagtcaaggagcaaggttaggaccaacagtaaagtttgtcttttgacctccatatgtatgagatacatacacatatacacgcacaaacacagacacacacacacacacacacacacacacacagaaaaatacagaaaaagagggggaagagagggaagagagggagagggggagagattctttaatagcaagtcaaatggataaaaagctccactatgataatacctaaattattttaataaagagttatgataaaattttatgtaacaaggacataaacactacccatcttcatgaaattttatctaatattgaaaaattccataagaactattatattctgagggattcatagagattaagttttgctatctttttaacagcacaatgctgttattgccctgtataagaaatagaaagagtaaacatctaaggtcacacagtgggtagaatgtgagccatcatcaatttctagaacattaacatttatatttagctaccttttaaatatcaccagttggtagtaattgtttaatagcattttaaaacacaatagataattaacagagaaatacttaagtaactccttgttattctccatcttacagaagtaaatattctcctgagtgtatttccttcaactgcaaacatgtttctatattattaccaattctttgtgcacacataagaaatatttctgtattcatgtttataaaactgtttttatattttgtatattatgaatcatgttttatactcattaaattctaacaccatgaagagtctatagcaccatcatttatttttcaattctactgcttaaattgtcagggatttttattgctctctaaacatatttaacaccatactacttctcttcaaacatatgtaaaagtagatgaagtattggattaaatgtttaattaattaaattaaacattattttaacaaattaattagattttcatataacattcacattttatactaaacttattttttgttgtgagtttgggtgtgtgtgtgtgagtgtgtgtgtgagtatcagtattacagagggcaaaggacaacatcagctgtcctgctctatcaatctccatctcatttccttcagagagggcttcccactgaatctggacctaggccgacagccaacatgctccagtgacctaagtggagttcagtttagtgaaaccattttaatttcagaaatcaatacaaagctagtttctttgtggggagtaccaatgtaattgttaaacatttaaatatgactaatatcaagaattaatcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaaaaatgaaaaaaaaaatatcaagaattaaaatgaggcttatataacacattctgtggatatgtaaaaattaaaatgaggtccatctaggcacatagattttacatttagaagaaattgaccatttttaaagacagaaaaaacagagctcatgcttatataactaacaataatatatctagtaaacaaactgaatgtatagatatgactgaatactaaagggtttacatgggctgactggaaatttaaccaaatatttaaataaaattaatatgtagtaaaatacttcaattttagtgaaaatgttgatgagatttgacatatgtgaatgtactataaagataaaaatcagaaaaattgatatctaggagttaagcttattcattttccatacattaaagtagagaagaaaatgcactatatgtaatattcatttttcatgaatgtgttctgctgattttgttctactgatcaaaagccataaaatgtagatcatttttcaccaactaaagcactcaaaacaccaaataatttctttttccaacatcaagcttacactttctgagtacctcttgggtatatgcgaataaatcacagttcctgtcccaaagaaacaatgtacttatgaatgggaaacttgtagtgtttaatgagctcccaaagaggcacaacttaaagattgttaagattggagaggcttttatagacaagagtctggtgtggttgttacacaccttttaatctcagcacccaggctgcacaggcaattggatttctgtgagtttgagaccatcctagtctatatggtgagttccaggacagccaggctcgtagttacaaagagaaaccctgtctcaaaaaaaatccagatagatagatagatagatagatagatagatagatagatagatagatagataatctctttcatttataccttgactgccatttcttggtactaagacaaaatgcttcctctccccataccacaagagctcattcttacattcctatctccataaataacactgaccctgccaattacagtgtctgtcatcttccctccatgctatatatagctctccatgctttaagaaccttcctccaaactcacttccaggagagggccactaattattaatcaatttggtcattcagaagtatttactaagcacctaatacatctaggagctatggatacaccagtgaacaaacaaaatctacctcaaggagctctttcattagaaggaaacaacataaaataagcaagtaagtaaatgtaagaatgtaaatatttacatattatatgaagaaaaataatgcaggatgaattgtcaaacttcatttatgagttgaatgttttgcatgctagaaagacttgcagtagaaggatattggggatttgggaaggaaacctaaagagataagaaaacaaaccatttggtgttagtctatgaggagaggaagacagatcaaaaagcacaaacatcccaagtctagaacatgcttagcaagtttgactggcactaagaacaaagggtggagtggaataaaatgaccagaaagatatctttggacagatcacattaaagactgttgacttcattatcacacaatgggagtaaaatcagcatatgagttgtttttaaagggtcattctagcaattgtatagagatgagaatgacataggcgggaacagtgcagagtagctccaagatgttgatttgtaccaaagcaatagcagaggacataagaaaccatatggaaagtatttatgatgtttagttgatacaattgctaggagactgattggactatgtggggagagagaattgggttataattgctggaacagtgctctcttgttggaaaatgaagatggaatgtaatgcatagaaggaggagctggctttagattaaagcatggacagttcactagagaaacatgagaagaatttggcacagaagcatccaggtgagtaagtatgaggataggaaacctgagggctcagtactgactgctttctcttttgctgcagaaagaaacctggagctaggaatgaaaaggagagatttgaatatgaaatagtcatccaaacatagccactaaatcttaacctctgtatccatttccacccagctggattcattttccttggtttgtgtatgttctcagaagctctttcttcattaaatcctcaccttgaatgatagaaacactcatataagtagtttactaaggagaaaataataaaccattaatttccttataaaggaaacatctacttggagaaatgatgatgtggtctatctactactacctctgtcatgctgctcaaatctccatccccactgccattctccgtgatcctttcttacttggaactttatgtcagcatcccggctctttatatttcttcacgaccctcttcagcacatcaccaaattatggccaatccaagtttatgcaacactcacacttgatatctcactacatccccctttcttgctttataccctgtatcctagccacataaaataaaatctgatagttttatccaaaattgctgtaatccagattggcttcacatttactaagtatcttaggatggctttgcattggttgatctcttgcttctaatctccatgtggtgggtgtatagcaaatccaactgttgtgtagagatttcccaaagctataaaaaccactgaaaaaattattaaaattataaataacaagaaaaatgcatttagaaaagaatacatgttgaatttgatcaaatatattttggacttattgagttgatcatttctctttcctttttatcctgttaaacagtgacaaaaattatattgatttattttgagcattttattaacaagtttcattcacatctacattcacaagtggtgttctcctataatgccttttcttggttttcttattaggctaatacttaattcagatgaaatgggttggaaagttttcctttctcatattttctgcaagtttatgaggggttggtatgatttctttattttaaaatgtttggtagaatttatcaataaaataactagtgcttgaatgtttcttgctagaatttttataatagtaaaccaaagtttaagaaagtcatagaactattcatatcatccctttcattacaggaacccttgatagtttgtgactctgaaagaattcatccattttgtgcaattttaccaatttccaggcacaaagtcttgtcttttaaatttctgtggggtcaagcatggtgcctcttctttatctgatgcttatagtttatatcttctctactgttttcttggttaggttgtaagcgtctcagttttactgccccccccccccaccaccaaaggacaagttagctcttggtttgattaaaatcatgcaaataactgacataaaaattttattgattcctatttttgtctctttctttttacctttggtttaatttcctttttttttctagtgttgaaagttttgggagcttagttccatagtgtcttttcttctaatataagctttagtgttttcatttttaagcactacgtactataattgtatcccagacaatttgataagctaattatttaattactaaattttgatgctatggattgaactgtgggccgtgtgcatgtttgacagcagtctgccactgaactactccctcagctaaatttttattttcacgcagctcaaagtattttaaagttttgccttagaattcttttttgatccataagttatttacatatatgcttttaaatgtccaactacttaagaaataggtgttatatacatttttttctagtttaatttcattatatttaaagaacatactttatatgatttcaattcctgtaaaagtttcccatgtccatttaatgtactgctagtctaattataaaacttagcagctactatggaaaacaaggaggttcctcaaaaaataaatgcagaaagctataatgtaatccagcaatcccaatagagtcttgaaaagatacttcacacccacatttgtaacatgagtatttgcaatgtcaagagctagaagcagtacaaatatttttttgtcaatagatggatcaacaaactatggcttatagccacaatagacttaaaattccactttaaaagagaaagaaatgcagctacatagatggatcttgaaggctttttatattttctgaaataagccaaagattttatgtctccatttgcatgaattaccttaagtagttaaattcatagaaacagaaagtataattatgactattagggaatggggatgaaagtaaagggtagttgtaatctaatgagcctagaatttcagctttgtaaggtgaaaaattccataagatctctttacaacaatatgaatatactactgaaatatacacttccaaaaatggcaaaaatttttaaaaagctttgcattacatggatatttttactgcaattagatataaaataaatcttttttgagatttgtcttatggaccagaatatcatgaaagatggtaaatactctttgtgcacttgtaaagcctgttttttgctcttgtagaatagaggtttttttttttaataaatgtcaattaactgaaattagctaacagcattgtgcagttctctacgcttactgattttctgcctagtcgttttattgattgctgagagaagcgtgttaatatccacaactatagctgtcagtttcccttctcagactttttagttctgccaacttttgtttcatatatcttgaacctctgttgatagttgcatacataatctggattgtgaggatttctagttgaagtgatccttttagtttcatgtgatcatctctgtttatttcagctgatattctgtattttgaagtctactttttattactatgaagtgagctttttatatggaacatgtgattttttaaaatttctatcttcttaaggtatatttattcagatgatttatatttgatgtaatcattgatataattggattttattatctgctttctgattattcttgctagacttggttgtgattttctttctttaagatcactgtggaatatttattagtccattttaatttatgtgttactgctgtatgttacatttgtatattgatgtttgctgtatgaatttcaatccatattctcaatattgcaatgtcatgtttgagttactattgtactacttcaggtacaatatagaagatttaactgaccgtgtggcttcattatcttaccctatttgcattcataagtattttgagaattatagaaaattcaaagtactatttcataacattttgcttccaatagttgcccatattttgaagaacataaatgtaacttgtaacatttgtaagagatttatacttctcttgtattttcattgtttctgattatcttagtttccatctaatacattttccctcacctaaaagaatttcctatatagtttttggccagaatcatcatatttttagttatcattaatctgaaaatatcatttacctttatttatattttaaaagtttttttgagaatgtcatatatgagtgttgtaccttctataatttctatctctctctttccccttccaattcttcttgtgaaagtaatttcactgtatgtaaaagtctcacttatatttgttaagtaatttaaatatgaagttctactatcttctgacttccatttttttctttcaagaattctcatattaatattgttttgagacaggatttctcagtgtaaccctggttgtcctggtggaactcactctgtagtccaggctgaccttgaatttagagatctgcctggctctccctccccagtgctagaattaaaggcatagaccattactgcctagccatctacatataattttagttgttttgtttaagatggaggtctaactatgtaaaaaaggctgaccttaaactccttatataatatataacattttttaacattgtggccatgattttctttgtccatatcatgtttgagatttgttgagtttcttaagcctttaattaagccttttaccaagttttagaaatcttcaattgtaatagtttaggtatattttctatgttcatttcattcttctcttctaggactctagcacatggaagttaaaatttccgatgttattcttcaagtctctcatcatttcttcactttctcaacattttttctttttattaatcttactggatagttcctactgatttatcctaaaattgtcttttttcctgtcatttctatttctaatttactattaagtttatctcatcattttaatattttagatcccttatccctcagttataaattttcatatggttctttttatggtttgctttttctacttaaacttatctagtatgtttacctttattgcatatagcatgattctcatagctatatattagctctctattgctaggttgtgggcaccacctccagcaggaagacaggacatttgtggggttgccatcccacagtcacacctctgacccataattgttcctgtctgaaagaattacagggatggaaatggagaggagcctgaggaaaacaaggtccagtgacaggcctaaagtgggatccagctcaaggggaggtcccaaggcctgacactattactgaggctattcaatgctcacaaaaagggacctatcatgactgtcctctgaaagacccaacaagcagctgaaagagtcagatgcagatatttgcaaccaaccaatggacagaagcagctgacccctgttgttgaattagggaaggctgaaagaagctgaggagaagggcgatcctatagaaggaccaacagtcttaattaatctggaccgctgagatctctcaaacaccaaacagacaacatacaccagctgatatgagaccccaaacacacatacagcagaggacttccaagtctgtgttcatttagagatgatgcacctaaccctcaagagactggaggccccagggagtttagaagtcaggtggggcggtgggtgggggcatccacgtggagacagggggtggagaggaggtgtgggatgtggagcagttggagggtggatgggaaggtggggaatggaatatggagtgtaaaaatgaattacaaataaaattacatcatatatatatatatatatatccctttttaaaacgaagtaaagctgctatgaagaaaaaaagagaaaaaaacaaaatgttatacagctatacagccccatagtacaaagtgtatctgtgcactatgcttcttgttcattacaaagaagtaaaagcttgaaaaatttgaaaaaaaaccaataaataaacaaataaataaataaaaataaattgtgggctcttagcagcttaaaaccttaaaagggccagggtcttagattattgtaattaagttgttgctagagtcacctgaagcttggggtcttctactgacctaacatagttgttgacagaattagcccctggaagctgaaggactgaattcctcaattactaaaattacctgtagtttccttgccacaaggccctctcaagaggcatttcacattttatcaagttgctcctttaagaagaacacggcccccaatggaggagctagagaaagtacccaaggagctaaagggaactgcaaccctataggtggaacaacaatatgaactaaccagtaccccggagctcttgtctctagctgcatatgtatcaaaagatggcctagtcggccatcactgcaaagagaggcccattggacttgcaaactttatatgccccagtacaggggaacgccagggccaaaaagggggagtgggtgggtaggggattgggcgggtgggtatgggggacttttgggatagcattggaaatgtaaacgaggaaaatacataattaaaaaataatgataataaaataaaaaaataaaagaagaataacagacagctggtctaggtggcatgtgcctttaaatccagcactgggaaggcacaggcaggcagatctctgagagttcaaggccagccgagtctacagattgagctccaggtcagacagggatacacagagaaaccctatattgtcaaaaaacaaaacaaacaaaaacaaacaaaaaaaccccaaaaaacaaaacaaaacacccaaaaaatcccacaaaaaaaaaaagaaaaagaaaatctgtctggtgtactaaaactggtgtgtttttcccctttaaaagttttaaaagtcatttttaaaatttctactattgtcgattttattacttctatttatttttcatttaatttctttctcctttttaaattagatattttctttatttacatttcaaattctatcccctttcctagtttccactctgaaaaaatcccatatcccctccctccccccttccccctctcctgcccctgctcaccaacccacccactcctgcttcctggccctggcattcccctatactgggaccaagggcctctcctcccattgatgactgattaggccatcctctgctacatatgcagctagagccatgagtccaaccctgtattttctttgattggcagtccagtcacagggagctctggggttactggttacttcatattgttgttcctcctatggggcttcaaaccccttcagttccttgggtactttctctagctccttcattggggagcctgtgctctccttccaatggatggctgagagtatccacttcagtatttgtcaggcactggcatagcctctcaggagacagctttatcaggttcctgtcagcaagctcttgttggcattctcaatagtttctgggtttggtaattgtatatggaatggatccccaggtggggtagtatctggatggtccatccttcagtctctgctccggtctttgtctctgtaactccttccatgggtattttgttcccccttctaagaagtgtatccaaaatttggtcttccttcttcttgagtttcatgtgttttgcaaattgtatcttgggtattctgagcttcttggctaatatccacttatcagtgagtgcatatcatgtgggttttgtgtgtgtgtgtgtgtgtgtgtgtgtgtgtgtgtgtgtgtgtgtgtgtgagagagagagagagagagagagagagattgggttacctaacttagggtgatatcctccagatccatccatttgtctaagaatttcataaattctgtttttaatagctgagtagtactccatggtgtaaatgtaccacattttctatatccattcctctgttgaggggcatctgggttctttttagcttctggctattataaatgaggctgttatgaacatagtggagcatgtgaggaaccaccagactgatttccagagccattgtaccagcttgcaatcccaccaccaatggagtgatagtcctctttctccacatcctcaccagcacatgctgtcacctgagtttttgatcttagccattctgactggtgtgaggtggaatctcagggttgttttgattagcattcccctaatgactaaggatgttgagcatttctttaggtgcttcttggccattccgtattcctcagttgagaattctttgtttacctctgtaccccatttttaatagggttatttggttttctggagtctaacttctagagttctttgtatatattggatattagccatgtattggatataggattggtaaagatcttttcccaatctgttggttgcctttttgtcctattgatagtgtcctttgccttacagaagaaggtttgcaatttatgaggtcccatttgtcaattcttgatcttagagcataagcccttggtgttttgttcaggaaaatttcccctgtgcccttgtgtttgaggctcttccccactttctcctctgtaagtttcagtgtatcaggttttatgtggaggtccttgatccacttggacttgagctttgtacaaggagataagaatgggtcgatttgcatttttctccatgctgacagccatttgaacgagcaccatttgttgaaaatgctcttttttccactggatggttttagctcctttttcaaagatcaagtgaccatagttgtgtggattcatttctgggtcttcaattctattccattgatctacctgtctgtcgctgtactagtaccatgcggtttttatcacaattgctctgtagtacagcttgaggtctggcatggtgattccaccagaggttcttttattgttgagaagagtttttgctattctaggttttttttttattattccagatgaatttgcaaattgccctttctaattcagtgaagaattgagttggaattttgatggggattgcattgaatctgtagattgctttcggcaggatagccattttgactatattaatcccgccaatccatgagcacgggagatctttccatcttcttagatcttcaatttatttcttcagaaacttgaagttcatgtccaacagatgtttcacttgcttgataagagtcacactgaggtatggaatataattttaaatattgtgaatggtgtcatttccctaatttctttctcagcctgtttatcctttgatgaggaagactactgatttgtttgaattagttttatatccagcgacttcgctgaagttgtttatcagctttaggagttctatggtggaattttgggggtcacttaattataccatcatatcatctgcaaatagtgatattttgagttcttcatttccaatttgtacccctttgacctccatttgttgtgtaattgctctagttaaaacttcaagtactatgttgaataggtagggaaaaagtgggcagccttgtctagtccctgattttagtgggattgcttcaagtttttcctccatttactttgatgttggctactggtttgttgtagattgcttttatcatgtttaggtatgggccttgaattcctgatctttcgaagactattgccatgaaggggtgttgaattctgtcaaatgctttctcagcatctaatgaaatgaccatgtggtttttgtctttgagtttgtttatatagtggatttttgatggatatatatatatatatatatatatatatatatatatatatatatatatatatatatatttaaacattcctatatgcctgggaagaaaccttgattgtggtgaatgattgtgttgatgtgttcttggatttctttgtgagaattttattgtgtatttttgcattgatatttacaagtgaaattgatctgaagttctctttctttgttggttttttgtatggtttaggtatgagcgtaattgtggcttcatagaacaaattgggtagtgttccttctgtttctattttgtataacatttgaagagtattgttattagaccttctttgaagatctgatagtaatatgcactaaacccatctggtcctgggttttttttggatgggagactattgatgactgcttatatttctttaggggaaaggtgactgtttagatcgttaatctgatcctgatttaactttggtacctggtatctgtctagaaaattgtccatttcatccagattttccacttttgtgagtataggcttttgtagtaagatctgatgattttattagatttccttggtttctgttatgtctctcttttcatttctgattttgtaaatttggatactatttctgtaccctctggtttgtctagctaagggtttatctatcttgttgattttctcaaagatccagttcctggttttattgattctgtgtatagttcttttggtttctacttggttgatttcagccctgagtttgattatttcctgctgtctactcctcttgggtgaatttgcttccttttgttctagagcttttataggtgtgctgtcaagctgatagtgtattttctctccagttactttttggaggcactcatagctgagttttcctctttgtgctgctttcattgtgtcccatatgtttgagtatgttgtgctttcattttatttaaattctaaagagtctttaatttctttcattttttaaaattccttgaccaagtaatcattgagtagaacattgttctgcttccctgtatatgtgggctttctgttgtttttgaagacctacctaagtctgtggtgatctgacagggtgcatgggattatttcaatcttcttgtatctgttgaggcctgttttgtgaccaattatatggtcagttgtggagaaggtaccatgaggtactgagaagaaggtatattcttttgctttaggatgaactgttttataaatatctgttagataaatttggttaataacttctgttattttcactatgtctctgtttagtttctttttccatgatctttccattgctgagagttgggtgttgaagtctcccactattattgtatggggtgtgatgtttgctttgagttttattaaattccttttatgaatgtgggtgcccttgtatttggagcatagatgttcagaattgagaattcatcctggtagatttttcttttgaccagtatgaagtgtccttccttatcatttttgataacttttggtttaaagttgattttattcaatattagaatgaccactcgtgcttgtttcttggaaacacttgcttggaaaattgttttctagccttttactctgaggtagtgtctgtctttggcactgaggtgggtttcctgtatgcagcaaaatgggttctgtttaagtatccattctattagtccatgtctttttattgggtaattgagtccattgatgttaagagatattaaagaaaagtgatggttacttcttgttatttttgttgttagagcaggaattaagtttgtgttgctattttcttttaggtttgtttaaagactactttcttgctctttctacggtgtagtttcccaccttgttttggtgttttccatccgatatcctttgtaggggtgggtttgtggaaagatattgcttaaatttggttttatcatggaatatcttggtttctccatctatggtaattgagagttttgctgggtatagtagtatggggtggcacttctgttctcttagggtctatatgacatctgcccaggatcttttagctttcttagtctctggtgagaagtctggtgtaattctgataggtctgccttcatatgttacctgacctttttcccttactgcttttaatattttttcgttgtttagtgcatttggtgttttgattattatgtgatgggaggaatttcttttctagtctattctattgggaggctcttgtatgttcatggacatctctatttttaggctagggaagttttcttcttaattttgtggaagatatttactcacccagtaagttgggaatctttgctctcttttatacgtgttatccttagatttggtcttctcattgtgtcctggatttcctggatgttttgtgttagggtctttttacactttgcatttcctttgactattgtgtcagtgttttctatggtatcttctgcccttgagattctctcttctatctcttgtattgtgttgatgatgcttgcatctatgactcctgatctctttcctaggttttctgactccagcgttgtctacctttgtgatttttttattgtttctatttccatttggatgattttgtttatttccttcgactatttgattgtgctttcctgtaactctttaagggatttttgtgtttcctctctgagggcttctacctattttcctgtgttcacctgtatttctttacaggagttagttatgtccttcttgaagtcctctatcatcatcatgagaagtgattttagatctgagtcttgcttttccagtgtgatagtgtatccaggacttgctatggtgggagaatttggttctgaggatgccaagtaactttggtttgagttgcttatgttcttatgcttttctctcagcatctgattatttctagtgctccctgccctccattatccgactggatcctttccttcctgtaatcctggttgtgtcagaactcctcagtgcccagctatatctgtgatcctgtgattcagggatcctgggatcctgagattctgggtgtgtcagtgttcctggaagtcaagctgcctctgggaccctgagaatctggtgtgaccaagctcctgggatcctgggatcctggaatcctgtgagcctgtcaacctgagcacctgagatttgagcctcctctggatgctgtgggacttgctgtggagttagcacccatggtaaactggtgcagaacggaaagaatgggagccactggttgggtggggttcctgagtccctggatcctgctggtcccagttattcctgatggtgttggaacggatgttgtgtcctactcacccctgattctgcgatccttagggtgctagagtccctgggagtagagcctcctctgggtgttgtgggactggctgcagagttcttgcctaagttttgggttccttttaagtagatgttttttgtattttctccagaattttattacgaaaggtcagttctagtgagcttcttccatcttgaccaggagtgtaggtttttatttataacatatttgcacatttacagtgggtttcttagagacagcacataatgtacttatttttttaacctaacctcaattttgacatttaatttggacgttcagataattttttaaaaagcttgtggacaattttattagtttgagagaaaaactacaaggcaggaaagctgtaaatctcagcagctacttagagtaggaaaacagaccacaagtcatttcatttgtaagcagccatgtagtgggaagtggggggagcttcagagaaagactgagaaaacccagtgtcagggaaagcatgcggagactttggaaaatagataaagaaattttttttttcgcttttatctgcaacacacaaaaaaaaaccttgttcaggcttcacatagccacattgtggtaactccataagtaagtgcagtgaggagaggcttctgggaaagaaaagtacattatgtaatcaagagaataattattcctccactctcctcagcatgtcttcaggtgaataagatttcctggggtgtgtactcttgggcaggtggttgacaggcccagttggactaattcttattccaggatacaatagtatgtagagttctgatctttggagccattcagaacattgcatctctgcatctctgtccagggccagacacagatcccattcttttctaatttttcttcttcttcttcttcttcttcttcttcttcttcttcttcttcttcttcttcttcttcttcttcttcttcttcttcttcttcttcttatcaggaaagaagtagctttatcgtaatggccctcaacagagctctgatacttatcctccgtggtatttctgtaacatactttcttaaagagtgaagaccctaaaatcgtttagaaatagacaaaattaaaaaaaaaatagttataacctatttctgccatgaaaatgcagatgtaattgtaaacctgtttaccagagggaattagtgtctggactggtggtttctgtcataccctcatgtatagcctccaagctgggctgctaatttaggagaagataacaagaaataagagctcctttctggcattcttggcctctggccagaatagaaccaaggacatttccggcttctggccaaggacaagaatgaaaactgttccctttggggtctctgcccctaagtctgtctaagctgtttctgtttcctgtcctcatttaactgtttaaagaggagaatattgttgggaaatttgggcaataactggttctggcatatgcctgctggatgggggtcctcaaaccgtccagtgggcctagaaaagggacttcagaagtccattagtgattccacttgtataaccaaaaggtgtagggaggaaaagcatcccctgcatagacagagatgtgagggtggagaaaaagcaagaaaggagtcagagaaaagtgaaattggagccctttaagcagaggaaatgattccatcccaccaggagcaggtacagaagtttaaataataccttagagttataagccctagtcagaaaaccagaagtcagaacaaaggacattgaaagatatctaagtcaattagaatcccttactagactcacaagaacatcatccatatgaggcttattgggtttctccttggagtttttcctatagtatttaaagtccgactaaagagcgacgaactgagggtctcctttcaaataagtactttgatacttattggagtcatgataaaaatcaaatggtaaaacctacagaaggtggctcaacagttaaaagcatctgttcctcttatagaagacttgagttcagttcccaacatccacgttactagtgcacaaccagcaggagatctgatgccctcttctagcctctttgggcagtggtacatggtatacacacacacacacacacatacacatacacatacacacattttaaaagattaaacaacagctaaatccttttctcttttttcccccttagaacctacctagaagggacctaattcattattttttaaagaaaatattacttggtactgtacagggggcagcaatctgggaagtaataacaatacttaatgtttgcccataattttcatttaatatcattacaataatatttggatttaaatctaccatttttctatttatattctattgattccatctactttttcatgacttgtttcttctcttcttgtcttctttcagagtaatatatttctatgatttcattttatcttgacttttagatcactagtcttagttctttgtttttaatggttgcaccatttaaaaatcttcattcaacaccacatataaaccatacagagctatgcctgtgttgtatatgtgtgtgtgtgtgtgtgtgtgtgtgtgtgtgtgtgtgtgtgtgtgtgtgtgtgtatggtgttgaggatagagtaggggaaagctaaaagattgctacacactgttaatgacaactcttggcttttgtttggataggatttgtttagcacttaaatttgaaagacaatttcattgaattaaataagctaggtttacagatttttgtttaatcacttaaaaatgttactctactctcttctgaatctcatagattctgatattatgtttgtaattattcttaacctttttcctatgtctttaaatttgggtacttttagcattttctttttatcactgggttaaaggaattagatatgacatgttttactgtgtttttgtttgtaattatgcttcttgtggcttgtagactttattaagttatcaggattatcattttcaaccatctggaaaaagtttggtcatatttttcattaaatacatttttgtctttgtctccttgtatgggtccagtgctttgtttattttgaattttctttcttggcataattccatttgcattgtttctattacctattcttcagcattgctgatttgtatagattgtaatttgtcattttgcttttatatgtttactgatttaatttaaatttactgctacatatattcatctgctacatatattcatctctcccctttgtgtgtgatagtgagatattcctacaagtgaaataatatattgttatatttactactttatacaacatgttttgttcgtttgttttgcagcactagtatcaaacccatatttttatacttgctaggcaagtgttctaccactgagctatatccccacttctctgtatgacatattttaaagtagctgaaagatttaaggagaacaaaaacatattcatagggtttattatctttgtgttcctgttgtatttctggttctttacatgtttttttgcctctaaattcaagttgccatttgctatcatttccttattcccttggtgctattattgtcattaatatatttctatatattatatatacattaattcaattataaacctatagcttcattcaattaaaataatatgtacaaaaaagtaagtagaaaaatatacattttacaatagttaatatttatatatttacctttacaagtcctatgctctttgtgtaagatcaaattaccaacaaaattaaccttccttcgtaatatttcccacccttctctctcttctgagaggatctcactgtgtgcacaggttggtctagaacttgtgctgagattgcagtgccattttaggcttcttcagtatttctcatcagccaggtaaagtagcaacatttttgtttgaatatcttcatttcattttaagttttgaaaggttggtttggagagagaactcttggttgaccccttttgtatttatttttctttataattgcatccttctgccatttgttgtcctctataatctctgatgggaagtcactttaaacttagttggttctcctgtatatgctacattcatgattttgactttttctttgaacttatttctcttgtcataagccttgatgtagatctattgccattatcttcttggtctttttcaggattatcatgtttaggttaatggattttgttatattttattggttttagttttggttttctaaatctcgggtttttccattcattatttcctttttttttaaaatcttaactctttttttggtattcttttaattatatgttgattttattaatgaagtcctgaatttctctgagaccctgttttcttttgattcgctgttctttcagttgcacaatatgctgcttttccatgtttgctaattctttatcagatctactattgacattcccttgctctctttataaagaaaactgaaattatattacatacattcaataattatgtgttaatatatttcctatctctattaagattacgtgtttaaagagacatttatagtagtttactttttagtcattgcttgcttcctttggctttttaaaatgtttatgtcttctttacatattttgctcagtcagtaactgtgcttttttttaatgataatctctcctttctactttttaaaaagttatatgggccacaatttattaattctttctatatctgaaaagacctgcttggctttataattgacctgagtagggtaaaagagtaaaaacatcacaggtatagaaaggctgggatcaggtgggccacgcactgtgctgaagttgcaccagaagccgggaaattcaacatgcttatttcatccagcagaaggaggagacaggtttatgacatatagtggaacaaggaggcaggtttattatatacagatgaccgagtaggcgagggaacagatagaatcttcataggcgctctctgctggggagtagtttcctgctgaagtcctctggaaggaggaccttttgcttgacacccttctttaaccaggagaaggcatccatcccaattgccatattttgatagatttgaattgagtccttgacatgctatcaatacacagtcactcagtaattaatctgttcctttagatatctgtcaagttttttgtttaaaactggacatttgcggttagagatggagctcagggatagagtacgtgaggaccatgtacaaggcctgtgagtctatccctaccaccagaaaaagaaacataggtattttagatatatcatgtcactatctagttactgattactattactgcagtcccattctgtaatctaaactttatttttattgtctgtttgatgacttgaatgtattattagtttagtgaagttcatttcttcagcatgtacaaagtttggcatgtgcatagttaccttggaatgtcaatgattttagaagaattatgttctaatatgtcattttgtccctctgatatcatatatttagcttgttgccaacagcaataatcaactggttttttcctattattttttataatgttttgggaaattctgatccaattacattctagctgttttggtagttagccttttcctcctccccctcccccaccccctcccccctcctgctgctgctgctgcttcacttctgcttctgcttcatcttctctcctcctcctcttcctcctccttcttttattccttagttttagtccaaattgacttcaaacatgtgattctcctgccttagcctcctgaatgctgggattacaggttatgctataatacatttttgtgtcagtatttttgagacaaatctttgaggtttagtctaaccccagggggcctctttttaaatgaatcttaccctggttttgccttaagtgtctaactggtggatagtttagttgtttcttttatgaatcaacgagtctttcagtactcatcagtaaaaccttcatagtgtttggggactaaccttctccccatgctcttttctaagtaaaatcaatcacctagggccgaattacatggagtcctttcttcttatggctgttctgtccctatgggaaaagttgtctatcattcttcagaggtggaggcagtgaaaatagcctgttgtttttttcctcatagttatactttgttcctgggagtaccatcttctgaactccttggttttccttctcagcataataattcaccttatgacagaactgagttaaggaaatttgagacccacaattcttggccaactatttcaagaggagcttatgaagtggtagctcggtaaaagaagggagtctcagattcttagctgtatctacctggattggattacaatttctgaaactcaacattgggtgctatgtatgaactttccgaattctaccctatgtcacacaacaccatgatttagatacagcaaactggagagtatgcctgtgttcttgtttataattgtctagggtagtttttgtcattagaagttggggaaatgggttggagtctaggtgataatagtgtcttaagtgccatatattgatattatataaatattttgatattaataaatattttgatatttttgatagttttaaagaaatgcttttcattgttctatgctcttagaatgatttcctggtacctttttctctccctcttctcccttgtgtgtgtgtgttcgtgttctgtattcacatgtatgtatgagtatactggacatgtatatggaggcaagtctgtgggacattttttaattaattaattaattaatttatttattcactttaattcccaatattagatcccctctcctcccagtcccccttgaaactcctcccccatgctcccctcctattctcctctgagaagagggaatcccttgggtccctgacccccagcacatctcattgtaggactaggcacatgctctctcaataggccagagaaggtagcccagttaggggaatgggatccacagacaggtgacaaattcaaagacaagccatgcttcagttgttgggagacccacaggaagaccaagctgcacatctgctatatatgggggggggggtaggtccagcccatgtttactctttggttggtcattcagtctctgagctccccaaaggtccaggttatgtaggattgtagggaagtgcagagacactgctctggggttggaaaaacacagtgtgagatgtgggaaagacagtgctggttggaggtctccaggcctgcaatgagtcctgggccatggggttctcaggctcatggacaaccaggcactgcagggagtggcagaaggggagagtgtggaattgggggctcaggctggggagtgtctagcctggggcccagggccagggaacaaggagagctccagcttgtcacacaggggatgactgtggcttgatggcagcagatttggtggtggatatgcctgggaatgcagagagaccttctatgggagattaggttgcagctctgtaggtgaaggtcttcttcatggctccccatggcagatttttggggataccctccttctcagggtggacctaagattaaataccttttgcagggagggatgtctgggaagggcagcttattgactaagccctccaggcctctaggtacctctttagagggagaactctgttttcgggcctatgtgactgtgatcatgtctcttttcctattgtcttggtctgagatgttagggatgcttcatctacatgtggaagggattggggcattgcccctacatgactgatggccaaaattctctctacagagggctgtgtatacatgagaggtacctggtgccaagagcaggtaacactcctattgtcctattgttcagggtctccagggcttctagcctttagctcaaccttaccaggcttcttttcatggtccaccaccccacaaagttagttgactctgttggtcttcctgtggcgttcctatcctcttcagttcactcaatccttcacccaactcttccacaggactcttgaactccatataatgtttagctgtgggtctctgaatctgttttggtcagctgttgggtggagcctctcagaggacagttatgctaggctcctgttctaccatcatagcagagtatcattaatagtgtcaggaattggtttttgctcatgggattggtctcagtttgggccagtcattgattgaccattccagccatctctgctctatctttgtccctgcatttcttgcatgcaggatacattttaggtcaaaggttttgtaagtgggttgctgtcctcatccctccaccagaagtcctgcttggctaaaggaagtggccacttcaggatccatctactgtggggcattttaggtggttccatccctggttagatagttttgagtggtaacagaaagcaggctgaacaatgtgtggcaaggaaaccagtaggcagtgcccccatggcttctgtttaggttcctgccctgtttgtgctcctgccatgcttgagtgcttgccctaacttcccttcatgttagaaggtaagttgtaaaccaaatcaaatccttctcttccctaagtagctcctgctcatggtgtttatcacaggaatgagaagcaaactaggatacttttcaccttagttttggaggtagaatctctttctgaacctgaagatccgattttgattaagccgggtaactagtgtactctcaggtgctacctgtctcctacttctcagcactgaggttacagattaaaagtggacatggccatggtcagttacatacctactaaagatttgaactcaggtccttttgcttcatcagtaagcattcttacaaactttagccatcatcctagcccccaattttctgtttaattacaattgcttcttataatattcactaactctggttatctatctgggttgagagtgaccagtggtgtatgctattatcgttaaagtcattccttctggttttttttttttcctgaaaatcctttctctcagttttgggtagctcctggtcatgcatatacagattgaataatcagctaattactcatggagattcccctgacccaagtaaatcactgaagttcttatattctgtggctctctcattcacaattacaaaacatagtgactagtagtaacttcagtctgtttcttcagtcccgagaaaacattgattctctatttcagttccttcttgcctgtgacttaaaaactgcctcagtgccatgaactgtaataataataatttgcctggtctttccttagcaattacagtcttgtgcagcttgtctaatatcagaatgaagatttttctagctattttcctgtttaaggaaggaaggtaaatctgaccctttttactacacttatctggatataagattcttacatcaatttttttccttttatttttcttgaaaaggcactatgtagtagttaaggcagctgctccatttttctgtgcctcattattggcctctgtggactagagatagtaagactcttacccttgcagtgttgttaacatgactgagttaatgtatgccaacagtttataaaagtttacacttaagctgaaataagttttaaattctacatccagcaatattttcaccatcattaccactgatacaactgtctttatttcccatatatcattggagaaattttccaaggcttcacttatgaactgtatataaaagtggactagatcaaaatatctaagttacttgtaaatattagacattgtagcccttccgctcgactcgagactcgagccccgggctaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggtccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggcccacacgggactccccacgggaccctaagacctctggtgagtggaccacagtgcctgccccaatccaatcacgcggaacttgagactgcggtacatagggaagcaggctacccgggcctgatctggggcacaagtcccttccgctcgactcgagactcgagccccgggctaccttgccagcagagtcttgcccaacacccgcaagggtccacacgggactccccacgggaccctaagacctctggtgagtggatcacagtgcctgccccaatccaatcgcgcggaacttgagactgcagtacatagggaagcaggctacccgggcctgatctggggcacaagtcccttccgcaagactcgtgactcgagccccgggctaccttgccagcagagtcttgcccaacacccgcaagggtccacacaggactccccacgggaccctaagacctctggtgagtggaacacagcgcctaccccaatccaatcgcgtggaacttgagactgcggtacatagggaagcaggctacccgggcttgatctggggcacaaaccccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtacctgccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagatttacaggagagcactgctaaagagttacaggctctaaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcatacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaccaagttcacacaatatctttccacgaatccagcccttcaaaggataataacagaaaagaagcaatacaaggacggaaatcacgccctagaacaaccaagaaagtaatcattcaacaaaccaaaaagaagacagcaacaagaacagaatgccaactctaacaacaaaaataaaagggagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgccagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttacctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgtaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtaataaaaactgcatggtactggtatagagacagacaagtagaccaatggaatagaattgaagatccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtaggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtccatctacacaatggagtactactcagctactaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaattccagggccaaaaaggggaagtgggtgggcaggggagtgggggtgggtggatatgggggacttttggtatagcattggaaatgtaaatgagttaaatacctaataaaaaatggaaaaaaaaaaaaaagaaacaccaaaaaaaaaaatattagacattgtataacagttgttttttgtatgtatgaacacttatatatttgtgtatatatagacaaaccttaggttggtagagtttgagagttaaaagaattacatatattgatttacttggtccatgaacacatttatgcccattatgctgagtagcttgatgaaatttccatagcaagccttttaaaagttgtccatgaagcattcttttacacaatgtcactagttggccctttggtacctaatacgttcttggccaccaactaagtataaaattgcactagcaattctgtacaattatctagttttaaaaattgagagccaggcatggtgattcatgctcttaattctagtactttagaggctgaagcaagtatcttaagttcaaagccatcatggactatacagtgagagcatatcttttaaaaaattaagataaaactgatgataattgaccacatggaattttagggcaatttaatccaagtagttagaagggtccaatacccaagcattagcagaatatccatggcatgttttctattttataaagatctggaaatagttaaggtggctacttttagaaatatattgcatttccatctggtctaaatcaataaaattaaactttatgctgtgtgagatggagattccagatttagagactgttatataatgttcttagaatcttcatttagtattatttgagaaacttatctagttatcaggacacaggtgatatggtatacataattttttatgagaaaaaatgaatttttttgtgatttggacatattgattttgagccttccctgtatagatgttctttatcaagtgaagtttatgttttagtataaattttttttcatcatgacaagatgatttagtacaatttataaactaatattgatcattgtgtaccagggattgtgtgctagaactataacataccctttgtgtatgttatatcacctaatcctcactgaaccagtatggggactggagcaatggctcagtaattaagagtatggactgttattcacaggacctcaattctagtcccagaacccacattaggcagcacacaactgcctgtaactccagcttcaggggatcatacacccttttctgcactctgatcatgcaatcaagtatggaaacccatatatatatatatataaatgtttgtgtgtgtataatttaaaaataaaagtaaaaaaaatcattttgatgtaggtgttatattccagttttatagaagagaaagatgaggttcaaaatatgtaacttccaagattataaaacaattcaatagcagatttagaattctgacccagggtcttactgatatcctgtttttaaagaacttcatcattagtattactattaacatctttgctcataccactgttacctaatgatagttctagcatacagattgttaaaggcattgttagaaagaaaatacagtgtgcttttatacccagaagattaccagggggagtaagtaattaaagattacatgtcagataagactttagtgaaagtttaacagccaccaggtggtcttaagagaaaagagatgtttttaaagctaagcagaaacagaaaataaaaagggactgtggtttagaattgtaagaattggtagtgggaggctagttgctaggtgcctgtaggatcctagtttgattataaatagaggttatcattcctattttcagataaagagtttaaagcttaataattggcttaaggggacgagctgtgtattcatagttatcctccaggttgacctgcattttactataccctattttcccctcccaagtaggattctggtagcactgtccttgcgactaacttattttcctcttagctttttttattacttgcttctttttcagtggattacaggaagaactatttcttcagcctgtaaaacttttcactggagagtagtatgtggttcttcaggctgtacttaatctgtctggagtcagtgaaggagaggattaaatatctttgaaactgtttcatgtcctaattaacatgtttcctgtcacgtttgctttatcaaatgagggtggcactcattgtcacatagtgatcccaagttccattgggtagctatgtatttttttattgataaaatccaaaaactggccaatttacccatgagattaaactttcaaaaatgagatacttttgggcaactgggagcaaaagaggcttcagtgagaaaagttcttatagttgatgttttgggggattggtgaatcttgttagattgatagattctgcttcttcccttccattaactaccctttaatcacagctatcacacacacaaaaatgagtaaataaatatctaaatacttgactttgcactccaaatcctttcactatggttgtttggtacatcaaagcagtcttttttttttcctcattaagagtagaccctataagtcagctactaaatatttcactaatggaattaacttattagtgttccaaaatatcaagtgccccagaaacattctgtcataaaatggtaaatggaaaagaatgatcctgtgttcccccttctccccacttccttccttcattcagctgctcttacttctcccgtccctcctatgcccctcctttatctgataatctttcttattctccattgtgttttcctttcctcctgctttccctcttttcctctttgtttacattagaaccgctgctcctttatgcgaacactaagtagcagtcatgtttgttcaggttgccatggaaatattgcaagtaggcctttacacaaactggcttgctctattaatgaatcacacctagaacttctaaggctaataatataggaaaaaaaattctacatagaaattaggtctcagaactcaagtccaattattttctccttcagatagagtttttatccattgtatcattttagagatacatgtatgactttattaataagctatttctttagacttttatttcttttcaccacagaacagtgacttccagtatttttcatttcagagtacacggggaatttacaaattgaaatcttggtttggggtagaaataaaaatgttttagagtagaaggagagagacttgttgactctctcaaaggcatgaaggtaagcagcagcagaggcctcttttgtttggggtgtgtgtgtgtgtgtgtgtgtgtgtgtgtgtgtgtgtgtgtgtgtgtaaagacttcccaacccctgtctctagaataagaagaaagcagttgaaggagggcttcagcctctgagggataaaaagtgggcatagggaagagacaaaggaaatactggatactgtgagggagatagtgtgagaaggaaaataatatgcccaactgtggcctcagaaaggcccaagtatcatttacaagtctgttactctagctctatgataaacagctgcttcctcctttctccaaataggctttgaggttttgtttttgttgttgtggtggtggtggtttaaatcacttgagatactgttgtaagtagatccaatctcttccttcctagaggttagcttagttctggggccggtgggggggggggggaggtaacaactttcaaagacagcaaaaggaatgtaagatgaagaaaaacataggatagtgataacaaaaggaaattaaaatgggaagacaaactctttgataagataatacgcaaagtgagacttagatttgttcacatttagaacccttgagaaagactgattcagatagagaaaaaggcaagttcaaaaggcaagtactattatactgatagtagaaaaacttccagcctttattaggaaccaagagtaagtgaataagtgaagactgggaagaagtgacagaacccagatcatgttgattaagatttataggccataataagggatgagtattttattctagatatagcaggaaaaaatggaggatgagtctttaacaagatgatgttgtacagaatggataatggatagaaggaggtcaaaagtaaaagcagacagactaattaggaagctgttgcttttattcaagactgagatgatggcttaaatcagataacaaaggagatagaagcaggaggactttgttgataatttaaaggtagttaacaggaattgctgagggaataaatgtggtgatttaaagatttctttttaaactttggtaactgggtagcttgaaatagaatgtgggaagagtgctccttggattagaaggaagggcagtggtttggaaaaataaaagcccacatgagactggcagagctctgaaattgataggctgacaacagtcagttcagtagctgccaaatgcaagagaagtagcatcctggaacagacaaaagttaggacagttgctcagctggcttaactcttgttgttctgtagcagttagaggtgcagaagaaatcctctctggaaaagaagaggaggaataaaacgggtgttctaggattggggtcagaagggtttgattttcttggcaccttcattgtgactcaaataattagtcttccccgcctccctcaaaaccataggatgcatattaagcctgtagtggaaaagttttggaagtgaaatccccatttttctgtttctaaagtgaggattgatgagataaaaagaatgagtgaaagaggactgcactgttcttcccaaccctgggacttttgagagttttcttattaagactcaaagggccctgtggtgcagtatgttatacgtagtcatcatgtaaacaaacttcttagtcatcatgtaaacaaacttaggatgtttgccacctgtctgtttgttttgaaagaactacaacatcaatagtttacattttttagaagaaagcaaggcatctttaggataattgctaaaacagccctcataatttattttcttctttgggaggatggcataacataattgctaaaaccatgactcttgatctatctgtggtctaatctctgctctaccaaataagcttttcttatctgtgaaatgaagctaacagaatctccctcctaaggattttgtgctaatgaaatatgttgacatttacaaccttcttagagcagtatctatgtgtttgttttaaaaggtttttttttaaagtatttagatgggaagctaatcaaaaaatatgactgacccagaattcaggttcactgggttaggtcagtcagcaagccaggcattgaacacgggtttagaaaaagctctagagtaggactggtatgcttactatgcagtgccctggtttcaggctgggagttgataggatttagagagactcttgagttccaggcacaggtgaagaatccccagattctctcagtgtactaaattatatacagatagttaaattacttcctggtgacataaaattcaataggatattatttcttaaaaacactatttttccaaaggtaggtgtgactctcactgtgtccttatggaaactattccttaccaaggtttctttttttgtcaggaaaagtcagatatcaggaggagagtggttcaaaagaattgatgaagtttgaaaaatctttgtcttgctttatctttgtcataaaagtaaccctgtactcttctgatcacataatgtatattgtttccttcataaatgaggacatttcttttatctccttatattattacaaataccccatccaaaagatttataattggagtctttatatattagatgaactaccaagtggtgtgttatgagcatcagattgcaaaaggcagcatctcttgatggatcaagatagtagttataagtggctgttttatcctaccccatctgtgcagtacagcagaaataaggccttttttaaagttataggactgtataggtttgtagtggtctcatatatcttcctccctctatgcttacctctaacatttctagaaagatgacttatttttaaagggcctttgagaattaaatttcataaccctccttctaagtcatttcggtgttgagaactttcacagtcaagacattttgccttttattcaagtgaaatctcattacaaagatatcgttcctctttcttcaggtgctttatagggaaggtgctttgttgcactgagtacaatgggctacattactacaagcaagcctattcaagcaggcttttttccttgccctaattctgtatcagctagtttacaagacatatatctaagtgtgtgtgtgtgtgtgtgtgtgtgttgtgagaggaaaaggaataaaaggtatgggggatgtataagcagtttgttttataatgtttattctttactgctaggctatgatcacatgctgatgtatcattgacattgacctctcttgctttgggagcccatggatccgtaatataatttctagaactacaataatttaaaaaattatcttcaggcttagtgtgtctctaatcccgatgcttggaaagctgaggcagaaagatcacttcaaaggaagcctgcacattacacagagtgcctcacaacatcagacaaaataacaaaagacaaagcttctaccgtatagtgctaatcatccaggcagaatatgcccaccgatgtaataatatcatgaatgtttggagagtaacaaaacacattatgattatatgtgaagaccactccacaagaggtgatatatgcctgattctgtaaacctctgtgaaaaacttatggctgcagatttcaaaggcattaagggagaaattactactaatactttgtgatgtacacatagagtcaaagttctcgctaatcaggtactgttttcagtctaagaggaacctcaggcctgtgtattagtgccgtgctcaaccttgatcagagaagtttctttttgcagaaagcagaagtaagtacagaaactcataatttaccaatacactgagaaaaggtgactattttctctcttaaatagaatatctatgtcatgtcttctaaaatccaagaaacacttcagaaaaggggcagaaggattgtaagagctgaaggacagaaagggagcttggaaatggggttttctggatatgacatgtctatttcaatcataagcacacaacagctatgcctatctgcacaaaatctttgtgtgcaagttcatgagtacatataccccaaagtagaaggggagaaagggactcaagtgggagtggaagttgataaaaataatggggtgaatattgaatatattcatgatacattgtatacatttatgaaactggcatacatgcttaaaatgaaaaaggggaaacaatggacccttatgctggctacttacttttaagaggctgacaaaaacatgttatttaaaaccctttcatccgaggttccataacataatggttagcactgtagactctgaagcctttatgtatatttggaaagcaaacaagcaagcaagcaacaacaaacctgtgtgacatgaactgatagtggcacaagttcaaaccaggaaaaaccccattgtggaacaggaggtgtctatatattccaaaccctagctgagaagtgtttggcaattaatagttgctggggaggcgagaggaagttttcttcaatgacgtagccactagaaagctccccatgctgtagtagttggcaggtttgatcagaacgcattagataactgtacgaaaacatttctccaacattaaaaattacctgtgtgaaggaaaaaaagaaataactgataaaaatgaaggctgacaaaggatatatcaattagtgataatagttatctctatgtaacaattccatgtgtctttctcaatatttgaaatcttctggtccttttgattttcacttttttttttcagaatgtagcccatgaaaacttcagagtagatgttgttggctaagaaggattctcaagctgtatttctttaggagttaaagtgagtgctacatataatcagataattagtggacatgctgacccaccatggttgatgaaatgtgatacttcacagttcatatctgcttagataacttaactccaagattgactattagttaaaaatctctctttttaagctaatactgatcgcatgatcctgagtactcaatattaaatcatcttaagccagcgtatttcttttaggaggtaaagggtatcatctggtaggcattaaggctctaatgtagtccatatttctttctttataactaaaaatattctaacttcatctcagcagatactatgatagctgctcagcagcaacatgttcagatttaactctgccctgaggggtactgtaaagcattgtgaacagaaaactaaactttcataatgaagccattgtggatagtgtgtcaaaatgtcattttaataatccatattttaatcatactgacttcacctgtcagatcctattttagttcctattagccatgcacttctgagaggctcggtaagaggcagtggtgatagaatctacacctgtcctaatttgtttgctttgccaggtattgctgggagagtgggtttaacatacattgtataaagatctccatctgggctcagtctctgaatggaatatgttctttatgtgggtacagataggaacttgtcagcatcttttgggtatggagtcatcattttcaagtgatttgtctgtgtttttattgtatatcactcagaagtagagtttatattgaagtttatacgaaatgctctagtggtgtagacagaaaaggaaaaaggagctggcacttccaatgtccttagaaagaacaagttgaacaatcagaatttatagataatcattgtgtgcttgcttttctctctgatactgctctcatttgaacgtttttctttaactgttacttggctcagggaacaatatttgcagatagaaaactttttaaatgcactttaaaaattatctttaatctttttctacagtctaattgttatcctcctcctggtacgccttccaacagttacttcttcatcccatcccccctgccccatctccaagaggatatgcccacttccaggccttcccactccctggggcctcaagtctctggagggttaggcgcatcttctctgactaaacccagacccagcagtcctctgctgtatatgtgttggggacctcatatcagttggtgtatgctgcctggttggtaatccagtgtctgagagatctcaggggtccagattaattgagattcctatgggattaccctcctcctcagcttcttccagcttttccctaattcatccacaggggtccctgacttctgtccattggttggttgtaagtatctgcacctgactctctcagctgcttattgggccactcagagggcagccatgttaggctcctatctataagtacactatagcatcagtaatattttcagactttggagcctccccttgagatggatcacaatttgggcctgtcactggacctcctttccctcagtctcttctccatttttgtccctgtagtacttttagacagggacaattctgggtcagagtctttttctgtgggatagcaacaccctccctccaattgatgccctgtctttctactggaggtgggctctacaagttccctctccccactgttgggcattttatctaaggtccctccctttgagtcctgagagtctctcacctcccaggtctctggtccattctagaggatccctccacgcatctcctgaggttgcctttttctattcattcttctggccctctgggcttctctcctgtctcccccaccatacctgatcatgttcccctcttcccctccctgtttcctattccctttccctttcccacccaggtctctccctccctgcgtcccctgtgattgctttcttctccctcccaagtgggattgagccatcctcacttgggtccttcagcttgttaaccttcttgagtgctgcagattttatcctggtattttgtaccttttggctaatattacacttatgagtgagtatacacaatgcatatccttttggggctgagttacctcactcagaatgatatttacttgttccatccatttgcctacaaaactcaggatgtcctcattcttaatagctgagtagtattccattgtgtaaatgaaccacattttctgtatccattctttcattgtggctatcacaaatagagaaactatatacatagtggaacacgtgcccctgtagcatggtggggcatcttttgagtatatacccaagaatggtatagctgggtcttcaggtagatctatttccaacgttctgaggaatctccagactgacttccagggtggttgtaccagtttgcaatcccaccagcaatggagaaaattgataaattggacctcatgaaactgaaattgttctgtaaggcaaaggacatatcaatagaacaaataagctacctacagattgggaaaaatatcttcactaaccccatattggatagagggctaatattcaaaatacataaagaactcaagaagctaaccttaaaaaaccaaacaacccactttaaaaaaaaatggggtattgaactaaacagagaattcacaactgagaaatcttgactagccaagaagcacttaaagaaatgttcagagtccttagtcattagggaaatgcaaatcaaaacgaccctgagatgattaagttgcacttgtttaactgtaaatctagatgggcaagtttgctttaaaaaaaaagataagaaaaaaaaaacaaaaatcacatagtgatcacatccttttctttccatatggacacttgtgaaaccagttgctgccgtgttggagtttatggatcacacttgaatcctggatccacataagaatatatgacctgtctcatccagttagcttctaattcattttggtgtttaaaattactgtgagtctctaaatgtttagattcatggcagattgggttttattattcagcaactatctgtatcttaaggttttctttgttctggggaaatcagtggctttacttttaaaaagcagaattgtttcccggtagagcagtgtaactgatgatagctaggatatgttcaatcccaagtggaaccaggttgattttctataaaactggaggaaaaagttcatctgtagataagcttgaaggaaaatggcttgtgttttacctttagaggagcatcttgaagggtatttaatttgatattcttatctataagaaatgcggcaggatgaagcatgtacactcagatgtgtagctgataacactcgtgaaaactggaagttccattttttaacttttaaaaatatgcaagaagggcccaaaataatgcagggaaagaaaaatgataccaaactgaagtcacaggactcaacatataattctggtgaaactcaggaagaaccgtattagtgatagtctagaatatgcacagtgctttacaataggttgattgcactaaacaaaggagaaaatcctttctctgaagagcttacaatctaaagatgcaagttagttacaatgtggaatgagaacaataagagatccccatggtgggtggccttcatagatgaaatacttaaaaataaggtgagggttagagagagttgaagggaaatagaagcttctttgagactggtgaatagggataaggaaatgaagattggacaatgtgtctgaaaagaggctcagcataagaatgggcaaagagatgagactgatgacattacagcgcttggagatttagtgaacaagagaaaaaatgccagcagaggagaattgagacattctataaacattctataataaggctctgaattacagagaataccacagctttaaagacacagattccgagaatgcagcttgcaacagctttcttgccacagtgttggcttcgatagcagaagaaggaagagtgtagcaggcttgaaacaattcagtgagattctatatgtgcttcataagcagtaaagcagtacagatgtacatacagtcatcatattttgcttaactttgattttattaaaattttggttagcataatattttaagtcaaatgattatcagtagaatgttccattacagagatgttatgaggaatttatctgattataaatgtttcatttgtttccatgtttttacaagctcattgcaaattctcctcatgagtgtcacagagcttagcctttctttgaacatacatacatcttcatgtcagtgaaattctcatcgccatcatccctgccctctcacttgcttccagcctcatctatacctttgcatttatatgtcatgcatttcctttgatgtaacaatattgttttatattatgcctaatttcaataaggctttcagtgcatttactgtatatatatataaagcttaagccgggcatggtggcacacacctttaatcccagcactcagaagccagaggcagacagatttctgagttccaggccaggctggtctacaaagtgagttccaggacagccagggctatacagagaaaccctgtcttaaaaaaataaacaaaaaacagaaacaacaagaaaaacaaacaaacaaacaaaaagcttaacacattgacaaagaaatgagcctgttagaaaaatatatgtaagttaaaggggaatcagataaggttagtacaataaatacataaacttaaggattttatagttatgctctgacataggtgccatgcttctcaccagactcaaaaaaaaacaaaaacaaaaacaaaaacggatgagttaataaaagggtttgcaggtgtcaataagctgagaagcacagctttttaaaatttgtgagaaatttctgtctgtctctcctccccaatctctctctcctatgtgtatgtttctctctctttctgtctgtctgtctgtctctctctctctctctctctctctctctctctctctctctctctctctctctctctctgtgtgtgtgtgtgtgtgtgtgtgtgtgtgtgtgtgcataaatataacctacaaagtccatataatgttacttctgtttgttttcagggctgaccatttgctactggacaatcaattggagtctctggggaaaaacacctctcctgctttcagctttcctcagttgcctgctgtgagtgtgtgtgtgtgtgtgtgtgtgtgtgtgtgtgtgtgtgtatagtgttgaggcctcatgagctctttctaccatccactctgacatgccatccacatgacatatgtgtcatctatgttcagcttatattgaggcagtcatgttaatgagtctttatgaatgtggcctctgattttactaggagattcattctcatagcgaactctccagtcctatggctcttatgatcttcctgccttcctcttctataatgtccccggagccataaagttcagagtgttttgtatccattgggactgggctccacaactctgcattttgattgattgtggttttctgtagtggtctccatctgttgcaaagagaagtttccttgataagggctgaggactacacttatctatggctataaagacaaacatttagattgtagttaggaattatgctgatttagtaaagtggtagttttacattctcctccaagttacatgactccataagcactgagtagttggctaagtttccaataccagatgtgatttccctcttgctgagcaggtcttaagcccacatagagagctgttggttactggcaaggtatgtgtgctattattgtaaccttagggttatcctgctatgctgtctgttgatgttgatatagttcataggcatcatagctgggtagaactgcgtcctgactctggaagctttcatggcaatttctggtatcatgaaagctagtcctgaggatgaagactttaggtcaattctagctcaggggtctctgggccctgcttctgaagtgtgtggtgtcttcagcaatagagacttaccttccacctctggcaggcaaccaagggcaactcctagacaacaattcaaaagaggacttttcatgtctgttattagagttttggttaattggtctttggctcttgggggagcattctcagtacagataagaaaagctcattaggtaagtagtcagtagtttgtttccttatggctttttcagaaaccctcatctaccacccatcactaaagaaccctatcctgtcataattccctgatcatatcacttgtaccctagtattcccttctgcattgctccccaaacctgggaaacactcctattttatgttacttgatttctgttgttacttaaggtatagcctcacatgtgaacatttggagctaggatcttttaaagagtcttttggatctggattacttcattacaatgatctctagttgtatctatttacctgcaaagctaattatttcatttttctttgtgctgaatattatttcatagtgcatatgtaccacattttattaattggaggacatttagttgtttctatttcctagaaattgtgaataaagcttcactgaatatgtctgagaaagtatctatagagtaggatgtcagtcctctgggcaaatactgaggagtgctatacttgggtcatattgtacatttatttttatctttctgaaggtttttcacacttattaccagaatggctacaccagtttatcatcccaccaactgtggatgagggttccctttcccccaaatctctccagcatttattgttattattttgttgatcttttcctttctgactagagtaaaattaaatctcaaaattgacttccttttgcattttcttaattgctaggaaccatggacattttttgagatacttcttagccatctttgtcctttatagaactttttgttcaggtctcaggcccatttttcaaatgagtcatttcgagtctttattctttgtttcttgaactctttatagattctagatattgctcctctgtcagatgcatggctggcaaagattctctcccatcctgtgaggtttcctctttacccagttgactgtttatttagctctgcagagcctttaattgtcatgaggccctacgtgtcacttgttggtcttaattcttggggaaatggagtcctatttagaagtcatttcttcacctatattgtttaagtactgcctttattctcttctagtagtttcagtgtttcaggtttcacattgaggtatttgatcaagttagagttagtttttgtgtaaggtgatataggtttagtttcattcgtctatatgtggacatccatttttagcaccatttgttgaaagtccatttttcctccagtgtatgtttttggcatcctcaacaaatattaaatggctggatttacatatattaaaactttggtcttcaattttgttccattggtctctatgtctgatttttgtacctgtaccatattgtttttattactatggctctgtaatatattaagattttatttcttccaatgttgttcttttttccagtcttattattttgtctgttttgggtcttttgtgcttccatataaattttaagagtttttttctatttctgtgaaaaataggatcagattttgattgagagcacattgaatctgtaaatagttttttagtaaaacggtcattttcataatattaattatcaatctgtcagcatgggatatctttccattttctagtgtttttctctatttcttcagaattttaaagttttattgtagagttacttcactttcttgtttaggtttatttctggatactgtgttttctttgagggtttattgtaaaagggaatttattcatgttttccttctctgtatgtttgttgtgattctatagaaaatatgttggtttgtgtaagttgattctatatgcttccataatgctgaatttgtttattatttctaggtattttccagtacactatccagtaggatgtctaatgtataatgtcatctgcacatagagatagtttgatttcttattttcctatttgcatccttttagtttccttctcttgccttaccactctagctattgctacaagtatattaaaatggagtgtggatgttgaacatctcgttctcattcctgagttcagtaagattgctttttttttccatttagtgtaatgttgtctgtgggcttctctatatatagcttttattatgctgaggactgttctctctattccttcattctctagaacttttatcatgaaggcatgctggattttatcaaaggctttttctacatctattgacatgaacatgtgatttttatatttagattgatttatgtggtttacttagtctatggaattgcacatgttgaagcatcctgcttttgagggataaagtaaatttgtcatagtgtatactcttgatacatgtttgtattctatttgtaagcattttttcagtatttttgaatgtaggtttatcagagatgttggcctacagttttctttttgttgtgtctttacctgtaactggatattagagttgttagcattctgtcctagctctaccacacagttacctggcaacaaccaggtatgctcctccccacagttacctggcaacagccaggtaggcctgactcactataaaaggaactgcctgaagtctcctctctcttgcccctctctcttgcctcttgctctcttgctccctctctctccccattctctccccccctccatgtggtcatggctatggctggcctctacttctctactctctccccctctctgcctttctctgtctctactatcctcttaactctcctccccatgttttgaataaactctattctagactataccattgttgtatggctggtcccttgggggcgggggagagatgctttggcatgggtctgctgagacattctcttcccccatacctcaccaccacctcccagagaacatattcttatatctctttatcttcttataaacacatcaagagtgatcctgtctccatgaaaggattttccttccttccttccttccttccttccttccttccttccttccttccttccttccttccttcctctctctctctctctctctctctctctctctctctctctctctcttttccatcctccttctcctgctcctcctcctcttcctcctccttctccttctttgttgttgagacaaggtctcatgatgtagcactggctgttctggaacttgatctgtattaaaggtacacactattttggggtattttcttcttttcttcttttttatgttttgcttttgaatagtttaagaaatggttggagatctactttgaatgtcttatagaattctgctaagaatccatcttatcctgggatttcttttttttttttttttttttttttttttagctgaaagccttttaattactatttcaaactcatcatttgttattagttaatttaggctgttgacttcttcttggtttaattttggtggtttggctgaatttaaaaatccatccatttctattaaggttttctttctatgccattgacctagaattcttctccctcatctacacctataattcttattttttggttttttattcatggcatctcatattttctgtgtgttcctttatttttatttttatatattccttgcttattatttggtctagatcatctactttatctttgagttctgatattctattttctgcttgattagttctacttgtaaggctttcctttagttcttagttgagttattggatttttcaattttattttcatttcagcttgagtcctcttcatttatatcttttgactgaattctgttctcaagtgatgtattgtcttcatcagcctatgtttctgttttttggtcattgttcagtagtttgttctctttgagctctttcttcttaatttcatggagctgtttctttgtgtcttcattaaactctcccaattcttgttagagttcatacttgttctcttaaattctgtgtcctggagtccatctaggtaattctcattatcaaacatttctacacaacttttaaatttcagacagaagatactggcttgatctatcatattcttggtatttttgcaatgatatctgggaatgtggacttttactgttagttctgggtctgatatggacagagtaaattggggaagaagacaatttgtgtaagtggtttgggtctcaaggtgtggaatgaagtcacagcaatactgggacaggactgctctacagaatatgcttcctatgccaagcctagagtgtaagggtagacctgtctaggtgcaaaaggttggctatgtcatggaagaatactgtgggttagagtatagctagggaggatcctagccaaagcctagtgttccttccctgtgcaggcaggagaggtcaggctaagctgatgcatttgttgtgggacccaggctagatttggtgggttgtggaaaaggcatggatgaattggaaggtcaaggggactcactggaccttgatggggatatgggaagtttgcataatgagtgggctggttggaagctgtgcagaagggacttttgggtggttgcagtaagacgggtcctagtataaccctgaagttgtttgagcaacaggcatagaaggtcagactagactggagcatgtgatgtgggaccctacgaaagcctagaggctcactaaagtgcaagaggggtactcctgaaaggcagactgaggctgaaagagactagacggggagagaaataaagacaccaagacaaaagtactctgttcaaggcaccttaaagtttacttagtgtctaagcttatatagggggtaggcccatcccccgccagtccatccaggcacctgtagaaagctacactgcaggtggccccacttcagttgcgacaaggtctgcacaagcccgcttcaggctgggggaggctacaattcctccctaagtatataataaaaatagctggaccaagacataaaatttatttatgctccatagtcctgcctgggagttatggtagctggtggccatgcctggcttgggaaatctcagatttttccgaactattcttatctgtcaaggagtatatatgcagcttgtttgtgtttattttacacaaacatggctctgtggtgtattattaacaaaccacggcctcttggcataacccttagattgatatagttccgaaatctggttgccagtcattggctgaccagccctcatagcacaccttattcccaaatcagaccaaagccacaatatatacttaaaatgcttcttcatattgacgaatttctgccacctgcgcttgctggaggtgaggctgcacacttgctgaaatcaggctgtaaggagagacttacgtgcttgaaaaacaaagtagaaacaattgaaaaacaacaggataatagcttctttggggatgtccaggtactttattcagttgcaaattagcaacgatcaagctcagactctgacctcctagtgtgggggagctggctttgagaattaacagaaagactgtaaattctctggaagtggaggttatattccaaattaactcttctggccaaaaagaatttttagccatcatcgaggttagaatcatacttactagaagattcgggatctgtgaccacttgacaaaccaatctttcaggcagccatcgcgcttcatcttctttttgtgaataaacacagtccgaacatcttccccagattaaaacggggtctggaccattccacgcattagttaatgggtcccgccaattaaccatggcataagaactggaagtaactggatgccagtggtgattcctgcagactgacctttaacatcagtttgcaaaaaaatttaaaacgaacaagacaaaagcaagatgtgcttttggtgaccttgggggggggtataactgcccctcttttgtttttaaaagccaatttttcagagtgcaatgagcacgtttaacaattccttgtcccatggggttataaggaattccagttttatgtttgataccaaattccttacaaaataaagtaaaattgttgccagtataagatggcccattatctgtcttaatgagtttaggcaatcccatagcattgaaggcttgtaaacaatgatcaattacatttctagaggcctctcctgtatgtagagaggcaaaaagaaatcctgaacaagtgtcaatacaaacatgtatatattttaattttccaaattctgcataatgagttacatccatttgccaaatatgattaggcataagaccttgtggattaactcctaaatgcagcactggagataatgtaatacatttaggacattgttttacagtcattcttgcctgttctttagtgatcttgtgttggagctttaaggtatggctggagagatgaaatttatcatgatcacgactagccaaaacaacaggatctggaattaaggcctctcctattagagctctgttgatgcaatcattgcctgcagctaaaggtccaggaagaccagagtgagctcatatatgaccaatataatatggatgttttcaggcaagaatgatgttttgcaattgtgaaaacagagatcctactggcatattaaagttaaacatgccacaagtctccaataagggaatcgattgtgcaccatataaactatcagtaaaaatattaaaagtatcatgtacagactgaaaaacattcagtactgctgtcagttctgctaactgagctgagaggctcaggagtctctatgactacttgttgattattcataagatatccagctcatcctttagaggagccatcagtaaaaatcaaaggagcatcatacaaaggctgtaaagaagtcatattaggaaatatcacctcatgtacatttaaaaattttatcaacctatcttgaggatagtgattatctataattcctataaatcctatttgagcaagcaaccaatccgtactgtgctgattcagccaactatcttgatccatactataagactgaacaatgatatctggctctttgccaaaataagttagtgcctacttccatccaagtatgatcatctgagctactgcttcataatatcctcaaatgtatccatgttagaggagccctttgccacaacaatcctgtaggcatatgaatcatattaaaaattaacagatgtaaaggcaaagagtaatctatataagtgacaaattgttcttcaatagctctttctacttgttgtaaggccagcaatccttctgaggttaaagatctaggggaggtaggatcagaactccctttaagaatatcaaataaaggtttcaattcccctgtagtaagctttaaataggggtgaagccaattaatatcacctaacaatttttgaaaatcatttaaagtttttaagttgtccctgcgaataactatcttctgggggaaaacagcttgatttgtaagtctaaaccccaaataattataaggatcctgagtttgtatcttctcaggagctatttatagtcctttatcagctaaggccttttgtaaatctgtataacacaaaagcaaatcctgggggtcttttcctgccatcaaaacatcatctgtataatgaattatttaaatcataggccattgttgtctcacaggctgaatggcttgtgccacaaacttttgacataaggtaggactattagcaatgccctgtgggagaactgtccattgatatctcttcataggttctttaaaatttatagaaggaatactaaaagcaaatctttcacaatcctcaggatgcaaaggaatagtaaagaaacagtgcttcagatctaccacaattttataatatccttttaggaattgctatcagagacggaagcccaggttgtaaagctcccattggtaccatggtttctttaacctttcttagatcttgtaacaatctccatttaccagattttttcttgataaaaaaaaattggagtattccaaggagactgagattctgctaaatgtcttgcctctagttgctcctgcactagcgaagtggcgacttctattttcgctttaggtaaagaccgctggtaaatcaacccacaccagaatatcattaagccattgaattttatcagcatgggatgcaggcaagatagtagccattactgaaaataccccaaacctcttgtgttagagtgggttttaggaccttcaaaagtcttaataccttgtactttctttcctagctcatgaccaggcaaaaatccttgtctgagcatctgcttgggtgtttttacaaagcttctccaactctctcccaggttctgctagctaaagttttttcttccctgaaccatgggcaacaagaatctatcttatctgaaatttttttctaacaattgttcttcaaaccctactcctctcgcctgtagcagctcttgaaggctgtggacaactgcctctttggaagtgtctagtcccatatttcgatgccaaccctaagtggaatcagcgccgggttagcactgttccaacttagcccgtatccaatcgcacctccagcaacactttaaaatatgaagtttaaagccagcgctagcataaatacctgttgctcactgtgcccgatatgatattcttgttcttcccttcttgtggagctccacataagacagcagtccctcagctgtaccccgccattttcaggtccgtgttcatggcaccaatctgtagtagtaagctgcccagggcctacatgaactgggtactcctgaaaggcaggctggggctgaaagagactaaatggggagagaaataaagacgccaagacaaaagtactctgttcaaggcaccttaaagtttacttagtgtctaagcttatatagggggtaagcccatgcccaccccaccccaaggtctgcatcagcccgcttcaggctgggggaggctacagggattgtcagactagccctatgcactggttgagagaccagtgctagatctggtgggttgtgggaaaggcataaatggggatttctgagaaactcactaggctagaatatggaagagaaagaacatgggacatttgggtgctaagggggtggctcaagactgtacagaaggggcctgtgagtgattgcaggtagggtgagtagtagcagaaatgcaggtgcggcttcacactaggcagaggcagtgcttttgaaacctgtgctagatatggaaggagcaaaagacatggatcagaaagtcagatggactcactcacctggcttgactttggaaaaagatatgtgaagtcgtgtacagagtgggatagattgaagtggtgcagaacagactggtgggtggttctgctctgagctcttatcattacattttggagcaaatacaacaaagaaaatgggtgtagctcattttttataaggtgctttcacacaactcactcattttgtctttgtgtaactcctacatgaaaagtagtagtaagcacattttacaatttaataaacctggggcttagatgaactaatctatgtaatatgatataactgataagttctttgctttcttccatatgaaaccatatggtaaagcagtgctttaccatagagctctttgtgtaatattactggaagactaaattgggacaagttaacagtattgttatcgttatggtttttttgtttctactttgctttatacaattgttgaactgggatcttttgatatgaatgacactgcttgctcgggcactaaatatcccccagacttatattcttataaattgtcctatcttctttttttatcctttttaaatcactttctctgctctgagctgttactatttgatgtatcttgcagctcccctacttctaatcagtaggtaagtacataggactttcatctgataatacaaaacctaattctctaatgttttcattatttgaatatacatttttgcctgttttctatgttgttagctaattctggatagttgaaggtgctaggtaaattacctccagaagtgagatattcttatatttctttaccacctgtgggcagctccattttgagttcttattgttacattttggaggaaatacaacaaagaaatagagagtaggacatattttttgaagtgcttttatacactgtattattttgtccttgtgaaatttctgcatgggaaatagcactatctacattttacaattttttaaaaaaaatctgagacattgtgattaactgatctatataaacatatctaattaataagtgaagtactcaatacttttgtttatatttattttttgaggcaaagtcttgctatattgttcagacttaacccaaactcacaaactcctggcctctacctcctaagtattgaaattacaggcaaccacacctggcttgactcttactttaaataaaacattactgtggccaagtatatgattcagttggtacacagaaacctaaggatctaagttgagatccccataactcctgtaaaaggcaggagtagtagtgtatgcttgcagtcccagtgcttgggactcatagacaggaagatccctagggctggctgatcagccacttatgctgaatttgtgagcttaaggttcagtaagagactctgtcttaaaaataaattgaggagtgattgaagaacacaccaaccattgacttctggcctgcattcaatctgtgtctgtctgtctgtctctcatattcctgttaccatactctgcaaacaggattctgtgaaattttagaaagctatttattgaaggtttgaagtgactgcccaatgtaccttattccatagtagtacttaatttctttttttttccagtcttttttgcttaccttttgtctccctataagtcttccaaaaatagtcactgaagcttcccatataaccctctctgcctaggtttactcgttaacctcccttccatttttggataagttttgacataaagatgtattggccatctacagggacattgctcttataggtagcactgcacttcatgtaaaatttgtgtctccagctggctgaatagtcttatagtactcagtactgtgtatacataaaattcagatgtgagagttgtaaacatgggcagatacgttgtgtctaaatagaaatggtattttttttaatttttattaattgtgattctcacatcctgcatcccaatcctactaatcaccctgttccttcatatccaccttccgcccttgcaacctcccacctgaagaaaaaacattttgcagcagaagctgtagtgcgtcacacatattgtgtcacacagtatatttgtccactcttctttgcttgcaaatgttcattgcaatgagtcatttgtctggtttaaggtctcttgtttctgctgcattattaatacaggatccccaccagggcttctctcagatatcctgttgttgctttgtgtcagaaagatcaggtagctttcattctgcaaactagcccccgcatgtgctctagcagatcatagatggggtatgtgttgaggtgggccaactcaaggccctggatctgggcttgggtggtagctgagttggtcagcccaccagctctcctgcactggaaccaccatggtcagctctcccatcttatgctattggggtagctctactgtgctgaccaggtagggtgctgggcctgctctctctaaatttactttttaagttatgtgtaaggtgatggacaatttgtggctaatcagtatatgcgttaattcaatggaacttgatgaaaatgagagaaaaggatgcagatttcatcctctgtgaagtatgaaattaacaaaagttgatatcactagctaaaacatttggttttaaaaatgtctcaggaaagattgtattcttcataccaatgagaaggcaaagttcttatttttgtctatataatttaaggtaaaataattacttttactgttacaaattacatatgtgtcacctaatgcaaacaaaaatgggaatgactttggaatttctgtggtctatgaaaaacatggagctgtaatgttactaacttctgcctttgaattgggctttgggaaaatatttttggtttgatgctttttggaactcacaatggaatttaagattcatgagatgattggtaagatacatgtccaaatgcccttgcataaatccatttctggcatgaaaatattttctggaaatagataggacgtccaagccttccagtgatcctggaggtcagtttcctggagtctccttgtattacttacttgtcagtttgctgtgataaaacatcatgcccaaaggcagctcagaaaagagggagtttattttggtttatggttccagaggggtaagtacccatcatgtttgaaaaaactgagagattgcatcttcagccacaagtgggaaatagagcaaacttgaagtgaagctatgaacactcaaagcccttccccaggacatacttcctccagcaagcctgcatcctccttcaaacagtgctaccaaccagggaccaagttttcaaatattagtgcatatggggacacagtttcattcaaaccaccacaccttttttctttagtagttgttatgttttacatgtgaacatgtcagtaaataaattttgggctgacttttcagagagaaatctgttttttttcttttatatctaagtgtccattataggaacatacagttagtaggcattccaatgatcctgatgagatgcttattggtaagtgaaaaggtgttctctgaagggtgaaagtggtctgctctctaaagataatcaaggttaccacttcaaaaatatttcaaagaaactgaagtatcagggcaaaatggtaaattatgaattatgtctctagaatactgcatctgctcctttatgtgacctcaactctagcaatataataaaggtaaatgactaaacatttataaacagcctcacttattgaataaagacaatcagtagcttgatgtgttatgtttggaggtagtgctacagatactttacatggtataatgcttgtgaggtcagcccctgatatttgaaagacatgcaaatttaaccagagcagcacagtttggagttttctttgatgtatccactagctttagtttcctgtagacgatgatgagtgggtatcaagtgtaagctataatataaacaaatgagatgtatacttttgggttttcaattacttttcatctaactgcattgaactttcatttagtgaaccaaattgaccgactggcaactgttgtgagactctgctataataaatcttgattaagcatcagcagatgtaataggtataagagttgagctagacagaaagggtcagatgggtggacatttttgatctgtagagcggataatgagatgatatcaaaatgaaacttccatacctcttcacccttcctctgccattactttattctgagaactgaacttatagatcagtgatccttatttaacttttcttataccataactgctcccatttatgctttgtattaataatgtagcagaaacaagagaccttaaaccagacaaatgactcattgcaatgaacatttgcaagcaaagaagagtggacaaatatactgtgtgacacaacataagcttttaaaaagttatgtctttttggaagttgcttattaatgaatgacataattaaagaaaaacatcaagaatgactttgcttatctttgttttacttgttttttctatgtattctcttatttaacacatcccaaccacagctttccctccattccctctttttagtccttctccaaccttttcttttcccccagatccactgcttctccatttctcttcagaaaagagcaggcctcctagggatatcaacagaacatggcataacaagatgtagtaatactaggcataaaaactgaagaaaatcaacctagtgggagtaaaagagtgagtcccaagagcagggaaaacagtcagagacaaccccagtcccactgttgggagtctcacaagaacaccaagctacacaaccataacatatatgcagaggacctttgcaaagacctatgcaggctctattattgttgctttagaagtctccatgagccctgcttgtttgattctgtgggccatgttttcctggtgtccttgaccctctggcttttctacaatccttcctcccactattgtgagaggttccctgagctctgcatagtgcttggctgtgggtctctgtgctggctccattcagctactggaggaatcctctctggtgattgttggcctgggtactggtctatgaacatagtaaaatatccttaggaattatttcattaattctttttgtcagttgtgtttggttctaccttaggtgtctgagcatggtataggtgtctgagtatggtagtttgaatagatatagccctatagactcatatgtttgaatgattggccatagggagtgacactattaggagatgtggccttgttggattaggtgtggctttattggaggaagtgtgtcactgtgggagcagagtttgaagtctcctatgcttaagctacatccagtatggcatgtagtctcctactgctgcttacaattcaagatgtagaactctccgatcctccagcaccatgtctgtctgttcactgccatacttcttaccatgacaataatggcctaaattctgaaattgtaagccagccccaattagatgttttcctttataagagttgccttggtcatggtgcctcttcatagcaataaaaccctaactaagacactgagctatccagcttccaatttacttgttttgaaaaatactgcctaattttcatcttacctttctttactgacactgtaagaataaatgccttataaaataatcttatacatacttgttataatagaattctcataaatgactgaaacaattttgcttatctgagaaatagtattctttgggtcacatctcaatcattctgacaccctgtcgtctagggtggcatcccgggatatttataatcttctcagtggttaccatgaaattatcaaactaaaattaatttgaagtcactttatgtaaaatgatttagataagatctccaaattaaattgttatacacagagaaccatttaatagttagaaattggtgctttggaacaatggttcttaaactatttcatttctacatgaaataatttattacactccactctatgaacaacagtcatttagaactaaatattgtaaatcatagtctgtcaagattctgggtacttatgttggtgttagaacttttatatgaacaggaaaaaaagacttaagctatcaaacttgctgtttctggccttgatacctcatttgggttatcatgaagaataaagaccctagtagatgatgaacaaattctaatgccatggtcttgaacttccatgctcctagatccatgatgtaaacaaacttgtattctttataaattaccatgtttcatgtattttgttataacagaagaaagcagactaaaacaaacagtacatagttgggggttatcactttctactattatgcttttgtttctagtctaggatgctgctcaggtctatagcatttgtgttagttagggtttctgtcaaaacaccatgaccaaaagcaacttggacaaggaagagtttatttcattttacaactctcatggcacattctcatcactgatggaaatcggggcagaagcctggagggacaagctgatacaggggctgtgaaggagagctgctgcctagcttgctcctcatggctttctctgagtgctttcttatagaacctaggaccaccagcccagggcatccatagtgagctgggcaatcccacattaatcatcaatgaaaaagagcaccccaacttgtacccagtctaattgaggcattttttttttcttggttgaatttgactggtgtggagttgacaaaatgaaaacaaacaagaaaaccctaccagaacagcatcatatccattcttaactatccttcctgtttgttgagtttttccagtgtcttcactttattttttctttatttttaaaattattttaaaatatcttaacataaccttttacttttaaaactctgcagtaaatttcaaaaagtcgaaaggtcggtttctcccagtggttacattttgtatagctacagtataatatcaaagcaggaaactgatactggtacactaattatatatattgtggtagtttgaatgtaattggttccataggcccatcgggaatgacactaataggtgtggccttgttgaggtaggtgtggccttgttgaggtaggtgtggccttgttgaggtaggtgtggccttgctggaggaagtctgtcactgtaggggtgggctttggggtcttatatgctcaagctgcacctggtgtggcagatatcttctttcctattgcctgtatatgaagatatagaactcacagctccttctctaggatcatgcctgcttgcatgctgccgtgcttcccaccatgctaataataaactaaatctctgaaactgtaaggcagcaccaatgaaatgttctccgttataggactcgccatgctggtcatgcttctcttcccaggaatgaaaccctaactaatacatataccttctgccattttatcacatgatatttttatagtcaatcaagacatagaaacatatcaaccacaaaaagctccctcttactacctacattttagggtcaagcccatgccttcccattctttaatattcattaaaaccaatcaacaactaaatcttttttaacactaaaacatggtcactcctagataactattataaatactgcgtgtgtatatatatatattacaaagttcgtttagtgttgtttgtatgtacttgtgtttagggctgatcacttaggattgtttaactataaccatatgttcatgtggtggcatacattgttaattactgtattctgaaggtataggcaggtgaatttctgtgtgttcaagattggcctgaactatatagagaggccctgtcttaggaaaacaaaaccaaaaactaaaactaaaaaaaccttgaataatcataaccattcatgagcttaagggcattttgtctgtttccagtttggctataatgatatgaactattatataaagttcccttacataagcataaatttctctggaattattattcaagagtataagcaattgtggttacattgttttgttttatatgagacttccaaattgtttttcagattatctgtgccattttatagtcccaccaacaatgtgggatcccatcttgccagcatttgatattatcagtaatctttatttcacttacctttactgtctacatgcacacatgcatgtgtaaatacatgtgcctgcacatatatgtctatcacacgtggggaaatcaaaagacaacttttgggagctattttttccttctaccatgcgttcctggaactcaaatcatcaggattatgtcacaagtgctctgagccatcttgctagctattttagtctctcagacctgtaatgatatcccattattgatataagttgcatttatttaacagctaatgaggtggaacatcttttcatatgcgtatttctcttcaatgtatgacgaaatatgttttcatgttgctttcagtccctctctctctctctctctctctctctctctctttccttcttcctttctttttctttctttctttctttctttctttctttctttctttctttctttctctctctctgtctttcttcctctttcactttttctttcttttggtatctatacatgctatatatgtgtataaatgttcttatgtgtgcatatgtgtgtacaattttgtgcgtgtgtgtgcatacatcttgagatcagaagtcaatgtcaaatgttttccttactctccatattgttattaagcaactgatgaaaactgatgcagaggcccacagccaaacactaagtagagtttggggagtcctgtggaagagggggaggaaggattgaaggaaccagagtgttcaaggaaatcacaagaaaacctacagaatcaacagacctgggctaacaagggttcataaagactgaactgccaaccagggagagtatgcatgggacagacctaggccctctgcacatatgtaaaagttgggcagatggatcttcatgtgggactcttgaagtgggagcattggccttctctgactctgttgccttggcaacaatagatgtgtctagttcttctgcatcttgctatgccaaggcaagttgatatctatgggaggcatccccttctctgaggagaagggtaggagggatggatcaggggaaatgagaggagggactgagagggaaggagggaagggaaactgcaactgagatgtaaaataaataaataaaaaatgaatatgggtaaaacaaaagcaaaaccaaaggttccatacatttatagaatgtgtattcatcatatccaccaaccgccacctcccttcagctccctctagtgacaacacactatcttgctcccagcttcatgtcctctttttatttgtttttttaaataattactgctcccttagtccatttggttccacttatatgcacacggagtgtgtgtgtgtgtgtgtgtgtgtgtgtgtgtgtgtgtgtgtatgacattctaccggggcatgaacaactttcaagtagccaaatacccaaagaaaacagactctacatcagcagctatcaacagtcaatgactactctaaaagttatggtgccatagagcccatcctctgtccatgctggaattttttttttttttttttttttttttttggtttttcgagacagggtttctctttatagctctggctgtcctggagctcactttgtagaccaggctggcctcgaactcagaaatccgcctgcctctgcctcccaagtgctgggattaaaggcgcatgctggaattttggcaggccagctcttatgcaggtattgtgcaggaaaccacaattgcttggcacctgcagctctcatatcacgaccagaagtcattatttcacagctctcttctccactcactcactaactcttaagttctttgtgcctcttattctctaagccttgcttggtaggagattgattccctgtccctgcctccccagcattgggataacaggtacacagcactgtacttgtttttttgtctttttacatcaatcctggggagctaaacacaggtatccatgattgtataggcatcactttatcaactgaaccatccaccccacttctttcccttatattttttatttttttattctctctctttcttttctttccattttttcacgttctttctcctcgtccttcctcttcctactctcactaaggttggaacttttataggcatgattactattgacaggctgtcccattgtttatttttttaattatttcttggttgttttatttacttttttgataatcttacatgtttataatacattctagtcaaatgcatccatctgccctgttttatctttatcccacccctacaacttccttgccttcttgtaaccaagtccctatttgaattttttgtctctttgctttgtttttgattttgctttgctcctcactttgttcaatcaagcccaccttagtgggaatggctatgaagctatctcctggagtataaataacttaccaattgactacataactgaagacaatgactttcttcactagtcatcctatactgcagtcatctcccgtagtagggcgatgtagtagggtgaacaaagaccctgtgagccctttgttcatctatgactgaatatttactgaatcagctttgtgcaggccccgtgtaggcaagtgtagctgttagtcatgttgtacccccaaaccactcttcatcaacctaccttatcatcactcagctcttaaattctatatacccaatcttctgtgatttttctcagaactttgcacatagtactgaacgtgaactctgctctgctgaataagccttggatctatacagaatagtcatgccactattgcaccattaagtaactatcatctgcaaaattagtaggacaacatgtaactggggatgactgttactgaccttttagtttttcctccagttgtctgcatgggaacttctaaatacaataaagatgccttagttacttgcttgttgctgtgataaaacaccatgaccaagggtttgtatcggtgtacagttctagagggaaaatagtcagtcaccatcatgggcaagaagcatggcagcaggaacagctgaaaactcatatctctaacctcatgcaaaaaacacaggaagagaaagtggactcaaaatggtgcaaatcttttacctctcaaaacccacccctagtgtcatactttctccagcaaggtcacaaacagacccacgaactggggaccaagtattaaaatgcctgggaatatggagtcatctgctatccaattcaaaccacaatagaggactaaccaacaggaaggaagcctctagctcggttctattacaatttctctgtatttgcatacaaagtatcttcaaaaatagtctcttaccttccaatttttctgggtaaccaatgacaacttgtatagtttttgaggactctgggacctttctgttcaacagctcctaaggaggtgccccacacttggattttctttgaacaacttatgacttctgagatcatcattagccatccaatatatatccatatatatatatatgtagatatatatatgtagatatatatatatggatatatatgtgtgtgtgtgtatatatatatgcatgctttataagctaattataatatatataattatatattataattaacttagaaagtagtcagcttccatgtggtttcattatgaatacttatctttggttagtcttttccatgaactccatcttctcccccttctttcatgcctatccttgtttaaacttgccactggcagtatttctttccaatgtctccatatcatgtgtatactacctttcttacctttcttcaaatctctttcctacttcaccatgacccctttcttgcttccacatctctacaggcataccatgataaccaaatctaaaaaatgcaatgctgtgttccgcatatgagaaaggggacatggcatttgactttctgagcctgagttacctcattcaatataattgttctagttccattcatttttatacaaattctgcttttctttccagctgaataaaaatacattgtatacatgtgccacactttactatttattgacctgttgatagatatgtttgatgattccatttcctacatattatgaatagggcagcaatgaataaagatgtccttgtttttaatagctgagtagcattccattgtgttaatgaatcacattttctgtatctatttttcagttgacgggcatctggatcttatccagcttctggatattacaattaaagttgctatgaacacagtggagcatgtgtctttctgatatgatagaccatctttgggtatatacccaggagtggtatagctgggtctaaaaggagaacttttccaaattttctgagaaacaccaaattgatttcagagtggttgtgcaagtttttatttccacaagcaaagaagtgtcctcctttctccacatcctcaccagcatgtactgtcccttgaacttttgatcgtagtcattctgatgagaattaggtgggatctagagttgttttgatttgcatttacccgatgactaagagaaagtaatcccacattgactcaaagcatattatgttgtaaattatttgtagcatatttcaccaaatttattgcattatctagaaaatatgtctaatttgtctaatttacttgggaaattcatttttaacatgtgatattaaagctacaaaagtttaatataatcactttaaagggtaccaaaatttggaagaagtagtaatagatgatagctatattctatagctatatcaaaatctattctatatagtatagagattatgatttgctcagataactataaaagacaacaaagttaataactacttgctaatcatagatcattaattttgaaacttaatagaagactctggacttaatgggttatattgaggaatatactggttacttttaggaacacatatgtatatattaatacatgtatacatgtaataataataataaaaagagatcatatatttgagggagaatgaggaggtatataaatgagattgtagctaaattgcaatctcaaaaataaaaactaaatgaatagaagactcatagttaactttatttccaagttgaatcaatatatttttaatagaaatgtaagaaaaattctaataggcatagtatataaataggaatggaaatatattaaagtctttaattgttattttacaaaattgttataatatgacaaaaacataaatttgatgacagcaaagcttaatattgtacttgtgtctcaaaattttagatgagcagaaatgtgaatacaatttcaatacacatattcatgcataaaattctaaaagaattaataaaaataattattttaaaaactatatattcgtgaaaagaagtctgaccttgttagttagcagtgtgccttaaaaaatccatactagttaacctgataaaacaaattaatgacttaggtggccattacaaatttagtatataaaaaaattcaagtgtgtgtgtgtgtgtgtgtgtgtgtgtacatgatgtacctatgtacgtgtagttacatatcacagtgtgtatgtggagatcagagcacagctttgtggagctatctttttccacctttatataggttctggggattaaattctggattccagacttgtgcagcaagtagatttactcatcaagcaatcttgttgaccctgttacacagcatttaaattaatttaaaatattttaaatcgttggaaattttgtaagttgattggtgttcccatcaccccactgggggttctgtctggctactgaaagcaatctcttcaggttccatatccccactgttgggcatttcagctaaggtcacctgcattgagtcctcggagcctccccatctcaggtctctggaatttcttagagattccctatacccctcccccagcagctgcctatttccactcattttcctgagcctttcagcttctcttctgtttctccctatacctgattctgcccaaccccattcctctctcctcatgtctcccaccctgatccctccctccctctggttcccatgactattttggttgcccttcttttttttttttttaattaccaactctttttttatttttaaggcattttctattagacattttaagtgggatttatgcatcctcacttggaccttccttcttgtttaactactttgattcttttggggtatatcatgcatatcctgtactttatggctaatatccacttatcagtgagtacataccatgaatgcccttttgggtctgagttaatcactcagaatgatattgctcctgtctaaaagaaatgccgggataaaaatggaccagagactgaaggaatggccaaccagtggtgggccaaacttgggatccatcccatgcatgccatgtatgcacaacaaaccccaacactattgcagatgccaagatgtgcttgcatacaggagcctgctatggctgtcctctgagaggttctgccagctcatactcacagtcaagcattggactgagcctggggaccccaagggaaaagttaggggaaggattgaaggagctgaaggggatttcaaccccataggatgaccaacagtgtcaactaagctggacccctcacagcttccagagactaagccaaaaaccaaggagcatacatgggctggtctgtggccctgaacacatttgtagcagaggactgccttttttggcctcaatgggaaaggatgcaccttatcctgtagagacttgaggccccagagaagagggatgcttagcttagcatttggcagggttgaaaattaccatcagtgggattaatgcatctcacttatttgtttaataagccaatataagattaaaagaagaatgtctttataaatatggacacagtgatctctgactatcatttttactataatcttttaagtggtcttgtcacctttttatgtttcatgtgtatgaccagagccataggccaagacagataatgttaccttatttttgatgttgagtgaattttatgagaattgccaggtacatttggtgttggtgcatgattgtagtcatagcattcaggagactggggcaggggaattttcataagttcagtgtgaccacatgtaacatagcgagactgtttcaagggaaatataaaagtgatatttatggggaaagtattttgtgagattgctttacaaattattaaaattatagttaggaatgacttataaagtatacatttaagttaaaagcaatttaattgaataatattgaaggacttctgaaaagcttttagtcaaatgtacgtgggtactgttagagatgcagtatctgaccacaagctataccttatttatatgtagatcctctttgtatgctttattaccctgataataaaaggcactactctattttgtaacacagtaaatttcctttttcctcaaagttatggagggaccatatttagctgagtttatgaggtttctctattaattcaaaccttttagataatattgacaatgtaagccccccaggctacttttgcttgattgatgaaatattacacgaaacttgaatttactatgatgagactttagaaatactgataagaacaagctctctctgtatagttgtctacattaaacgcttgaatcaacagaaagttagctgtggctacaattaaatgaaatatgtctttgatatttgtttctaatactattgattaagaaaagaaatgactggggcaaaagataatccccaaattcacaaacagtgataaatactgttctcactcttatataactgaaggtttgagagccaaaataccaggaggtattgttcagtattttatcggtcatctgttttgacacttccagcttttatgtgccccttcattttcctctttagagacacttagtgaataaaccttctaaaacttgtagtgagtttactggttggtttttgtcaacttacacaagtcagagtcatctggaaagatagatctcaattgagaacatgccttcttcagattctctgtaaacaaatctatagggcattttcttgattagtgattgacatgggagggcctatcctctgggcagatggtacttagttgtgtaagaaagcaaatttactaagtcatggagagcaagacagtaaacagggtccctccatggtctctgtttctgttcctgccatcaggctctttccttgagttcctatcctgacttcctttgatgactgtacggttgtggtttttgtttgtttgtttgtttgtttttaatcacaactaagatagaaggaaataatgactatatactatggttttcaccaattgcaaggttcattgaatttttatactctgttaagtaaaatactcaccagttcatgcatcccataaattttttggttgtcttttggattacagttaaaataaccttctattgagtctgtatcttgctacatcaattttgttgttttgtcttagaaattgtaaggacaaaccaatgaatgatcctgagccttcagaatgctagaataaaaatgtttactgcaattttaaagcctaaatctctacttcagtgttcggaacattttttttttctttttacaaagggccagagaagaaataaccttcaactgtactgatagtaagcttccatagacaatacagaatagagtgtgtctatgtagtattaaaactgttacccccagagacccctgggactaaaccaccaatcaaagaaaacacatggtggcactcatgactcaagctgcatatgtagcagagaatggcctagtcggtcatcagtgggaggagaggcccttggtcctgtgaaggttctatgccctagtataggggaatgccagtgccaggaagcaggagtgggtaggttatggagcaaggggagcgggggaggataggggattttcagaggggaaactaggaaaggggataacatttgagatgtaaatacagaaaatatctaataaaaaagaaaaagaaaaaatgtgctttctaaaacaggctgcaatatatttcaaaaataagtacagatgtccaacaaacatatgtaaagaagttcagtattactactcatttggaaaatgaaaatgaaagtcacttcacttttaactaaggatgcatacaattaaaaaaactgaaagtagtttttagaaggattcatagaaattggaataaaatatattggcatctttggaatctaaaacttcaagtgtggcagtttgattaagcaaataatcccatgatataaaattttcattcataggtactgccttagttaattttctattgctgtgaagagacactatgaccaaggtaacttacgtgaaggcatttaattgtgggcttgcttacagtttcagagggctagttcaagatcatcacagtggagatcatggcaatggccatttgggcatcttgttggagcagtaacagagcttacattttatctgcaatttagaggcagagaaaacaactgggcttaggcttttaaaaccacaaatccaacttcctatgacatatctcctttagcaatgccacagatcctaatccttcccaaaatagttccaccatcttggaaccaagcattcaaatggtatgatcattagagtatcatttttcattcacaccattgcaggtacatgcccttaaaagctgaaatggctattctttacatacttttataaaaatgttcatagcagtattattcacaatagtcaaagctggaaacgatctaaaagttcactgctgaatgaatagataatcaaattatagcatacccacacaagagcattgtgtggcaaccaaaagaaatgaagaactagtacatattatgacatgggtaaaccttagtactatgccagatgacagaagtcagatgcaaaaggtatgattccatttgtattaaagacccacaataggtaaatccatggagacagcagattcataatttctagggactggtataggatgaggactaagaataaggaatggatgattaataaacacttctttgagaagcgatgaaaatgaattggaattaaatatagatgatgagacggcagaactcctgtcctgttctcttgctttgctctcctcttcagacaatatgagcttcaccaccctctccactaccttctccaccaactaccagtccctgggctctgtgcggactctcagccagtaagtccagcctaccagcagcccagccagtgtctatacaggtgctgggggctccggatctgggatatccctgtcttgctccatctgggatggctctcttggatcttcaggcctcgtgggaatgggctgagagtctcaacggtgctccggactccaacaactccatgcaaactatgaagaggacaactatcagtaaggtcgtggatggtaaaatgatgtccaagaccaattacaccagagttctgaggcactgaggctgagaaggagagagcccctggagactgagggaccaataaaagttgagagctcactggaaaaaggtatagatgatgggtatgcactactgaattactgaagtggacagtttaaagtagttaattccatgttttatgaacttcacctctatacaaaaaatggacagttatgatgattgaccagagtttactgacctctgctctatttggtaagtgagtatcctctatctccttcatttctgaggtttctctgtctctcatatcatgagagctgctagagaatatgcctaaatttgcaggaaaaggtatatggctttaatgcaacccagctaccatgagctggtaaaacatagaacgattctctcagggttttgtcagtacatcatcatcattgttatcatcaacaacaagaacaacaacatcaccatcgataacaataacaacaacaacaacaacatgactatttttgaagcagagtatcactatgtagtccttgttagcctagaaccatgaattcttagagttccatctgtctgccttcaaagtactgggaaagggtcttaaccccataccaaattaaaaaaaatgtttatagaagcagccttgctaagatataatccatacacgcatgcacgcgtacacacacacacacacacacacacacacacacacacacacactagaatctacctatttaagttacatgatttagttacatgatttattttttaaagtcatattctatgaaaggtctaactacttctatatttaactttagaccattttggttgttactatattttagccagtataacaatacacctggggtgttggaaaatgattcagtggtagtacctagatttggatccccagaacctaagttaaagagccaggtgctatggtacatgtttatagtcctagcactggggaggcaaaggtgggaaggttcttgcggttcaccttgcattctatcagtcaagctgaagaaacaacaccagaccaatgagaaacattttcttgtaaaacaagataaatatttcctgagaaacaacactcatttttatcaaactttgccctccacatgcctgcctactcaaatgtgttcacacagacatatgtatacacagaaataatacatctatgaacactcatgtacagatgtttgtgtggacatatgtaatcatttatctctacacctaggggtagaattgctggattatatgacaagtctatgtttaacctaatattatccagtcagcagaaatttgtgaaatttctcatttttttctcaaccttaccagcacacattatttatctgtctgttaataaagatatatttgaaataccacaatattccttcttttacaggttgtctgccactgcttttgcaatacaatcattttggtggttataacaaagatattatattccactataaattacaaagcacccagtagttacttgtagaacttttattgttctactaacttgacttgtgaattaaaagtttgccagctgctgctatacagggattctcattaagttgaagttaattgtgttttttaatgtcttagtgaagtctgataatgaggattcttttttctacattgtttttctttgaatgacactcctaagtggcctgtagtcactttgtgtgtgtgtgtgtggggggggggggaaggcgtatcctagatataaagttttatctatttggtagaaagcctatgatttaaaaagaaaagacaatttgttctcatagtttatcatccaaagcattgacaaagagtacaaatatcaaaagggtaccaataaatgtgctattccagaacttgagttatatagcttggaatatcatagtggagagggtaagattgaattagtaagttaaaaatgaaatgggaagggagtttggcaggtaaagatctgggtataaggcgggtgctaagtcttggaagaagctatagtgctaactttgttcccagaagggcctatagccaagttctatcctgctgtattttccaccaagggagccaaatacaaactggaatggtcagagatatggaaagctgctatcagaacctttcctctttgttgataagaaaaaaggattatatatgaaaatgccactgggatcgagatggtgtaagtgaagaaatagaaaagtgaatcaggcaaaatttgtcatgttcgatctctgaagagctttgattgctattaattgtgttcaggaaacataacattaaatgttccagaagacatacagcagctactaaggaaacttgaacttaatggaagaagaggggttacagagccttgcctagaagttatttttgttttgcgtggtcacacaaatgagtagcctagcaactgaaagcaactgcaaggtacattagtgacgctttgtgtgattatacagtactgcttgttttaagcaggatgtacttcattatggaaggtttttatttctgagacatttgttaattgaaatgtcccagggagagactttgttttgaatatattgaaggaagttacaagtctaagccaaggagcagacaaaatctagtacttgtcttctgtgctgtgagttaactaattaataaaacaaaatggatggagcaggaaagcatcatagtaagtatggtaactcagattcagaaagacaaaacttacatgttctatttcataagtcacccttgtttataaggtgtgtgggggtgggggagagagagagcagggggggagagggacaggggggaagaggagagggagaggagagagagaaagggagagagagagagagagagagagagagagagagagagagagagagagagagagagagaaggggggagtataggaacaaattataaaactagaagggaaaccatgagaagtctaatgagacaatgtgggaacagtgtagggcacatgggacatgaaagaggaagcaatgggtggtagatggaggagtaggtggaggagtggggtcaagagagttgaaaaaaaaaggggagggagaacaacaacaaaaacaaaatttgctttaaaatgcccaaatggaacttaattactgtgtatgttaattcaaacgcttggatataaaaaaatctcttgtgcaaagaaaaatctgttaacacaactaaggacttggaggctgaacttggtaaagctccttctcttcttgtagaaaatgcactaagaccatagcaaagcatccatttccatgcattgttcatgacattaaatgaaaacaccatgttcattgtaatcagactttcactcttatagggataaaatatgatctgtaaaccgggcatggtggcgtacgcctttaatcccagcacttgggaggcagaggcaggcggatttctgagttcaaggccagcctggtctacagagtgagttccaggacagccagggctacacagagaaaccccatctcgaaaaaccaaaaaaaatatatgatcaataaataatatataaggatttatatcattatgtgccataaattatgtccataaaaattaaaaactaatgggactggagatgaattatataggtaaagtggtgaaataaatgtcattcaactaaatgattttctggggagttggaactcatgggatagttttaatgacagaagaaatatttcgtgggctaaagtggtaaatataatctgatcttatttcatgccaaaactaaggtagcagcaaattgaccagataaaaaaatttatgaaattagtatcataaaatgaaggatatcatattccttgaaatataatccaaatgaatgataaaggccagatgtcttcatttcctccacattcactgtcaccattctgttcaaactgttgtctagaagaaagatggcagcagctgcctggacctgcagcagagcatcctggagtttcagagacccaaggaggttccaaggagtgacccgagggcaggagtttgcagggccagcaatagctccagaacaactaaggggaaaaatagacaagtcttatggaaaagtgcttttaaaatgtgaaatcacaaaatcagaaggaaaaatggatgaacagagctggctcagagaatgatgaatttgtacccttcactgccactagtctcagcttcaagaacaaaatatgtttctgatgagcattggtgtataggcaccaaggactgggagatgtgctgccccctggagttcctgcaaaaatccattattgttgaatagggccagcataggtcctaggcacccaacatggaggccctgaagctgcaactccatgcttcctgtcctgctgggacatggaaagtactgagcagcatcactgtacacaggcttcaaaaggtcacgtctggtgagcctcaaggtggcagacattgagggcagggaggtgtgtgactgccagcagctcccacagaacttaccccagcctccatccctccccaaagccccagttattgacaccctgcctagctccaacattatcctggctctgggaaacgaaacaataggatatctgagacaaatctcaacaatggtccaatatttatggtgcaacagaaaccttgatccagaccaccacctcattgcaatgaatatctgcatgcacagctgtctgagacagacagacagacagacatacagagacactgcagtttctaatgctactattatggatgaatatttgatagagaggtgggaaagatagaggactgtagcagtgagcgagtggtggaaaaaggaatgtggtgttgctgagtagggccagcccagtggtgtgcagcagattgaaccttgcaatcttactcagcccccagacatgctgtgcagactcatgatcactctggtccgaagcaatgacaggattccaaggtgaagaacagtacattttctgaattggatctccttgaaatccctctatgatcactgctgcctttggagaccactttagtatctgtggtctgctgctccaggctctattgaagccctagattcaggtagatgtctgtgatcctacagcagctcagagacttgttgatgtctctggcccgacttaccactgaaagctatatggatatccttggtctgggcaaccacctgaggccatcctgatgtctatggactgtacttctacctggatcaatgttgtgagtagcctgggaagccacctgaggccattttgattgatgtctgagtccatcatcctactctatccaggacctgtgttgatgtttgtggcctgtgctaccactaaaggttattcagatgtctgtggtgtatggtaccactggggcaatgtctggatggtcctactgcagcaggggtttgttgatttctgtggatcatgttgccactgaaggctgtgtggatgtccttgctctgtactgcagtctaaacccattaaatggctatgggctatgctgcctccaaggccatgttgatgaaagtagcttggggttgccccttgagaccatgttaaggccttggcctatgttgacacttagggctatggtggtatctgtgacccacagagcagtcacatagagggcatgatgtccatggtctgtagccacaggagaccttttttgttgttgttgttgtttttaaggcatttattattagatattttctttatttacatttcaaatgctaaccccaaagccccctataccctccccctaccctgctccccaacccacccaatcccgcttcctggccctggcattcccctgtactggggcatatgatcttccgaataccaagggcctctcctcccattgacagctgattaggccatcctctgctacatatgcaactagagacacaagctttgcggggggggggggtactggttagttcatattgttgttcctcctatagcattgcagacccctttagctccttgggtactttctctctagctcttccattaggggccctgtgttccatccaatagatgactgtgagcatccacttctgcatttgccaggcactagatagtctcacaagatacagctatgtcagggtcctgtcagcaaaatcttgctggcatatgcaatagtgtctgggtttggtggttgaatatggaatggatccccgggtggggcagtctttggatggtctttccttccatctcagatctgaactttgtctctgtaactccttccatgggtattttgttccccattctaagaaggagcgaagtatccacactttggtcttctttcttcttgagtttcatgtgttttgcaaattgtatcttggatattctaagtttctgggctaatatctacttaacagtgagtgcataccatgtgagttcttttgtgattgggttacctcactcaggatgatatcctccagatgcatccatttgcccaagaatttcatgaattcattgtttttaatagctgagtagtgttccattgtgtaaatgtaccacattttctgtatccattcctctgttcagggacatctgggttctttctagcttctggctattataaataaggctgctatgaacatagtggagcatgtgtcattattacaagttggaacatcttctggatatatgcccaggaatggtattgctggttcttctggtagtactgtgtctaattttctgaggaactgacagacagatttcaggagtggttgtacaagcttgcaatcccaccaacaatggaggagtatccctctttctccacatccttgccagcatctgctgtcacctgaatttttgaccttagccattctgactggtgtgaggtggaatctcagggttgttttgatttacatttccctgatgattaaggatattgaacatttttttcaggtgtttctcagccattcggtattcctcagttgaaaattctttgtttagctttgtaccccatttttaatagggttatttgatccatcttaaaatcagccaccaaaccaagacactattgcatatgccagcaagtttttgatgaagggaccctggtatatctgtctcgtatgaggcaaatacagaagtggatgctcacaatcatctataagatggaacacagggcccccaatggagaatctagagaaagcacccaagtagctgaaggggtctgcaaccctataggtggaacaacaaaatgaactaaccagtactcccagagctcttatctctagttgcataagtagcagaggatggcctagtcggcctacactgggaagagagactccttggtattacaaactttatatgccccaatacaggagaatgccagggccaagatgtgggagtgggtggggaggggagcagggtggaaggatggcatagggaactttcaggatagcatttgaaatgtatataaagaaaatatctaataaaaaataattgatttggaattttgatggggattgcattgaatctgtggattgcttttggcaagatggtcatttttactatatcaatcctgcccatctatgatcatgggagtcctttctatcttctgagatcttcttcaatttctttattcggagatttgaagttcttgtcatatggatctttcacttgcttagagtcacaccaagatatagtattcgtgactattgtgaaaggtgttatttccctaatttctttctcagcctctttatcctttgaatagaggaagaacactgatttgtttgagttaattttatatatagccaacttgttgaagttgtttattatgtttcggagttctctggtggaatttttgggtcacttaagtaaactatcatatcatctgtaaatagtgatattttgacttcttcctttccaatttgtatccatttgaccaccttttgttttctaattgctctgtctagtatttatagtactatattgaactggtagtgagagagtgggagtcttgtctagtccctgattttagtgggattgtttcaagtttctcttcatttaatttggtgttggctattagtttgctttatattgcttttactatgtttagatataggccttgaattcctgatctttccatgactaatatcatgaagaggtgttggattttgtcaaatgcttcctcagcatctaatgaaatgatcatgtgttttttttttcctttgagtttgtttatatagtggattatgattatggattaccatatattgaatcatccctgcatctctaggatgaagcctactcaatcatgatggatgatcattttgatgtgttcttggattcacgttgccagagttttcttgagtatttttgcatcgatattcataagggaaattggtctgaagttctctttctttattgggtctttgtgtagttcaattatcagagtaactgtaggttcatagaatgaattgggtaatgttccttctgtttctattttgtttaacattttgaaaagcattggtattaggtgttctttaaaggtctgatagaactctacaccaaacccatctggtcctgggatttttttggttgggagactattaataactgtttctactctttaggggatatgggactgtttagatggtttatctgatcatcatttaactttggtacttggtatctgtctataaaattgtccatttcatccaggttttccaattttgttgagtataggcttttgtagtaggatctgatccaaaaaggatttcctcaggatctgttgttatgtctcccttttcatttctgattttgttaatttggattctgtctctgtgccctctagttagtctggctaagggtttatctatcttgttgattttctcaaagaaccagttcctggtttggatgattctttgtatagttctttttgtttctacttggttgatttcagccctgagtttgatcattttcttccttctagtcctcttggaactatttgcttctttttgttctagagctttcagttgtactgtcaagctgctcttgcatgctttctccagtttctttttgtaggtactcagagctgtgagttttcctcttagcactgctttcattatgtcccataagtttaggtatgttgtggcttattttcattaaattctaaaaattttctttttttatttcttccttgaccaagttatcattgagtagagtatttctcagcttccacttgtatgtgggatttttattatttctgttgttattgaagaccagccttggtccatcatgcatgagataggatgcatgggattatttcaatcttcttgtatctgttcaggcctgttttgtgaccagttgtatggtcagttttggagaaggtaccatgaggtgctgagaagaaggtatatccttttgttttaggataaaatgttctatagatatctgttaaatctatttgtttcataacttctgtcagtttcactgtgtctccgtttagtttctgtttccaggatctgtccattgatgagagtgggatgttgaagtctcccactattattgcatgcagtgcaatgtgtgctttgagttttactaaagtttcttttatgaatgtgggtgccctagcatttggagcatagatgttcagaattgagacttcatcttggtaaattttacctttgatgagcatgaaatgccctccttgtatttattggcaacttttggtttaaagtcgattttatatgatattagaatggctactccagcttgtttcttgggaccaaattgctttccagccttttactctgaggtagtgtctgtgacatgggtttcctgtatacagcaaaatattgtgtcctgtttacatatccagtctgttagtctatgtctttttattggtgaattgagcccatagatattaaggaaaagtgattgttgttttctgttatttttgttattagagatggagttttatatatatatatatatatatatatatatatatatatatatatatatatgtctatcttccttttggtttgttaaaagtttattttcctgcttttttcccttactgctcttaatattctttctttgttttgtgcatttggtgttttgattattatgtgaagggaagaattacttttatggtccaatctatttggagttctgtaggtttcttgtatattcatgggcatctctttctttaggttaggtaagttttcttctataattttgttgaagatatttactggctgtttaagttgggaatcttcattctcttctatacttattatccttaagtttggttctctcatcatgtcctccttttttgggttatgagctttttgctttttgaattttctttgactgttgtgtcaatgttttctctggtatcttctgtacctgagattctctcttctatcttttgtattctgttggtgatgctcacatctataactcctgatctctttcctaggttttctatctccacagttgtctccctttgtgtttctttattgtttatacttccatttttagatcctggatggttttgttcagttcctttacctgttaagttgtgttttcctgtaattctttaagtgatttttaggtttcctctttaagtgcttctacctgtttacctgtgttctcctgtatttctttaaaagagttattcatgtccttctgaaagacctctatcagcatcatgagatgataattttaaatcccaatcttgcttttctggtgtgttggaatttccaggacttgctattgtgggagatctatgttctgatgatgccctgtagtcttggtttctgttggtaagattcttatgcttgccttttgccatctggttatctctggtgttagttggtcttgctgtctcttccttgagtttgtccctcctgtgggcctgtaagcctgtgtcagcactcctgagtgaccagctctcccctggcaggacctgtgcacagaggggctcctgggtacagctggaggcaggaaggaccctatcccactgcttttggggcctggcctgtgcgctcctggttggtcctgccttagattgtcactggagagaaaatggcaatctcacctccgagtccaggagtcagaacactccctggagatgagctctcccctggcaggacccatgcacagaggactgtggaacagccccagcttctggctgcaatagaggctggaaggaccctgtctcagctgctccactgctcctgcggcctgtgtactcctggctaataagtacagttttataaataaataaatcaaatcatttaagtcacagactggaaagataacatgttaaataaccagcttccaaatgacagggctcagatttgatttcagtaagcctgagatcatatttcaaaaaatctaccctcttaatcactgtcaaatgggcaaaatagataaaatcaatgtggtatctaattaaatgtcagtcagaaattgaagttctattttaggaaatgatacatcaatagagaaatggtatctttattgaaatttaactgatatcatttcaggactatatttgttgtgtaagtcagctttctgtactacatcaaaaaccctgacaatatgagctaaaaggaaaaaaaaaggaaagatttattttggctcaggttgtcacaggttttagtctatgatcacttggccccaatgcctttagtgctgaacaattgccttaacatgatagaagtacttggtggaggaaaatactcaacttatgctagaaatgaagcaaagggggaaaaaggaagggcagcagcagttgagtcccccctcgagcatgtagtatcacttcattttactaggttacagctcctaagtagctcaccatctccatcagcctcatcaaattggaaccatactttgacacaaaaacatttgggagacatttaagttatagaacataacaattgtttcatgacataaaagcatacttccatattgaaaagcaatccttagtgaaggtgttagaaactgtcttatataagttttattttgcactctctatttcatcagtcaatatgattattatcaattaatgtttctttgggtagaagtaacagaaaacccaaccaagtcaaagtgacttttaactgttttattttctccaggaatatgctagtcaaaatcctagaactgagaaattctaagtcacctggtaccaacaaggatctggggtctttcgtcatttgtcttttaccatccttcacacattagctattgcctataatctggacctctaatagctgaacatgttttgctgtaacttaagagcttatatctttataaaattcatatagtaagaattattatgatagtcatatatatgtctattatttattataagaaaatgtataaaaatacattacagtctttttttaaaaaaaaggatataggataatctaaaaataattcaggctctccccagtactttcctacaaatcttctcacagtggagccccagagaacatatttaattctctcaggtattaattgaagcaaactatatgctgaaagcttactagggattcagtatctaggggtttccttgggagatgattatgtaggaaacctctgcctagcacataatcaaattcactctcccgaagggaattaggtattccacatactctacattggttgtacaaacaatcgaggtatagtaatgtaccctcaaggtacacaccagaaactcaaattctctgatgcaaaccaaaggccaacctttctagtgaacttttctatgtataccaactccaggcttgctatgtcatctcttttcttcacagatagtaaagttttcttgcaagcgaaactttctttgaagacaaagtgtcactgccaatactagaacagttgcccatttcccctcttaaacggatagttgaaagaatctagtgttttgcaattttagcctctcatggaagatggatttttataatgaggtaatgaacaagggcttctgaatagagacaactagtaacctcttccaaaacacctttacatgttccttggtttaaaaattcactatttgaacttgctcttgtttcatttaataaccattaaatatttattgaatgcctcttatctagaaactctttaactgcaaaagtgggtgatgaaaaggagagattttagacagaagaaaagagtaccacaaaaaatgtttttttttttttatgtatccaaataactaaaaataaggtatagcaaacacagatagtgcaacaggtgttatttaaaaaaaaaaaaacaagccaggtatgctctataggactatgtcagactctgcaggacgttgttataaggacagggttgtaaggatttgggcctttagcttcattatcaaggagagccattgaaggtttttaaatagtcagtttcacatctaagtttgttaaaagttttttacttgaaaataatttagacacacattgaatttcaaagtagtaaatgagttccagtgttatatttacctgtggaaatcctgtatatggaggttcattttaaataaccatcttaaatgatcttacatgagtatactatagtttatcaaaaccaggaaactaataaagtatcaactgaaatacagacctgagctaatatgttactagttaaatatttttaagcattctcctgtatacagtgtagaaaatcttctccataatacactattgacaattagattcagtagatacataaaccataatgtaacaaaataaggtgagtcatttagtgggatgttcagagaaataatgtcaggaatggtttctaaatttctggtttagaaaacttgatagaagtggtgttatatatgctgagctaaggattatcttggtatgtggtcaggtagagttcaacatgtagagctgttgagtacacagtcgggtgttaaactctggagctcagataaaggactatatgatgctctatagcattgatacatcatgacatgtttatcattttctttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctgtggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttgcctaggaatttcataaattcattctttttaatagctgagtagtactccattgtgtagatgtaccacattttctgtatccattcctctgttgaggggcatctaggttctttccagcttctggctattataaataaggctgctatgaacatagtggagcacgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttattacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttcttttagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcctgtgtggacccttgcgggtgttgggcaagactctgctggcaaggtagcccggggctcgagtcacgagtcttgcggaagggacttgtgccccagatcaggcccgggtagcctgcttccctatgtactgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcaggcctgggtagcctgcttccctatgtaccgcagtctcaagttccgcgcgattggattggggcaggcactgtgatccactcaccagaggtcttagggtcccgtggggagtcctgtgtggacccttgcgggtgttgggcaagactctgctggcaaggtagcccggggctcgagtcacgagtcttgcggaagggacttgtgccccagatcaggcccgggtagcctgcttccctatgtactgcagtctcaagttccgtgcgattggattggggcaggcactgtgatccactcaccagaggtcttagggtcccgtggggagtcccgtgtggacccttgcgggtgttgggcaagactctgttggcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacccttgcgggtgttgggcaagactctgctggcaaggtagcccggggctcgagtctcgattatcattttctattagataccaaaaagaaattttcacttatagtgtgtaatatctgtatttgttgatacatatttctataaatattcattttctcatgataaattctcagaagtgaaatgtctgaataaaagaacatgcatgttttattttaatactaatattggagttaactcctttctctttgatactaatgtaattcctcattaacaatttaagccagactatttgaggtcaaattaaaaatatttgatgaactataataatttttgagcaccaagagataccacaacatgtggtttgctgcctaaatgtacatacactagaatattggtcttcaatatgacaatactaagatttagtgaacgttttttgacaaggtgaggcttagtaggatgttattatgtcattggaagtacttggaaattattaacctggtcttttagtatctcagtctttatctgacttcctgtcttgctgtgagatctttcccactatgatgccatcatccatgatttgacccagtcagcaaggaattgattggatgccaattccatccatggaattttcaaatcttgggttttcagcttcttaaaatatgagctatataaacatccttgctttataaagaacctggccaaaaagcttttggtatcaatgggcagtaaattaagataccagtaaaatggttttgagtttatttgtggaataagtcggttcctaggtatcaaaccaacttaaatagtttacgataagctagaatcttgtgagtaatataattgagaaaatatgcatccgaaaagtaatgtctttattccagtcagctattggtacagtaattgtagtactatcttgatccatgattttccacgtttaaaaattttaaatattactctaatttatatttagctttttaattctttatttacattccaaacattgctccccttcctggtatcccctccaagagttctttaccccataacccctccactttgcctctgagagggtgcttccccaccccttaccctcccaccctcacctcaccccttcatatcccccttccctgggacctcaagtctctacaggattaggtgcatcctctcccactgaggccagacaaggcagtcctctgttagataagtgctggtggccatagaccagccactgtatgctctttgattgatagcttagtccctggaagctcccagtggtccaggatacttgacactgttggtctttctatggggttgccttcccattcagcttcttcaatgcttgcttcccttaactcttccataaaggtcctgatctcaatctaatgcttgtctgtaagtatctgcaactttctcagtcagctgctggtagagcctctcagaaaacagccatgctaggtccttgtctgcaagtacaacatggcattagtaatagtgtcagggtttgtttcccacccatgggattgatccaagttgggccagtcactgggtggcctttcctttccctgtatttcttttagacagaaacaattctaggtcaaatattttgaaggtaggttgatatccccaaccctccactggggtccctatctatctacttgaggtggtttattaaggttccatctccccactgctggacatttcaaggttacgcccattgagtcctgggagcctctcacatcccagatctctgagactttctagatgtctccctcccccaacatgcccctcagctgcatatttccattcattttcctgaccctttgggcttctctcctgattctgtccatgcctgattctgatccccttttccctccccctcccctctcccaccatgattatttattttccccccttctaagtgggattgaagcattctcactttggccttttttcttgttaagcttcttatggtcagtgggttgtatcatgggtattctatacttttgggctaatatccgcttatcagtgtatacatatcatacatgtccttttaggtctaggttaccttactcagaatgatattttctagttccatccatttgcctgcaaaatttatgaagtcctcctttttaataatggaatagtattccattgcataaatgaatcaattttttttctatccattcttcagttaagcgacatctgagttgttttccagcttctggctgttatgaataaggctgctatgaacatagtggagcacatgtccttgtggtatggtggaacatcttttgagtatatgcccaggagcagtatagctgggttttcagatagaattatttccaattttctgaggaattgccagattgatttccagagtgattttacccaccagcaatggaggtgtgttcttctttctccacatcctcaccagcatgtgctgtcacttgagtttttgatcttagccattctgactggtataaggtaaagtctcaaggtaagtttgatttgcatttccctaatgactaaggatggtgaacgtttctttaaagcttcttggccattcgagattcctctgttgccaattctgtttagctctgtacccaagttttggggggttatttggcttttgaaagtctaacttttgggttcttggtatatttttgatattagtcctctgtcagatgtagggttagtgaagacctttccccaatctggaggttgctgtttgtcctttggatgttgtcctttgccttgcaaaagcttttcaggctgggcagtggtggcacatgtatgtaatcccagcacttgggagaggttgtggccagcgtggtctacagagtgagttccaggacagccaggactgcacagaaaaaacctatctcagaaagaaaaaaaatgcttttcagtttcatgagctcccaattgtcattgatcttagagcctgagccactggtgttctgttcaggaaatttttccctgtgccaatgcattcaagggtatttctcactttctcttctattaggttcaatatatctggtcttgtgtggaggtccttgatccacgtggaattgaactttgtacagggagataagaatggatcaatttatattcttctacatgcagacagttagaacagcactatttgttgaagatgctgtcttttttccactttttttttttggcttctttgtcaagggtcaagtgaccataggtgtatcagtttatttctgggtctttaattctattcaattgatccatctgtctgtctctgtaccaatactgtgtggattttatcatcattgctctgtagtacagcttgaggtcaggaacagtgattcctccaggagttcttttattgtcgagaatagttttcacaattctgggtcttttgtttttccatatgaagttgagaattgctctttccatgtctgtgaagaattgatttggaattttgatggggattgcattgaatttgtagattgcttttgataaaatgaccatttctactatgtaaatcctaccaatccatgagcatgggagatctctctatcttctgatgtcttctttgatttccagcttcagggacatgaagttctttttatacagatctttaacttgctggttagagttacaccacaatattttatattatgtgtggctattgtgaagggtgttgtttccctaatttctttctcagcctgtttatcatttgtataaagaaggactgcagatttcttaaagtcaattttatatccatccagtttgctcaagttgtatgttacgtataggagttctctagtagaatttcttggtgtcacttatgtatactatcatactatatttaggtatgtggcatgaatttctgatctgtccaagacttttatcatgaaggggtattggattttgtcaaatgctttctcagcatctaatgaaatgatcatatgtttttttttctttgagtttgtttatattgtggattatgttgatggattttcatatattgaacaatccccgcatccctgggatgaagcctacttgattgtagtgaatgatggttttgatatgtttatggatttggagtgcaagactttattttttttttacttttataagtgtataatcctctttaatatttataattaattcatagatttagagcaaaatgatatcttcacatagtctcctatgtttacataaatatatatatatatatagagagagagatagatatagatattttcttcatttatatttcaaatgctatccagaaagtcccctataccctccccctgccctgctccccagcccatccactcctgcttcctggccctggcattcccctctactgaggcatataatatttgcaagaccaaggacctctcctcccattgatggcctactaggccatcctctgctacatatgcaactagagacacaagctctggggggtactagttagttcatattgttggtcctcctatagggttgcagaccccttcagctccttgggtactttctctagctccttcattgggggccctgtgttccatccaatagatgactgtgggcatccacttctgtatttaccaggcactggcatagcctcacaagagacagctatgtcagggtcctgtcagcaaagtcttgctggcatatgcaatagtgtctgggtttggtggtagtatatgggatggatcccccggtggggcagtctctggatggaccttccttctgtctcagctccgaactttgtctctgtaactccttccattggtattttgctccccattctgagaaggaatgaagtagccacactttggtcttccttcttcttgagtttcatgtgttttgcaaattgtatcttgggtattctgcatttctgggctaatatccacttaacagtgagtgtatatcatgtgtgttcttttgttttgggggttttttctttttttattttcgagacagggtttctctgtgtagccctggctgtcctgaaactcactctgtagaccaggctggcctcaaactcagaaatccccctgcctctgcctcccaagttctgggattaaaggcatgcaccactactacctaacatgtttgttcttttgtgattgcgttacctcactcaggatgatgccctccagatccatccatttgcctaagaatttcataaattcattctttttaatagctgagtagtactccattgtgtaaatgtaccacattttctgtatccattcctctgttgagggacatctgggttttttctagcttctggctattataaataaggctgctatgaacatagtggagcatgtgtccttcttatcggttggaccatcttctggatatatgctcaggagaggtattgctggattttctggtagtactatgtccaattttctgaggaactgtcagactgatttccagagtggttgtacaagcttgcaatcccaccaacaatggaggagtgttcctctttctccacatcctcaccagcatctactgtcacctgaatttttgatcttagccattctgactgatgtgagatggaatcccaggtttgttttgatttgcatttccctgatgattaaagatgttgaacattttttttcaggtgcttctttgccattcggtattcctcaattgagaattctttgtttggctctttaccccatttgtaatagggctatttgattttctggagtccagcttctttaattttttgtatatattggatattagtcccctatcagatttaggattggtaaagatcctttcccaatctgttggtggccatttttgtcttattgacagtggcttttcaggctagggatttttccagggtctactgagctccaacttgaccacttgaggttctgctctttcttaaaacaaagcatatatgtgaagtcattcttacagagacttataaaatatccttgatttctatgatctctgtacattttgtaacgcaaaaaccgtaatttaagaaaactctatttggtacttgcagagtcatgcacaattccaaattacatccaaggactggtttgtttagctacatttatatccctcattagtcagagctggagtggacatctaagtatgaagaacacatttcttgtgtgtggtacattctttaaaatacataatttcagtgtgttgaatacagaaactaagcaaagcttttcaaaatttaggtaaaactttattactttggaatcagtcaaaatttatatataccaggttatctctcagaatattgaaaaatattaatttttatttactaaaacattgcatttctgttcattttaatctaaatatacattaaaggtgaaaatacaaatatgatagatgacatttgtatcacatctaattggcagatgatcattactcagaatttataaagaattcaaataattataaaaagttgttggaataactagttcttagaagagtaaatgattgacttatgaacatgaaaaaattagcattcttattaaaaataaaaaatatgaattaacacagcccggctaacactttatatgtttcaaatttacagaattgtgaagtctgatatttccagttattaactagaaattacagtagtggaactttttttcctgcctaatgggaatgtagatatgcacagctactttgaagaacaacatggcagtatcatttaaagttgaagaagtaaaaattcctacagataaataacattgtgaatagaaactctgttgaactgccaaggcagtcctaaaagggaagtttatagtgatgcacatttacataaaaaaaattaagagagatttcaaataaacagcctaatgtttcaacgctctcaaaaaaataaaaatcagcccatccaaaacccaataaatagcaagaaataataaatattagggaagaaattaatgaaaaagagaataaaagaacaatacccaataatgccagaggcctttcctttattttaacacatttctgagaacactgtgtttaaattgcattgagatctctgggtaccctgatagcttatagagttgtatcaggcctacaaacagaaagctctatgtcagtagttcagaaccttcctaatattgcaactctttaatgcaatcccccatgtgtggtgacccccaactataaagtcatttttttttgctacttcctaactttaattttgccctgacatgaatcgtaatgtaaatatctgatatgtgggatatctgatatgctacctttatggaaaggtaatttgacaccccctgcaaggaggtcacaacctataggttgaaaatcacttctactgcaagacataaagcaaggaaacctatataatcattgaagattcagtagtagctgtttttgccccttaattggttaagatgtttgtgggtggtttaaccagttgtgtacagtgatacagatactacaactttgagatgcatctgtaagaaatgatctgtaaacatcctctgtactgtaatgtatcttgtcctttttagtacctcaaaaagatgattcactgggtggtaatttttgataaaaaacgactttgggaaaatggctcatacatgtcactgagtttttattgtttttaatcatagctaacttaatttatattcaaaaaaggatgtggtctacttcttaatatttctttgacacagagcagataagatttcttattatttttttcaagatatacaactaaaaggagatcaaaatcagtgttgtagactctcagtgtgccaaaaaggctgagagtaaaatttaatcattgtcacacacttatgaaatatcattagtggatccctaccactagccctctttctctttctagagcaaagataaaagaaacaggcttaatatacattgggagtgctagtttacacataggaagaagtacaaaatggtgaggtttattcaacagtagatcagctaagcagaggagacagttggactttactcctgggtaaaggctttatgaaataggacagacaatcatctaatatgattagttagggagaatgatattcatgtaactaaatggcctcacagggtgccttctacactctactctctgtgaaaataattgaattaaaacctgtttccaagacaaaatgtactgctcaagcctataacctggcactgatgcagtcagctcctgagctgtgctcttctcactaccgaaactagagtgctggaccagaacaattattcaaggattttgtgaaactttttgctacataaggaaaattaccctttattcacggggaggcagatattgttattctagatcactatctatttttaaagttgtatataaatcatttaattttttaaaaatgtatgccctcttcttagaaaaatgaaaacaaaataaaactaagccattttctcactagtttccaggtaaaaatttctgcattgatttgcctcttgtggtacagtcaagcttagcacagtaattaacatctactattaaatcagctcaaacataaaacactttaattaagcagccatgtatgtgcccaagaaattaagaatgtgctgattggaatgaagcagctgttgttcctgcttgtgatctaacttggacaatactgagcaaacataactaaagcaggacaaagaacaaataaacaattatgtatattcatgaatttcacttgttatatactctgatatgtcccccatttactaactccctattattagcctagcattatgctctgtgctctctctatatctttccacacatatagccaggagatatacatatagaaaaatagatagatagatagatagatagatagatagatagatagatagatagaaaaatagatagatagatagatagatagatagatagatagatagatagatagatagatagagatagatagatgtgaatgtggatgtggatatggatatagatatagatatagtcttgttcatactaccttttaaaatgtaatagaagaaatagaagcactatataaataatgaaaatacctgtagtgtagattatgtgcagccgtggagaattaattcaattatgctagtctctcttcctctgcaactctctctctctctctctctctctctctctctctctctctctctctctctttccctcccatgagtgagtgtgtgtgagtgtgtgtgtgcatgtgcgtgcgtgtgtgtgtgtgtgtgtgtgtgagagagagagagagagagagagagagaaagagagagagatcctacagcatacctgtggaaataatattttctgaataaatagtcttgactttttctgtgcacagcagagagcatatgacattgggattcttaatgtagatttatattctttatatttaagtaccattatatatttattctttcatcaaatatttgtttaaaagttaaaatatgcaaggtgccaaggagctcagttggattttccacttatatactaaagggtatggttgcagaaaaaatacaccacaaatatatctaaaaatatcaatactgttaacatgctacaaaagggatgctatggtgccaagaaagtttgtaataagatgctaaaagaggttttatgattacctagcagtctgaaggaaaaagtggtaattgcctagattgagaagtagctgagagaattccaagtagaggagaaagtatgtctaatgtcttgtaatgggaagaacgcaaggaattgggacagatgaaaggagtcctgtattacagaaaaaaaaaagaaaagaaatggtagtcaaagagacttaagaaggtcaaattgaactatgctaccatttatacgtcatggaaaagtagtagttgcacaagttttaaagaaaggttttatgagaagagttgactcaatgttatattatattcttgtgtataccaagtgctttttccaactaagttatgtcggcacgtgcatatatatgcagttataattaacaagattatacacaattggaaaaattagtaatgaattacatacaagaatggaaactaggaagacaattctatgtggggacataattggaatgcctagtacacagtatcctaaaagaattcagtctattaagtagacaaaagatatgttttgaatagctaacataggagataataataaataaaggatatcatgaatgagggagagctaaaatgggtagagtgaaaatgtgaacatgttgtgaaggctaggagatgactcagtggataaaatcacaagcctggtgaccctattttagttttgaatcccagaatcagttgtaaaagccatatacaatagcacaagcatgtgtgatgccagctttcctactgtgagatgcagagacagcagcatcttctggagcatgtggtccagtcagcttcacttgtacaatggctgagacctttgtctcaaataaggaccagaggaaaggaccacagccagaggttatcctctgaactctcccttcctccctctttccctttctcccctcctcctctctttatacacacacacacacacacacacacacacacacacacacacacacacacacacacacacagagaagcacacagaacaataaagtggctatgagctagtatagtccagaaaaacaagaggataatttaacttgaatttagttctgaatgctaagtagtgtatcatattatgtctcaaaatctcaaattataaaacttggggatcacaatgaaaaaaaatgttttcttaggcgttgccttgttaatataattcttccattgagtggcctagatataaattatttctgtgtatctatctagcaaccaattctaaagccagattctttcaaagtacaagttcaacagtcatcccaaattttctttctttattaatttatttttcacactccatattttattcccccatccaccctctgactgttatatatcccatacctcctccccactccctgtctccacatgcatctacccatccccaaccccacctgacctctaaactccctggggcctccagtttccttagggttaggtgcatcatctctgaatgaacacagacctggaagtcctctgctgtatgtgtgttgggggcctcatgtcagctggtgtatgctgcctagttggtggtccagtgtttgagagatctcaggaatccagattaactgagactgctggtccttctgcaagattgtcctcctcagcttctttcagcctcccctaattcaacaacaggggtcagctgcttctgtccattggttggttgcaaatatctgcatctgactctttcagctatttgttgggtctttcagagtgcagtcatgataggttcctttttgtgagcattgaatagcctcagtaatagtgtcaggccttgggacctccccttgagctggatcccactttgggcctgtcactggaccttattttcctcaggctcctctccatttccatccctgtaattctttcagacaggaacaattatgggtcagagatgtgactgtgggatggcaaccccatccctgacttgatgccctgtcttcctgctggaagtgggctctacaaattttgtctccctactgtctggcatttcatcaaacttccctccctttgagtcctgagtctctcacctcccaggtctctggtgcatttgggggtcccccaacttcctatttcctgaggttgcttgtttccattctttctgctggccctcggggcttcagtccttttccctcacccagtaccagatcaggttcccctctcccccctcctctgcccaccagatccccacccccacttctgacagctttcttctgtctcccaagtgggactgaggcatcctcacttaggcacttcagcttgttgaactttatgagttctgtggactgtagcttgggtattctgtaattttggggctaatatctactcattagggagtacataccatgcatgtccttttgggtctgagttacctcactcaggatgatattttccagttccatccatttgcctgcaaaactcaggatgtccttgttccaaattttcaaagtccaaaatgctctaaaaatcttaattttttgagtaccagtatgatgtcaaaagttccacacctgatgctagctattttaaataccatcaaatcacactcagacactatgtacaaggtgtacatgaaataatgtatgaatttacataaatgaattttatctttgtaactgagttccaactcaagatatgacattaggtgtatgtatatatttcaaaaagttacaaagctcaaaaatccaaaatgctagtctcaagcatgttggataggagatattcagtatattgatggtattatagacattacatggtaaacttcctttagtatagttagccaacaggttcattttgtatccttgcttgaagtggtcattatcttcttttttgatcacttacaggaaataatcaaaaagctaacattaaaaggaagaaattgtgagtaggaaaagtccagagtgtgtcaatcaatgtaagcatacaaacattagaatccgaatccctaatccaaatccctggcctcctatacacctgaaatgattcacaaagtatctctgaactttaatttctttaagtttaaaataagtctcagaaaagtactttgtttataactgagtatgagaaataataaatggaatgttttgttaaatgctttgcaaattatgaaactttatggcagtgtaaattagtgtcttgatcaaatatataaagccaaattttacgtccaataatagcaactgttaaaaccttttcttatccccttttattaatttgattatttgtatattatatgcttatgtagtatataatttaatacaggaaaagaatacagattataactgaagggaaaggctcaaaatgttaaagcttcctttatcttcagaagaaattattttctaagcatcaatgtatgtcactatacatgaactcttgccaaccaagaaactcacatttcttgacattaaatttgtgattgatgcttgattatatagatatgattgattgaattgttgcccatatacttgaactcagccttgagattaactgattttacatggctcaaaggctctacccatatgatattgttggtctttctgttatgactgatttccaacattaagactctctggtatattctatcctttccatgatgaaagcaatctgaaaatataaggttattcaaagaactaaataataaccaccacaactatgaaacaaaatattgtttagttcttgattggatggagtcagaaattttgacattattcaattttgactatggggatactaatcaggaatgagatgacattaagattgtggcagtccactgctgaatgtcattcattttattactttttttcattggccacactatggccatcatgttcaagaaaaaaacagcaggaagaatggcccttccttcagtgggttttatctaattcttggctattttgttttcatctatattgggccatattaaccatttaaatcctaccacaggtcatgtttatgggtcaccacttgtaacaacttactgggaatatgaaatatttattttattttacttattatcctttagtccagaatatcaatatgtattatgagatattttagatttgcaaatactgtagtgtttgggaatataggcaaggaaataattccaattattaaaataatacagttcaatctgtcctttattttatgtctaggaactccttttgaatttagtatgatgccatggtatacctataatcaaaatcctgatattaattaaaggcatgacaatttgccaattggtacatcttagtaagtgctaaaattaattcagaacctatgtgcctacaagtccaagcaatcatctttcttttctatcacatagtcttatacaatcatacaatttgggtttccaattagagtgttattatagtgttctgctttaggtttgtgttggcaggtcttgcttttcagtgctaaggttgattctggaccttgcacatgctaggcaaggactgcaccacttagctatatcttagcacttctgcttcttattttttaaaagtatttttaattattctgcatatttcaggggggcagaatccttttcccagttcatatttatgtttgtgccaacagagaatcccaactcagtatcatcaagtttaatggtctcccaaatgtgataaattttaatttatttggtttgagaaccctaagcttaagtcaagtttggtttaacaataacactggcaactttgttgaactcagaatcactgttgcttctttttacagttgtccaaaatgagcaagggtctcctctgcacatttatttttttgttttcttttttagatagggtcttgctatgttactcgggcaggtgttaaactcactgtttggatcaatggatcctcctgcctcagcttttccttaatagctgagtctgtaagcataccaccaaacagatctactacaaattaaaaacaaaacaactagacttcaaacattcagagctgccttttatactggtcactgggtgccactggtatctatatgtaaccatgctagtcggaagatttttggagatatagacaatagctgaagcatttcaaagagtactgatgaactatgatatttagaatatgctctaaagtatgctccatagtgatttttctttgtctcattaccaactatgcaatgggctcatacattatagatgatgtgattttttttctaggcactgtataaaatgagggaaagtcctcatttgcatgtataaccaacagttataggataagagccattcccctgagcctagcatcacttgtcttccactacaatcaaggcacctgatttgatctgaaacactcacataggccaacaaactcagtgtagtactactttaaatagagccctaatttcatattcctattcctaaatgtaagtcatcaagacatatgaattagagaagttaaatttataacagaaactcaggcggacttagcaaatgcagtacagcacagcggaacttgatgcaaagtgatatgaaagtaccagcatcattctaatatgccctgtaaaacacacagtgcagagccagttagtatagagggaagaaagaaagctttctgggtaattcacattgacatggtatttaaacttcagttgtcttgtgggggttgctctacaaagagagagagagagatcagcctccaccccaaaatatgatttgaatgctgcccatggactaaaaagagtataagatgatttgttactagcataattagttgtgcttttttttctttttttgagatagaggtggctttcaagccacagatatcttgaatgaagggaagggtgaatagctttgaattttacattggttggtgattcgtcctgtgctgattggttgtgcatgctctctgaatttgcatatgagcagtatagaaaaaagagaaaagcctgaaggagcttgcaaccccattggaagaacaacagtgtcaaccaaccagacaccccagagctcccagggctaaaccaccaaccaaagagtacacatggagtgacccatggctccagccacacatgtagcagaggatggccttatatggcatcaatgggagaagaggcccttggtcctgtgaaggggaatgtgagggtgggaaggcaggagtgggtgggtgggtgggggagcacccatatacaataaataaataaataaataaataaataaataaacgaacaaaaggggaaaaaacagttcccactgctgacagttcttagcagttgtcctaatgtggcacaagggagagaaggaaattgttagaggggaataaaagagaataacaatagcttaatatgatcaaaatatattatgtgcatgtatggaagtgaatttcacaatgaagttcattattatgggaagttaaacatttgaaaataataaaaacctcttaaagggaaataatgaagattatggcttgaaagctgctaacatcaaaatggtagtcaggctctttattaaaaatttgaatctctaaaaataaattccagtgtcaccagttaaagtttgccagataaacaagagctctattaatagtcttagatttattcttaagtttatcagcattctttttgctgttatagtgaaaatgatgatttagtggtaagatccatttcctttcctctatgtgattctggttttagatgctttgatgtgatgctttactttcaaaatatgcccctttatttctaaagacttcttatctgtcttagaataaaactaaatattgtctcaaagaagacaagacctctggcccacatctatgggcttttttctacactgtattctaactgtgctgctttggggaagacatttaagctgttcatcagcttcttcatgttcctttcataagatagacattacaaagggtggtgagtgtaccaacataagtaagttttctccatgtttgtaatatgcttccaataccatagacactggtaattgccaaggcagcagtgtgcgtatgctgctgggaattatctgggtaatattttaactgaattactgggaagggaataaattaagaaaaaccatgttaaactactttgagatatataaagtaaaataagatcacggatgcattttcctaatttatcaattttttgcaattaaatatttagagtgtgtggtattcctaagttatctatttagaaattgggaagatttgggagctgtgttggttgtatttctaagattcatttttagttcctaatggttttattttccagaataaggaactgtgtgttcctcttgccacaatgactaagtgctgctggcacaaataacacaactgtgaaattttttaatattataaaattatggcttccaaagaccccaactgcccctgtagagtacaatttactaatccttcttatgtgttcttaattagtccccttttctgctgacagtggtagctattgcaaactttactgtatcctttctcatcaacatgtttccatacattttctctgactcaaaccactccctttgttccctgtcttcctacatactctgagatacagtatctgtgcctcaaactattaagtgggctatccatgctgccttatagctctctccatttctatagactatttctgactgaatgccaccaccatacaacaaactttactaatcccctttctttccagattcagacaacatatctcaaatttgtgaggccttcttcggcagctgaagtctagttaggtccttccttgttctaccaccaggcatactttctgctagcaaaaaacagcgtatacaacattctcttgtttattttcatatctgtctcttgtaataaactataaaatcctaaagaacaggtaaggtactatttaatttgtctctgagttctctgaacaaatatagtgttggcacaaataactatttattgagattggaaagagaaggaaagagaataaatataagaagtatatacttctttcagaacacaaaccactttctttcaaccttttaaagtaattttcaatggcatacccatttacattttccctcaacctttacaaaactttctttgcatttaatagatacatgctgatatttttaaaaggaacttcaacaaagacagctgtctgacagctgtacaccatctgtgcttttcagcctgagtaaaaacatctggctactcgagaataggagctctgtactaaagaagtttcccaggctggtgattattagtattctaccaatgtgctttgctttgtcccactttgacataataatttatacaacttgtccatctggattatgaagtttccttttgcttacacacctcgacaaaggtaaatgtaaaacaaacaaaaaattaaacagaaactgtagcatgttgctttatttcttccatgagtatcttttatagtaaaagttaatatcatagaaaatatctacatgtacatgtaaacttgtacatttgtgctttgggtcaataatctccatggattatgaatctccagttaaacaaagttagttaaattttaaatgtctttttctttctttccttgatttggaactacttcaggggctgtgtccaacaggacaaaggagagatcttaatttgagagcaatggaattgagatgtcatgaaaaaagaacagagaactatttggtgagaggaagggaaccagcaagagtggaacagaagggttggaggagtgacatagaggagaaggatggatgaaaacaaagtatggtggcatatgcataagagagagagagagagagagagagagagagagagagagagaggagagagagagagagaaagagagggagcataacttcatatgcttattctcaaaaattaagaaaaaagaaaatgtaaaagaaaaaacaatccctaggtggggcagtctctggatggcctttccttctctgttctgctttgtccctgtatttcctttagacaggagcagttctggattaatatttttgagatggggaggtggccccatccctcaactgggggccatgcctgacctctggatatggtctctatatgttctatctccctttttttgagtacttgagctaatctcatccccattgggtcctgggagcctcttgctttcctggcatctgggactttctggtagctatccccagttccccatcctccattgctacaaacctctgttcgatttcctgaccctctgtacttcatccctatctcctcctgtatctgaacgggccccccttttccctctccctcctatctccctcctagatccctctcaccttctgcttcctgatataattttcttcccccttctgagtaggactgtatatagtactgtagccttcacactttggtgtggtcttctttcttcttgggtttcatatggtctgtgagttgtatcgtgggtattctgtgcttctttttagctaatatcacttatcattgagtataaccatgtgtcttcttttgtgactgggttaaatcactcaggataatattttcaagttcaacccatttgcctgcgaatttaatgaaacagaggactgccttattaggcatcagtgggaggggagtgcattggtcctgtggaggctcaatgacccaaggtaggggaatgctagggctctgaggctagagtggatggacaagtggggaaacaccctcctagaggcagagggagggagaaggggatagggggtttgtcgaggggtaactgagttcgaggccagcctggtctacaaagtgagctccagaacagccaggactatacagagaaaccctatctcaaaaaaaaaaaaaaaacaaaacaaaaaaaaacaaaaaaaaacaaaaaaaaacaaaaaaaaacaaaacaaaaaacaaacaaaaaaaatgaacttataatagcagttgggactaacccatttacaacacagtttttactgctgagttcccgttgatgttttcagtaatacatactttatatatagatgtatgttgtagtctgcatttgtgtgcatgttcatgtgtttgtaggcacatgtgtatgtgtgtgcatgctaatagaggccagagggcaacctcagctgacagtcaagttctgtccactgttttgttggtttgtttgtttgtttgtttgttttaaaagatagagtctctcgatagcctagtcagggtaggtagccagtgatcctgagggatattcttgtctctgactccttagtgccccgcgggattacagaccgacaaagaaacccagcttttaatgtaggttctggggatctaatctaggccttcctacttgctaggaaaccactttactgacagccatcaccccatctccttttcaatatatttctctagcatatctttattgtacaaagtcgcttgtatcatagccacattctggaatagcagtattattgtgataaaatatatgcaacacaaaagatttcaaccatgtgaagtattaatattatttaggaatccatattgtaaatcatgaccactgcttatctttattactttttgtcttacaaaataaattatttgaacatacttgacaagtctgctattatatgattgtattattttaaaactggaaactttaagtttttatttccagaggtagtttggttttaagtagctcactaagacactgtgttgtatctgaaaatacatagcttctagatggtctacaagacctaaataatggttgaaggacttggacttagaaaacaatagtgaatagcaatatattatttagttttgaaaggatagaactagagtcaattattgagaattcctgaacaccatgtttgggttatagtaagaagatgttttctagcatctgggacatttcagagtgtagtgtaatgccttaaacactgaatgtatttaagcaatgattaccactgggggggttatatattgtatgagagattagattaagttctatcatccttcgaattatattaaaggttagacaggcattgaatggtagtcatgtttcctgttgtatcagatgtcatatttgcctatcaactaaatacttaaagcattttgtctgtccattggttaccaatatagtgtttgctatttttgtttgttgcacccagaaattactttccttagatctacaaacaatagcattacttttatcactcagagtataaatgtatcacttcagatatgccttctttcaccattttatttaaaataatccacccctatcccaccattgccgtctctaattaccttctagcatattgctctgtttatttccaccagagaagtaatcagtctgtaattttcttgtttgctttttcccgtcttcttctacaaaaagggaacctaactttggcttactcaaaagtaaattcatattttccagaccagtggcatgcatgaaataagaatttggtaagcatttgttaaatgaagaaatagagacctctccatgggttaaggtttctattatgttaaagcactctgtagaagatgcttgctcagagacattttgcatttctccataacacaaaatcaggtatttggatgtccaagggtgataatttttcagtttttcttatctttccaaaaatttccttctgttagctattttcaatgaaactaggttttatgaattataaatataagaactggggcattcatgagaaaatattgtaattgaattttgtgggtatttaagagtaaatgatgaccatcacagatggccatttgcaaacatatatatgagtgcttagttgcttggacttcatccagtgatttgttataacttaattacttaactgatagatcagaaatcgagacacctgggacatgataacatctgcttctgaaaccataatgaaagtgtgctttataacattctcatctccaagatccattgaagctacttacatgcttcccttggcttgcttttctttaatgctcactagttgtgtttcattttcttgcttcctaatattaatagtttaaacagctcatttgtcagttttatgtgggtgttaatattaaaccacctttttctttttataaattccataagagcacatatcctttaccaaaccttttcatttgcaatgaccctgtggtagtttcccattactttcttttttctatattcaacagtattgcataatgtattttggacaggctgtttgatcagatttttttttccaggcaagtatttctagtaagatttggcttccttctcattttatcactatattctttcttgtttagccctgccttttcatctttcttcttcccaagtcacttttttctattatcttaaattgttttctggtgtgatgaattaatagtgataaaatggtttatatcaataaatggcttcttggatttactgaaatttttaaatggtttcttttcttttataaagacaaaaaaaaaaaagctgttcattatccatatcagatcatgtaagctccagattccaggtcctgtggaaaccatgaaagagtagtcagcatttttaaaagttatttgtgcacaccagaatacagtcttattataaagtatttacttgttgaacacgttatacataatcgtgtatgttatcatgtcaacggaagatccaagaataaggaattctacaactcaggtttggcagggttgggtaggagaaagcaaccaattctacataaatctcaaaatattgaacttccacaaacattattttcataggtattatgtgagacagggacttcttatgggccctagactggtctcaaatttaaggcactcttttcctgaaagaaaagtaggaagagaatgtggtaagggaaggaaggagaggggagagagagagagagagagagagagagagagagagagagagagagagagagagagaaaggagaagaggaagaggaagaggaacagagaactaaaggcagaagacagcacttgagaacctgctctcccctttcaccatgagtcttgggtccttgaggtcacccagttctcagtctcgttggcccccttacctactaagcccccgcactggctcagaatatttttttagatatgttgtgaaaatgctataaagtgagtagagcaatgtttgatatgaagtgaacttttagaaatgaccaggctaggtactgcaccagagtgtttctcaaatgcatcagttaaggtcttgaatttctatatcatggcaacttttaccaaactttactctttggaaccctagcataagaaaatatttcaatagttttatttgagggaaacaagcaatttcataactagcagcttgggaattgctgcatactttatgtattttgagacagggtctctctatgtaacctgactgtcctttagctcattatctaggcccagctagcttgaattcatagagatctgtctgcctctgtctcccaagtgctgtaattaaaggcatgtgccaccacattcagctcattcatactttttttcacttagatcattatacatcatcacactaatggcagtaaaaatatgcatggtttacacttactttagccattgctttcaaagttgagaaatccttttactatggatcatacattagtatgttaccagacattagtttggggaagcacaattttgagaaacaaatagggcactccccttgtctttagctggacaaatcattctttttaacttacaattgcataatgaggggagtagagaaatggtttagtgattatggtcttatgctgcccttgcagaggacctgagtttgggccccagaactcctctcaggcaactcacaaacacctgtgactccagcttcacagtgttccaaagcctctgccctagggagacactggcaatcctatgtacatatccacacagacagacagatagacacatatccacacagacagacagaggcagacagagagactgtcagataaagacacaaacacacacacaaatttaaaaatataagaaaattaaaaatttaagaacctggataaagtctgctatacctcattggcaaattggaaaaccaaactaacatttagtgttgttgcctagtgacattctctagtctttattcctacaattacaattattccttgatattgccacacaactactgtgctactgcttatcctggcttttactttggtttgtttgtttgtttgtttggtataatcatcccatgagattatacaacattttgttgtattaaagactagtgcttgcctggcactatgtaagagactcataaaccattactaaaagttcatagaaacaataaaaaatggagttttaacagctttgtatagtcattgcacatttttaatattgattatgtttttattctcatttccacttactctctataccatgctatagaaagctttctatgtgataagtgacttaggtgaaagtcaatatctgcaattagaagtgtctgttttgcaatttatttgtcttagtgataccaggaaatgcaaatcttttcaaacaaagaggccatccaaaggcactgatgatgtagagagtcaattctttccattaccacacctttgaaaggctcaattgtaagacctagtactgagggaaatccagttgttcttctaattaaactctcaaagatacccagagacataagaaaccgatcctaatatgctcactatttttcttccttccttccttccttccttccttccttccttccttcctttctgtctgtctgtctgtctgtctgtctttcttccttccttccttccttccttccttccttccttccttcctttctttctttcaggtcaatactgtactttaaaaaaaaattaatatgtagttaaatcattttcccctcccttccctccctccagcccctccctatcaaattcatgacctcttatttttaattattatcacatatgtatatataaaagtgaataaatatataaacataacctgtcgagtccatttagaatagtttgtatgtttatttctttattgctgaccacatggtattggataaccatttaaaggattcacccctggggaaagactaaactaaatctcctctcggtagttgttcattgcctagagctcttcatccagggttgaggccccataagatttcccccattcatcttggcatgtcagttgatgctttcatcgtttaggtcctgtttaggcaaccatattattgatattttatgggtgtgacttacctgacatatatggtagacacaatcttgcagcagacttcctgatcttctggcctttacaatctctttatgctccctcttctattatcttccctaagccttaagttgtaaagcagggattctcaacctgtgagtcatgacccctacagagattttatatctgaaatcttgcatatcaaatatttacactatgattcataacagtagcaaagttacagtcatgaagtagcaacaagaataactttatggttggggtcaccacaacatgaggaactgtattaaagagtcagtattaggaaggttaagaaccattgttgtagagactatgctgtaggtgtctcaatagggcaaagattgagagtgaggtaggacaacaggagatatggtggaggagattgtagagattaccatagaaagcagaacctcttatccccacatgatttcattggaccaagggaatatgcttaaatatcaccccccataccaacttggaagaagtgggtttgatataaatgacacatagaaggtcacacacactctgcagtcaggtgagaggccagtctgacacaccaccaaattctttatatctctctattaataaattacctccttaaccatccccttgctctgtacaagataaaatccagaaacaaggaatgttagatttacgaaataaatgtcatcgagaacactggacagagtagaatggaaggaaaagaattccccttcccacactatgggctaccacaagcaaaagaaaggaggaatgtctctgaagcaaactgtctaaaaaccaaactctgaaaaagagatctgcacaaggcccagcagtagtcacttagagggtacttgcccagagctgtgcctccccttcctccaaagctgggacaaaagaggaagctgttcttgaggccttgctatcaaactgctctgtcagaaagagtagaaaatctggcactataaaatctccaacccctagtaccctttccactatttaggccagcaatgaccctgacaactaggaacaaaagaaatgagctgaacctgacatagactcatgaatgcaaacatattcaggcaaaggctgtgggtcacaggtttggaaaagttgtctggggtcctagagcgaggaaaacccagaggcaaaggtaaatacaagaatgggtgccacccctcccacacattcaccataaaagccttagatagtgacaaccatgcatagaaaacaatgtgatcactcagcacagcagagagcaggcagtaactggtaggggcacatggaggactaggaaattcctaccaagggccagggtggagggctgattcttgtgcagcagagacattctggtttaactagttttgaactgcatagaatttagcaaccttcttcctacctgcagagtcagctacaaaagacaacctatagggtaggagaaactatattcaccatacaagtaagaaatatagattggttggttggttggttggttggttggctggttggtttgtttgtttttagctttatttttcatacatttcacatttgtatgttggttttgggggttggggtttatttgtttttagctttttcttgcttgaataaaatcttataactgacctttctttttctacacctaacctatagtaatttcgctcataccttcatctctattttactattttactcctgtttccctcttccccgttcccttctccttttgcttcttaattattaatattgaatatccttaaaaatacactacatttatcctaatggtgttttagttccattttctaatcttattggggatataattgaagtacacaaataatttttactgtatttaagtacagccttgctgtcaaatcactgtttcagttacagctgcctgttccacacactaaatggcagtaggactcattacctcaactaaagactatacataaaaaaagacataaagtaaagggaataatgaatgcacagaggaactcagaatgtaactcagtggtagatttcattcctagcatgtgcaagccagtggtcaattatcaatagtgaacaaaaaagtgtaaatgtaataataaaaataacagctggagaacatatccttctcaatagatacacaaatcacaacaaagagacagaaaatatatgagaaaacagtacttctaaaagtccacaagacctcaataatagagaacaaagataatgaaatagccatcatgctagaaaaaatagtttagaatactgctttttaaaatgttccatgatcacatagcagacaaaaacaagaagatgaatgaaatatggaaatcaattcaggacctagataagaaagttagcaaagtagatgaaatatagctttttattgttttgaaatttcctacaaaggcagacacatcacagtaatatcacagccttcatcagcaaccctaaaggccaggaaagcatgcaacgatatatttcaaattttgacaataatcaacttccagctaagattgctatatacagcaaagctatcttttaaagttggcagcaagatacagtcatattaagccaagcacatgaaacaatgttgaactgaaatttaaaaaaaaaaaaacttggagaaaaaaaattgagcaaggtgattgaaattttgggaaaaaaaaaaaaaccaaatgctagaaatgaaagctaatcaatcaaataaaaaggacatgataaaaccttaacccacaagattaatgagggggaaaaagaacaccaaggatggaaacaatgtcaaggtaatatttcgttcaaatatcaataaataaaaagaagtatatacagccacaacacctaagaactcagctgttggatcaagagaccaaacttaagaatctatatgacatgaagaggaactgagattaaaacaaaaacacagaaatatgtttcattgaaattatatcagaaaatttctcaatcataaagaaatgaatatccaaatacaagaggcatttaaaactacaaatagacacaactagagaagaaccttcccacaatgcaggcaaggtgacatctgtagtggtgacaaagaaaaaaaaccacatacctacaaagctataaaggcaaatctatcagaatagcaccaggcttctcagcaacccaaagccaggaaaagaacatactgatgtattttgagtcctgaaagtaaataactgccaaccaaggttgctatttccagcaaagcttatttaacattgaaggaaagatagggagatttcaagacaaatgcaaactggagtaattcatgaccaccaggatagcactacagaagatgtttgatggaatcctaaacacacaggagaaatacagtcttcatcatagagtacaggaaagaataaattttataaaagaaatggataaataaaggagaacaaggaaataattcatcaagccaaacagaaccctaatcctagtagaggaaaaaaggaacaaacaaaaatttaaccaaccagaaagacaacgaacacaattggaaaaactagacacatctctttcagtaattgaatataaatggcctcaaatctccaattaaaatatgtggaccaggtgactgaatccaaaaacaagatcaagctatctgttgtctccaaatcatgtgccttgctgtcaaggatacttaaagattgtcagaggatcgaaataaatttatcaaacaaattgaagcggaaaaatatctgtttttgatattcaaagaaataaacctcaaacaaaaattaaacagaagaaaagaaacacctcatctcttaaagatacagcaattataattgcacattaggactactagttttatttaaaaggtgaaaataaaatgtaacacaaatcttgattaaaatgatagtaatttcaatatccacttcttatctgtagataggtcatccaaactaaactcagaattaaactacaacatatcaagtgagcataacaagtatctcctggtttgtgtattcagcagaatcagaatgcatattagtattagttacttttctgttgctgtgatttaaaaaaaaaaacaagttggtaaggaaggggtttatttggtcacaaatccatgtcacagttcatcattaaagcatgacagcaaaaattcaaggcaggaaccacaaagaagtgtagagttagggtatatgctttgagttagagtttaatatggtagtttatcccatagctaggattgacaggtctagtgacccataaggaaagtttttacttattatccctgggatcttatgctctagactagaagttttggttccagagtaacaaccacttctgccaagagatactggcagactaatcacatggaagctagaactatctcccagctatttgggctcttgatacccataagtcaatgggataaaaagggaatagtattgttaggacaggtgattcgagactttcagtaattagtttgtttttttcacagtgaagataaggaagattatgtctagagaacagtagattctttagggtttctcttggtgttaccatgtcttgtgataaaaataaaaaataaataaactggaaactataaaaatccaatccagacaggatgacaaaggggctagaccattcagtgatgaaggtataggtcatccttccagggaaagaaccatgacctccctacataggagcttgctgaaagtagaggaaatatagaatggatagtagagcaaggcagataaataccagataaagccacatgatcggttgcagaaacaaggattataattgacatgagtatttttctaagaacatgtttgtgcagatatacacatatattaaggtgacatttgcatttccctctttttctttatcatgtaatgtaacataaattgagataatatcagtagttaagtgttgtaagtctatagtatcatatttaggttatgagacactgaaagacaagtattcctcaatggactttgcaacctagtctaaaaatatatagtgtgttggcactttcacatgcgatagttataacatcataattggaattatgaccttatttttttccatttaaaaatgaagcatgacataaaaaatgtgattggaggctgttagtggtggctcatgcctttaatcccagcactcaggacagaggcaggtagatctctctctttctctctcttttttaattagatctttatttacatttcaaatgttatcccctttcctggtttcccctctgaaaacccccctatcccctccccctccccctgctcaccaacccactcctgcctccggaccctggcatcccctacactggggcctagaaccttcacaggcctcctctcccattgatgacctacaaggccatcctctgctacacatgcagctagagccatgagtccctccatgtgttttctttggttggtggtttagtccctgggagctctgggggtactgggttagttcatgttgttcctcctaaggggctgcaaaccccttcagctccttgggtggcaggtagatctctgagttctgttacacacacacacatacacacacacacacacacacacacacacacacacacacacaaatgtgattgggcgtcatgttgataaaggatggacttgtggtggatattcttagttgtcaacttgactggttctagaatctactgaaatataagaagctggcactccttttaaggaactttcttgatcagatttttttttttttttgaagaagggagatccatcctaaagtgggtgacaccttctggtggcaaccaagataaaaggacataaaagaaaactttggcttttttcttgcttgccttcacactcactggcaagttctcctatcttgttttagtggcattcattcactaatatcagaacctgcttattcaaactttcattgtttcctgaagaccaacaaccctcctaaactgcattctgaaagccaatctaaacagcaatttttaactacttacaaaatcttcctttaaaagaactcattctaggccagaaaccaagctctaatgaatacaaaagaaacaaataatttcttatatcttatcaaagcatagtaaaacaaaaccagagatcaatagcatggaagaaatgaggacactatataaacaagtggagaataaaaagtatacatttgagtgactagtgtgtcattgaaggaaataatttttttaattcctaaaatcaactaaaactgaaagaacaatttatcagaccctttgggatatagcaaacgcagtcataggaaagctcataggtgtagatattcacattaaaagaattaaagtcatctcaattaaagaacttaatcatgaacctcaaactcttaaaaaagaaagaagccaaactaaaacctagtagatggaaaagaataatgaagatgagggtgggtattaatgaaatgaagactaaaaaatcagtacaggggattaataaaagaagaaataatgtccttgaaaagtaaacaagactgacaaagccccagctaaactaaccaaagaacaaaaaaatcccaggttaataaaattatagataaacatgataacattacaacaaattctcgtgagatccagagggtcattgaaaactactgtcctgaaaaactgaaaaatcaagaaatggataatttcctagatacaaacctaacaaaatgaacttaagagtatataagacattcaagcagatctttactaaacattggaaatgaagcagtaatattctctcaacaaataaaaattcagagacacacaggtttactgcttttttacatatcatcatcgttgttgttgttgttgttgttgttgttgttattattattattatatttgcatcccaaatgtttcccccttcttgtcccctccttcagatcattctccctaaccccgagcccctttgccttctagagggttgggacaagaaggggtaaacctttgggtatcctcccaccctctggcatcaaggctctacaggattaggtacatcctctcccactgatcgcagtgccagggacttgggagcagcccttttggttggtggctccactctgggagctataaggggtccaggttagctgacactgttgctcttcctatggggttgtcatccctttcagcttcttcaatctttcccctaactcttccataggggtcccaacctcagtccaacgttaagctgttaagtatctgcatctgtctcagtcagctgctggtaaagcctctcagaggacagccacgtctgcaagctcatctatcttggcatcagtaatagtgtcagggtttggtctctgcacatggaatggatcccaagttgggccagtcacagagtggccttttcttcaatctctgttctactttatccctgcattttcattagacaggaacaattttgggttgaaatttttgaaggtgggttggtgtacccatccctccactgggggccctgaattctgctttaaaaaaaaaaaacatttatttttttattgttactgtttttggtggtggtggtggtggtgatggtgtgtgtgtgtgtgtgtgtgtgtgtgtgtgtgtgtgtgtgtgtgtgtgtgttaggggtaggggaggcaatgtctataaacatgcgtataggtgtgtagacaggtgccaggcacagagtgcctgtagaggtcaaaggacaacatccatgagttaattgttttccctcattgtggggattccagagatggaattcaaggactgtcatcgggcttttgattaaaaacattaaataaacagaagtatatggtttctctttttaaaaaaaaaaacaatggtggaattttcttaatccattgcagcagttctttagcacttccaatttgttaattggacccttgtagatacttaaatattagcagattgtctttaaaatgtatttcatttatcttaaataaaagttgttggaaagtttttggtgccaatgaagatctaattgcactaggtttggagttaagaggtcagactcattgtctttttttctatttgctggctgtgtcactcatctgagaatgataagagttgcacttcttcccttgtataagacaggtgctttgtaaattatgaagttccatacatgcggtgggatcagaagaaagtcattaaatttatagaatttaaataccacccctttgagaaaaaagaaaagcaagagttagagacataatgaaaaataaatacagattgtcctaaatattatcctaatttttggttcatatgcactaagaacagatccatggtctaattttgactcaattaagggggagagtttcaagggttgaggaaatgttgaatagtctcatatctgttgaaaatagactgttcaaaatatgtattgattgctatcactattttctgagttctgaaaggtacaaatggacttttaattagcccatgttacagcactgatgggatatgagctttcccactgctgctgttgtattatcatgatcaagctgtttgtgtacttgttgcaatttcatgttcacaagcatgttgggaattttgtgcattagcagagccactcagcactcctgggcattgtaaccctgttcctcaaacttcatctttgaacagtattgaaatataataaattaatccataagattcccataagcctaaaggttctagaagaggtcctagaagaatgtccattacacgtccccatcctttaactatttgaggttggatttctgaccagcactgtcttagagtttctattgctgtgtaacactatcaccaaaagcaacttggtggggggggtattttattacacttccatgtcattgttcattatggaaggaagtcagttgggacaggaactcaaacaggccagcaacttggaggcaggaactgatgcaaaagccatggaggggtgaggcttaatggcttgcttcacaagacttgttcagcctgctttccttataacatccagaacactagcccagagatgacccaacccacaatggactgagccctcctccatcaatcactaattaagaaaatgcctgacagctggatcttatggaagcattttcttaattaagattctctgctttcagatacctctagtttgtgtgtcaagttgacataagactagccagcaccaccacttattttttctatataagaatatttgtttagctagaacatccccatatgtgcttgtgtctccaaagtttagcaagcacattttattcgatcctatataaaactggcaggaaatgataataaaacctactgtaataataaccagtgatttttgcccaccaccacctgacattattgacatgtgctacagtccagctccatccattctttcccagaagtggcctcagaagaagtacatttgtcctcttcaggcttagatgtgtttcttctgaaatatgtaattgaagtcttgatgatttgagaaggaaatgagggatgtgaaaataaataattaccaccagttggtaacctcataaaacttagcttttcatggaacccataaaatagcatgcaaagtgtattcaacaatagatactctcttaaaaatctccagacatcttcaaacacattcatgtattggggtaactttagttcaaacatagtttaacatgaataaaatttcagtaggcatctttaattggaaacagaaacgttgcttctgtggcagtttgtggagaaccattcacaactagttttgttacagttcattttagtgatttttctgtatatggcagcagagatcaaatcaaggctttgtacattctaggtaagcactcaatcacctatgctatagcttttaaaaatacttcctttatttttgaagattatagtcatatcatttcccccttacctttcttccttctaagccctcttatatactccttcttgttctctttcaaatccataacctttttaaaattaatttttgatattgttgttattgttgttgttgttcttatatgtgtgtgaaaaactgaagtagcccgttcagatgatgataacagtggaaattgtgcctgttttattggttgactgatgagttgaagttttcattaaaggcacaaagcttatgaatgggttttatgaaaaagagagtaccgtgataaggattattcatgtttactaagatatctaacccaaggctggggagatggctcactagttaagagttcttattgtgcaagcaagaaaaccttagttcaaatccccgaacctacagaaaaagccaagcataatcaagtgcatgcctataactatagccctgaagagggcggagacaaggagattcttgaggcttgctggccttcagtctaactataccttgaatgagaggtactgcctcaagggagtaaggtggagcatgacagagcaggtgccctcctttgacctctttgtgggaatgtgcacacataacacacatgcacatacaacacacaagcacacgaagaattccaagccagaaatagagaaaaatgcacattaacatcaatgaacaaagttttaaatattgccagcctgttcgtagattatgctatacatatatgtttagacaagtgttatttataaaatactgggagaactaaaaaaaatcaacatctgatttttgattaacatggaataaaataaggtttgctaaggggcgtttcatgccttaataaagtttaatttatatatagattaatttaactacagcactaatcacttctaccccctccaaaaaaactgtttcatcctacctgcttatactcatattaccttgacttcccttcccatggctaacctcttctccattgttttcttttcaaaatatagaaatatgtacaactgtataaacacagcttgtaatgtttaagtctgcactagttactttttggttgttgtgacaaaacaccatgaccaagacaatttataaaagaaagctcttaattaggattacagtttcatagtgtgagagtccatgatggtttgtgtgttggcatgattgtaggaatagctgagagcttatatctcaaactctaagcaggagacaacaaccgggaatggcgcaacacttttgaaatcccaaagctcaaccccaatgacacccgtacacacaaagcttcacctctttatcctttacaaatagtttaggcaacaggggaccaagtatttaaacatatgacccatgggagccattctccttcaaatcaccacagagatgactgtcatgaagcataatacctttgagatttctctaaacttttgcaactaacacactggaggatatctagggatttttttccagctttgggtaattatgaatagaattataaaacattcaagtgtatttatgtattttcacttctctgggataaatgcctaggagtagaatttctggcttataaggtaagtgtatgtttaatttcaaaagaaactgccaaactattttccagaggagtcatttttcattaacactggtagtacaggagaatggcaattgtttcatacttttccaaatatttgatattctcaatatttttcctttaattttagccattgtagtgggtagttaatgatttgattttaatttaattttgcatttaatggctaatgatattgaccagttcttcttatattaaattacttacttttactttgtaagctaagaggaaaatttaaattttgatataaataggaatttagaaaaattttggttggacagcttcatgtatttatgtaataaattttagtcattttaaaaatctttcacccctctcctgctggaacccttgacaacaagtcccatactacttccatgtcttttgtttgtgagtcactgtgcttaattagtttttgttgttgttgttgttgttgttgttgtttgtttgttttctcagaacatgcctgggaagttatttattggagtaacttattatcagtggttataatactgagaaaaaatggcacccctctcccaacaactattaattgccaatagtacctcagggaaagtagggcatcaccaatccctccatgaatgggcatttttaacatcaaaaaagtaaatagaatcataatggtgatttctaaaattagagagaaagagaagagatggaggatgggtagaagattctaaaataaagtttgacatgaagaatggagtctagtattctaaagtacattaaggtaaatatagatttcaatatcttatgtattatatgcataaagccttaaagataggatttttgtagagtcagaatataaagaaacattaaatattaaagaaatggaaatgctgactaccctttgatcattacatattatacatgtatccaagtatcacactgtatttcataaatatatacaattttgtgtcaatggcatttttttttaaaaaatgtaataaataaatgtgccttcatcaaaggttcagggcatcatgttgactattctcattttaccccaggctaattgaaatttgattgtgaatcaacactgatctactgacaagactttagaaacccaactgttcagtaccaggttttgttttgttttttttttgttttgttttgttttgttttgttttcttttttacattaaccttattgctatcagaaaatttagtgaatcccaccagagttaccacatgttgccaggaaatttagggtccttccccaccgccaacttcttaatttcatgaaggaaataatttaaaatggactgaaatgaaaatgaaaatgaaaaagacaatattattattattagagtttaaatgaaaatccccccaagtggatcttggcagttgcccaaggagggaaatggagaataagaagagtgaaatccatgctgtttttaagcagccacattgcagacaaacaggtacaaggcagaaaggaggacttcaaagaaagaggaaaaaccccaaagaaccaaagaaagcagacttgggctgtgaaagagaccaaagagagaaaaaaggaaatgttatatctttctgaaaagtgaacaggcttaacacactctcatggtgactctatagcagctacacccagaacagtgtttctaggaaggacatgtctatttttcctgtccgtttagcatggcttcaaagtgaacgtggcttcctgatgggtcatgcctttgccaggaactgactggtaactggattaactcttaagagagaaaacagtagactgcttctacccagagatagacgccattctttttatacagaaagaccctcataggtcttcagtactactgtaacaatgggtcaacacagttaattcagttttactttattggctctgtgcaatttaccagagtcatatgcaaactttctaccatgatggctgaagtactttataatttttctttctattctttctatataaaaatttccttcccttttgagatacttgggagggggaggcaaaaggatcagaagttcaaggtcatactctttctacatatgtggcttgtggatagcttgggatataggagactctgtctcaaaacaaagaaaataaaccaacaagaaataaataaatggatactaagtctgaggaaggaattcagatccttctggccttcttacctgcaacatatccccacatagtaccccctattattctctcagccacatacctcaggactgtacacaagacctaaaaatcagtagacaagtgtcctcccagtgtactatatctgcattttcccttctgaaacagattcttgctatgttgtccaggttggccttccactcataatcctatctcaacctcccacctgctggaatcccaaatccgtgccaccacttctgactctaccttacttactttactgtctctatgtaatcccagcttcatctgtcgtttggaatgttcagcaaacctgcttatatcttactttgttaaactgttagtgattcacacagtatattctaaggagcacttgcattggaatatagtggaatttctaagtgtatgggctcctgtgccttgctatattgaagtgctcaattagatttttcagaaatgggtctcataatgtacatttttattggatattttctttatttacatttccaatgttatcccccttgccctgtttcccccagggaaaccccaacaatcccctacccttaattccatgagggtgttccccccccactcacctgccccactcctgccattccaccctggcattcccctacactggagcatcaagccttcataggaccaagggcctctcctcccattgatgcccatcaaggccatcctctgctacatgcccatcaaggccatcctctgctacatatgtggctagagctatgactccctccatgtgtactcattggttggtggtttagtttctgggagctttgggggctctagttggttgatattgttgttcttcctatggggctgcaaaccccttcagctccttcagtcctttttctaactcctccattgtggaccccgtgctcagtccaaggttggctgcgaggatccacctctgtatttatttgtcaggctttggcagaacctctcaggagacagctatgtcaggatcctgtcaccaagcatttcttggcatccaacatagtgtctgggtttggtaactgtatatggggatggaaccccaggtcgggcagtctctggatggcctttgtttcagtttctgctccacattttctctccatatttcctcgtgtgagtattttgttcccccttctaagaagggctgaagcatccacactttggtcttccttgttaggtttcatgtggtctgtgaattttatcttgactattccgagcttttggtctaatatccacttattagtgagtatatatcatgtgtgatcttttgtgattgggttattttactcaggactatattttctagtttcatccatttgcctaagaatttcatgaaaatgtttttaatagctgatttaaaacattgtgtaaattgtccattgtgtaaattcctctgttgaaggacatctgaggttgaccacgctcctgtggtcattgccctactgcaactgaggcggcacaaactggactcagtaggttatagaaaaaaaaaggatgtaaagttgggaggtggacagtatatttgggaagagttaggggtaaatatgatcaaaatatattgtatgaaagtctcctacatttagtaaagtattggtatttaactactgtaaaaaaaaaaaaaagaagaaggacatctgggttgtttccagcttctggctattataaataaggctgatatgaacataatggggcatgtgtccttgttatttgttggagcatcttttaggtatattcccaggaggggtatagctgggtcctcgggtaagactacatccaattttctgaggaatcctcagactgatttttagagtggttgtaccaccttgcaatcccaccaacaatggaggagtgttttctctttctccacattctcaccagcatctgctgtcacctgagtttttaatcttagccattctgactggtgtgaggtagaatctcagggttgttttgatttgtatttccctaatgactaaggatgttgaacatttctttaggtgcttctcagccatttgatattcctcagttgagaattctttgtttagctctgtacacccgtttttaatagggttatttgattctccggagtctaacttcttgggtcctttgtatatattggatattagctctctatcagatgtagggttggtaaagatcttttcccaatctgttggttgtcgttttgtcctattgacagtgttctttgccttacagaagctttgcaattttatgaggtcccatttgtctattgttgatcttataaaataagccattggtattctgttcagaaaattttcctctgtgcccattggatttgaggctctacccctctttctcttctattcgtttcgatgtatctggttttatgtggcggttctttattcacttggacttgagctatgtacaaggagataagaatggatccattcgcattcttctacatgataaccaccagttgagccagcaccatttgttgaaaatgctgtcgttttaccactggatggttttagctcctttgtcaaagaccaattgaccataggtgtgtgggttcatttctgggtctccaattctatccattgatctacctgcctgtcactgtaccaataccatacatttttatcgctattgctctgtaatacagcttgaagtcagtgatggtgatttcccttaaaagttcttttattgttgagaatagtttccggtatcgtgggtttttgtttatttgttatttcaaatgaatttgcaaaatgctctttataactctatgaagaatttaattggaattttgatggggattgcattgactgtgtagattgcttttggcaacatggccatttttactatgttaatcctgccaatccatgagcatgggagatctttccatcttctgagatcttcaatttctttcttcagaaacttgaagatcttgtcatataggtctttcacttgcctggttagagtcacaccaaggtatatcatattatttgtgactgttgtgaagggtgtcatttccctaatttctttctcagcccaattaccctttgagtagaggaataatcctttgagttaattttatatccagccactttgctgaagttgttcatcaggtttaggagttccctggtggaatttttggggtcacttaagtatactattatatcatttgcaaacaacgatattttgacttcttcctttccaaattgtatccccttgacctccttttgttttctaattgctctggctaggacttcgagtactatattgtataggtagggagagagtgggcagccttgtcttgtccccgattttagtggaattgcttcaagtgtctctccatttagtctaatgttggctacttgtttgctgtatattgcttttactatgtttagatatgggacttgaattcctgatctttccaagagttttaccatgtaggagtgttgaattttgtcgcatgcttcctcaacatccaatgagatgatcatatggtttttacaagtgacacatatatgatcattagacacaactgaatataaaattccatgaatctagatgtacatcatgtatgactctcagtcacaacaatttctcctttctatgaacaatcaaagtctcttttttatttacacatgtcagtaatcttgtttggtcatttcatctgttgtattgttttacaatttaaatgttaggtgtgacttaatttataagccactgaaatacagggattctcttcatatcttgtttattatgttgcttaatatagtgtacataatgtgtatatatattaaaaatttcatatatacacataaaatagtgtgtgtgtgtgtatatataaactttgtacacatttcagtagtggagttatgagatttaaggagaacaattgtttttaatcatttttcaaaggcatagttactctgtgaacaatggtgatgtaaagctttgagaattttgcctttgattcaagatagtttgtactccaagtgctaaattgatttacgcctttgaatattgcattgacacttcaaaatatcttaaatatttgtgatatgaaggggtgatggtgtaccatattcgttccacttgttctttgctatttcaatcataccatcaacattaccatccaccctcccttgctggcccatgcttttcccattatacaagtcccacagcagtttccatctcctctgacttattgttaccacttaggcccacaatccacatgattccccttaccagtgaatctctaatatttcctgttggtggttctgttttgacacctaacatactggttggtaacttgctgacttttcctcctactcattcattgtgaaactctccacaaattaatagcatgatgtgcaagctaacacaggttcctggctgctaaaggttagaaactacttttttaatgctaaagaaattaactaaacttgagataattgttgatgggtagatagcaaaagatgccgcaattcaagttttcaaagaggaaaccaccatggaaatattaaacataggcaatctactggggcattgctacatctacatgcacttacaataagattcttaatttgtactttataatgaataatgatatgagggtgtgattgaagtaatatctttttgttttttggtttttttttctgaatggtaatctatactaggcatagtcaaactgttcatttctggcatcttggtatttaggaatagtttttgtatccaaatccatcatgtgatgagtctcattggttactaatacaatcctgaaaaacagatggcttttgctttggcctgctggtcacaaatttggaggtgtggcttcatattctgaaggacaagatgatcataaatagtatcactgtggcttgttagtagaggtgatttgactcagattatatataaaattataatattatatattatgtatatgctatttttcaaggtacaatggaataggaatggtgtgagcctctgtcacttcaaattttctttaggttagaggatactttatccaacccacaaatctaggaatcacatttagtagttcctttctctggttcatttactctaattacatctaataaagtcctgtgctgtctaactccataccatctcttaattctgtgctctgttcccatatacccttactgctactttcttacttcatggttttctatttcaccaagattggctacttttcagctcttggattgatagaataaaatttgggcaaaagaatacaatggctttctgcttaagcatagtagatggacttcctgcttctgccatttactagaagtttaaaatagaaataaatggataaaaattcctaagaataaagagatgagaagaaactgattcacaaagaaaatataaggaagatggaagagagcaagtattaactacctgttatagaaaacaatacttcaaaacttagtgatttaaaatggcacaatatttagagctctttcctctgaatattgaatttcatatgaatcatttattttcctactatataggaaatggaaaatagatagtatttgacagtcaggaatctgatagttgtttagtctggcacttcagactgaagattgtgcacaggaatatagtgagaatagctatagtcatagataaagctggagaatctacttctaggttccatcataagcttctttgcaggaagcctcagttcctcaccacatgtgtctaatagacagtcagcttgggtcatcttacaacatgacacctggcttctaacagagtaagtgatggaaaagacaaacaaggatgaagccagagtactcttcaaacctcacctttaaacttaacagcatcatgtccgctttattctgtttattagaagaaagtgattaaatccaactcacacatgagaaacatcaagtttcacatactgaatgaaggaatataaacactcgtgggcatacattcaaaccaccacatagtggcaactaagttagcagaatataataactataatatagatgagttcacaatgggtacttattaaaaggagccaatttttccctgagagatttttttcaagcattagcttctacaatttagagtgatgttcaaggctgaaaataaagcattgcttgaaatccacgtatgagagagctgatctctcatgtctcttcacctccacacaaaccacatcaccactagcaccattaggaaggagaatggagctttagtctctaaaacaattaggtaaaaatctccatgttaagagatgacaaactggatgctagtcttctcttaaaatgctgtgcattaaattatattccttaaacctcttttccatttcctatgtagtaggaaaagaaatgaatcgtaagaaattcaatattcagagaaaagagctctaaatactggtatatatacccccaatcaaataaatgtcagtttattcctaatactcccacagaatgataatccatcggcagttccaaccgtgcacacaaggcatataaccaaggattagcagatagttaaggaatccttaaatcctaaaaataggctaaatatcactgaaacagaacaaaacagttgttggatggtacaggaaattgcaaaagctattacacatgtgtatatatctctacaacacacatatgtatatgtataaataagataattgtgtaatatatttaatattggattaatatgtatttggggatgataaaaatggaattagctggctgtgatggcacatgcttataatcaaggcacttgggcattggaggcaggaggattgggagttcaaggacagcatgggctacatagtgaaaccctgttttacaaagtcaaaaactaagggaccaagctctaaaatttggataatcctaatatatcattgcaacaactgacagctgcatttatgttgtacaacactatcattctacttgattgtcttaaacaactaatggattgacctgacatttctgctctgttctgttgtgttctggaactagcttattaaaactaaatttaaataatatattttgattatattgttttccatcccccaacttttttccatctacatattcacccaatttcgtgttctttctctctggacaatgtgcagagcttggaagactttggaacattcagttctaagtgagctctttatcacacccttcccctcaaggctcaggaatctatgtgaaaaaggaggcagaaagattataagagtcagaggtagtggatgtatccaaggaaacagcatcatttagacacagagggactgagcccatatgaactcatggagactgtgggagcatgcataagacctgcacagattcaaaccagacaaaaatctcagcacagaaaaagaaggggaagtcaacacaaagttgcaaccctggccaagaagctttttctgttctttatttacagtatttaaagaaaaatcttcgtgtgtttctacgcactaatgtaagaaatggtttctaggaaggagctaatttaattgatctttatttcactgttatctttaatgcctactttattgggataatttatatacagacatttagctttttaattgtacagttttgatatttgaacaactcatagagccatgtaatcagccttgcaatagttgtataaaattaccccatcacccataagttttgtcaagacccttttatagacagcttttacacctatcatcagttctttataaacacttatccttttacctctaggttcaccttttccagaccatcttaaaagcacacacatagtgtatactgttttatgcatctggctttttcatgtagcataattcatttgaggtccatccatgtaattgtgtactttaactattcatcatttttgttattgtatgagattccactttatgcatacaatgcattgattatcagttcaaggatatttagactgtttccaattttttggggagtgtgtgtgtgtgtgtgtgtgtgtgtgtgtgtgtgtgtgtaggtaggtagatatttgtgcatctttctgtatgaaagctaaagaacaatgttgggtgttttcctcagtcaagtaaactagactgtctggccccaggaagcctcctgtctgcacatacctagcactgggattacaagtgtacatcgccatattaggacaaacgctttactgcctgagccatcttcctagccccaagctgtttccaactgtcaatgattataagtacagcttttataagcaaccatgtatgagattttgtaagcataatttgtcatttctcttgtaaatacataggagtagcattactagattgtatgaaaaatgtgtgcttaattttagaaggaaatatcagctattttccaaaatgaaaataccacttatgtatctatgaagaaatgcataagagatactattgctctttattgtttccagcactaaattcttagctttttgttgagcattattattagtacaataccattcaaaaattcctacttcatgaatcataacctcaaacattttaaaatctacttgtatttctattgcccatttttaatatttaggtttgtttatactgagttttgagagtccattgtttgttttcttttcttctgcttttctagatagaaacaaaccctttaaaagacatatgatgtgtaaatattttgtttaagaaaactcttgttttcttagaagtgactttagaacaatgggattatataatagttttgttggtacggtgtctcactctgtagcccaggctgaccttaaactcctagcaatagtcctacttctgcccattaactgtgaattatatgaaccaccacctggtttgtcatagtaagaattttgttgaaatcagttttatcaagttgaatctcttagagattgcattttggatattgtatcagttttggtgtgtggtgtgatgtgtgtgtgtgtgtgtgtgtgtgtgtggtgtgtgtgtgtgtgtgtgtgtgtgtgtgtgtgtgtgtgtgcgtgcgtgcacgggcaggcattcagaggccagaaccaagtctcatgtattgttccccaggaaatgtgcacttagtttttgttttgtttttaaatcggatcttctagaacctagagcttaccaaatagtctaggctggctggctagtgagccccagaggtgagtgtgtctctaatccccagtggtaagatgataagtgcaaaataccacacccagctttttctgtgggggctggggatcatacgcaagtgctaatgtttgcacagcaaatactttacctactgagttctctctcagccactatgtgccaaatgaggactacacagattttctttttagttatctatttatatctttatttgatacttctttattttaatgtaaatataattgcttcattttctctcttccctgtcctctctccaatgtcttctattcccactttcccccaactccctgtcaaaaatttaattctgcttatttttttgttattaacacacacacacacacacacacacacacacactggtggaatgagatttcaccaatgagagagagagagacacagagagagagagagagagagagagagagagagagagagagagagaatataaatatgtatattgtgcctggttatgagaatgggaccagctaagctacaacaaatggaatataaaccaaattctttgtcctattgagttaatataggaaacacatatgtattgtcattaatctttttagacaaaagaatgtttttgctagtcccttgacctaatcaccctgtactttggaaagcttggctctcttacacgtaggataagtgaaggaccatattgagataagaaatatctcatccttgtcctgggtaggtgatataaaaaggggggagggtatctccaacaacaactgggtatagcctgtaaattcctggtgaggaaaccagtgttgaaaaagccacccccatgctggcagtagtgtgctaaaggagatgggacatgaacttgctctctgtgcatcagaaaatcctcaaggtgtggtataaggcaggagtgactttctgcctcaatgactgaattctatcatttgtggtgacttgcctgataagaaactaaaccaatggatatcctatccatgaagacctagagtggcaggcttagaaatcagtatatatggctataaataaaccagagggaaagatgggtttatactagaaaattgcagagaaaattagacagaaatgaatagaagttttgaaaatttattttgcattgagccagactcctttcaaagaggaaggtttctggtagcgtctagagccatggttctcaaccttcctaatgctgtgacccttaaatacagttcatgttgtggtgactcctaaccataaaattattttcattgcacttcataactgtaatttggcgactgttatgaatattaatgtaaacagggtttttttttttttttggagatactggtttgccaaaggggtcatgacccaccagttgagaagcactgatctaagagtctgttctcttcagcattacctctgccccctactgtggcatgtttagtatacttggatgaaggatcttcactcttcattcactgcttgaagcaccaatactatatgcagggaccctcttggtgctcactatttcagtttagcagcctttacaaacagtgatttttgactgctctatcaggctcctgtcagcaaaatcttgctgctgcttcttcttcttcttcttcttcttcttcttcttcttcttcttcttcttcttcttcttcttcttcttcttcttcttctcttctctctctctctctctctctctctccctctctctctctctctctttcaagacagtatttctctgtgtagacctggctgtcctggaactcactttgcagaccaggctggcctcaaactcataaacccacctggctctggctctggctctgcctcccaagtgctgggattaaaggagtgtgcctccacaccaggccttgctctttcaattagatattttctttatttacatttcaaaagttatctcctttcctagtttcctctctgaaactcccctatcccctccctgctccccctgctctccaacccactcactcctccttcctggccctggcattcccctacactggggcatagaatcttcgcgagaccaaggaactctcctcccattgatggctgattaggccatcctctgctacatatgcagctagagacatgagtctgaccatgtgttttctttgattggtggtttagtcccagggagctctgggggtactggttagatcatattgttgatcctcctatagggctgcaacccccttcagctccttgggtactttctctagctccttcattagggaccctatgttccatccaatggatgactgtgagcatcaacttctgtatttgccatgtactgtcagagcctctcaggagacagctatatcaggatcctgtcagcaagcacttgttggcatctgcaacaatttctgggattggtgattatatatgggatggatccccaagtggggtagtctctggatagtcattccttcagtctctgctccgaactttgtctctgtaactccttccatgggtattttgttcccccttctaagaaggaacaaagtatccacactttggtcttccttcttcttgagtttcacaaacagtgattttttttttttgattccagaagtaccaggagaaaatggattgtttacattggagaaaacagttaaatattccccatttgtcattacattccttttcagtggagggcaatgactgatattaatctggtggtttagaacagacaaatgcctctgttaaggggtaagtctgtctttaagacttaaatttagggatgctttttgttaatctgtttgtactgacaagtctcctggtgtacctagtttacaacagaaatagtgatgtgaggatagataggttactggtttcacctgtttatgaggtcttggcgaagagatgccatttcactggcttcaatcctgctcaatttatgtaaagatcataatcttgctttccttgaagaaatctctctgtatacaaaacataacaacagccaagtacaatgtcatgttagttctccaaagagcctttgagttctagggtttgcttctttgctattattcaactactaaatatgtagtagttaagctttcatcaataaaataagcatatttgggcaactttaactttctcatccatctgttgaaaaatcttagcctctcaagggagagcaagtggagatggtaacaaagcccagccattgcgacaccctctactaaacaaaatgtcatggcaccacagaaaaataactaattattaaaaagacacttaacatctgatttggctgcactcttgcagctagatagattctttttgtcctgaaaaatctttaaagactagctcttagaggctgatcctgagaagttgttgcaggggagggagttccttcccagtaccccattttcactccatatccacctgtcccttactagataccgcctttcattaaaaaaagggaaaatgcctcaggccttgcatgcggggtgatagtgatccttccaaggtcactgacagcaatcatgatcttgttattttctttaatattaaaacttagagtcttagaagagatttagccattagttctatccctactagtacatcaaggctctgtcctcagcctggttgccacagttgcttagctagatttcagatccctggcattatattcttctttcatccacccaaatcaatttttctgttctttgccccagctctctttactataatcacaatgcctaaggatctttacttgaagggaggagatttgtgttattatttctctttaaagttaattcagcattgattccatttttaaaaggctgtatacgttgccattggaagatctctcgaatagtgtagttccttatgcaatgcatattccacagattaaggcaagtatcctagattccaaagcaaaaccagttctcccatcaggagcagagcataactgcttatctgtactgcctgagaatacaagggttggccagttgctatatacacttaggtctctcattccaaactgctgtataatggtgaatagaggatacaagcaacaagtgtgtgttcaagactgtttaaatttgtattctgctgctattttacatatgtctgagggtaaatatggtctaagggtgtacaagttgagcgctggattagcctccagttaaagttttattttcattttggtatagagattacaattttcagtagaaatgctgattgacttttctcagtgaactcttaagtacctagcaaaagcctgtgcccattagagaaaagaagcatctatcatctctacagtggtttccaacttgatttggtggaaatgaacactagcagtgcatgttccctgccttgctataaagctcaggctgacctcatacttcctatgtagtctaggctgtctcaaactcatgctcctcctctacatataccatcatccttataaccactttaatgttttttaatatttctttatttgtgtgtgagagatacaaagagggagagagagacagagagagaacacacttgtcttgtctgccatggcacatgtgtagaggtcagaagacaatcatgaatgagttctttattttaccatgtgggtcctgggatttgaactgaagttgctagtttttataacaagtacctttacctgctaagccatctcaccagccctgataacaagttgtaatattagaaataaacaatattggtaatgttttgttaaactggttactgaagggtataaggttaaggttttatataatagtataatctttttcctctccctatgagcaggaattgtttacatttctcaaatgattgcctagaaaatatttccacaaaggaatatggtatttcttctatttcgcccaaccccacatggctcttatgtacttatcacctctcctgtgttttgaaaatgattagggagccagaataactggccattccatctgaattgcccacatggacaataggccatgttagtcagagaaaactcctctctgcacctcacagtccattagcttgcagcctttcccataagttaatagaaaccaaactgtgttccctttcatttgtacttgttctctctctctctctctctctctctctctctctctctctctctctctctctctctctgtgtgtgtgtgtgtgtgtgtgtgtgtgtgtgtgtagggttgatgctttttccaaattaaaaaaagcaaggtctcttctaagtgcttgtagaattataagcagaattttagataacatatttagaagtataaataacattcttaggtgtctttgatcagaaaagcagtcttacaactaagcttttcctaaatcatattgcaggtaactgagtgaaaaactgtaggcttctgcattgtatttaaaataaaaagtacattccccgtgtagcaaatagtagtaatagctcatctagtctctcaaaatggaacccagaaacataccccagtacctgtctgtagatcaactttcaaagtaaaagtgaacccataatccatatatttacaatttaattcccaagcttaatgttactaagagatctccattctgtgacaagttgcttttgtcattttcttctttcactcccacacccacctttctggagtcctcaggagcttcacagtctcagagcagaggattctgcatagggtataatgcacagacaccaaaagtgccagaaaacgatagctgccttgaattttcccagcccagtttcagaatggattctacattttcagtatcttctttataagtatcagaccaaagcccagaccaactgctacactgaaagctttcttttcttttcttttcttttcttttcttttcttttctttttttttttttgtaagaggaagcttattgttcttttaagaatgtctcaggaaagttgagccattgcttttggtgggtaagtgtgcttgcagattagtgcatgtgattgcatgtgtgggcatatgtttgtgcttcagctgtgtgcatttcacttttagacaaactcatagcccaggctgctggggaccagatgttcctaaggattcttagaagtaaacagtgacaagtgagcttctcaactcagtattggagtctggctcgaggaatgaggcccctctgtaaatcagagaggagagcaacagcagaaaagatggatatgaaaccacagatattgtaatctcctcagtgaaaaaagttgatccagcaattcccactggatccatacatgttgtaatttattattttatgactttatcttttcctttaacctttgcccattgtacttttgaaaaaatgttgggatactgattataatttttaaaaactgcaaaatatatgaatcagccccttgagtcatttttaaatgttatatgactataattagaggtttttgttatttgccttttgaagacaggtattattattttataaactccagcacaggttagaaagttcactatgaaattaactttatagcatcctattttgtgggaatttgcatgtgagatttttagagttctgagaattttatacatgagcataatatatttacatatccaaccctccctctctccccatatttctctcagagtaccttctgcatgtctatctttcaaattcatgtcctcttgttctataaatgttattaaatctacttagtgttatccatatgtacatgagtttagggataactactttggcatggactcatcaagaggctcatccctgaagaaacctgactgtccttccctcgaaagctgttggtttcctgtggatcttcaagccagaagtagggtcttttgaatctttacttcatccatgtttgaatgtctctcagtatagtctcatgctgatcttgcgcagacaagacactatttagagttcatggatgtggcatctccttcaggtccctctggctcatactatcatttttaatccgtttccattggtaataggtgaagggattatattacaaatctactgatttgggatgcacaccccaccatgacttattctctacattggatgaattacagatcactaaagaagcccgtgtctgctacaaaatgaagcttctttgggaagtgacatacatgaagcctgtgtttatgtatggatttaaggataagtatttagaacggagttagatactctatcagtttagcaaaatgatagtaataggttctcttctagtgtctatgactactccaaccacaggttcttgactaggtttatagtatcagccatgagtctcctattattgagtagaacttaacccatatcagtgagatgctggttaccccaagatattagtgctactattgcactactgaggatatcttgctagttgttactgtagttcacagaatttacaactgagtagaatcagtgatatttttttctcttctgccagcttgcatactaagtaccttaaagtaatcataggaggcttgcaggtccatcccagctctatttatccaactcctgtgaccagtgtgctatcttcagcaagagggtttgactcttttaagtactagcaggcaaccaaaactaacagcaatagcctgtattgttgagggaagtctttagtggcctgtggctaacaacttgcaaggcactgggcttaaaaccagaattcctgcgtcaagtgtatgtgagaatggttcttctgagtgagagaattggattcaattcgaatcaattcccatgcagaggaataaccttctttgaagagaatggaaaatgtgttctatgctgtctcagagaagcccacttcccaggcaccatggctaacccaaaggtcatctttaaatctaattctccaattgaggaggaaattgttgcacctccatgcttttgggcatgtaaaataaaatttcttcacataaaaaaatagaactaggtaactttgggagtcttcccattttgcacctgtagcccatttttggagttggacttgccttgaattcagagtgatgccagaagaaacatttaaaagttacctctagtttgatgatacttggaactctggacttcttgtgtttttctgataccctttatttcttacagtcttcaaatagctgcttaattttattctgtgtaattttacattggcatttagtagaaaggacaggatactatatagtaaccccaccctatgtgaaaccaggacccacctacagatgctttagacaggaaatggtattctgtaacatttttaaaggaattaaattgcaaccattttaaaacattttccagagaacatttctttgtttagacccaggcttctgtctaagattttttttctccatgaagaaatcccttctatatttattgaaatgcaggttttctgatatgacttctgttggtccttatctgaacaaaagtattgtttgatttttattttgaaagatagttttggtagggtggaaagttctgatttgattttttgttgtgttttctgctcccatgccatatggagtgtcactccatgatcggacatagtttctaacaatatgtgctataatcacctttgttttcccataggattatattttctattcctttaggtattgtcaagattttatctgtaattttaaacaatttgatatgtctatatgtttttaaatgatgtttatcctttttggcattttctaaacatcttgcatgtatgttttagagtctttcattgattttgtaaaagttttaaaaaattatttaatattaaattcttttttaattcttttgttactctacatacatatatgttaggtcttttaatatggttcctcagcaattggattttctattttgcttacttattttctgctcttactattcaagtttgtacaaccttcattggtttatctccaaattacctgaggtaattaaaggcattctttgttattttattgattacttttcttgttgctgacaagaagcaacttaaagaaagtaaagtttatttccagatcacagttttgagttgagggagcccaatctggcaacgacctgtggcagtagctccctccaaagtggctggaccatgagcctggaatggtggaggtagaactaagagttctacatctgaaagtgctaggagaagactggcttccaggcaactaggataagcctatacccagagtgacacacttcctcctataaggccacacctcctaatagtgccactccctgggccaggtatattcaaaccaacacaagtcccttcagttttgatcattgaactcccactacaatcactcattaatctctgattatggcattctaggggttctctagccccagttccaaactcttctgcattccacttctaaacttattccaaaggcctatgtagcacatagcaggtttaccacagcagtaactccactttgatactagttttctataacatttgcttttctcatcactgtgacccaaagcctaaaaagaagcaacttaaggggggggatcattttattttggatcatgatttgagaagatatcagcatcataatgaggaaggcatggtggcagacatctctaaaacagcaggagcatgaaactcagaattatcatattttcacttcattgcacagtaactagatatagaatagaaaaactaaggataggctataaaaccccaaggtctgctctccagagatccacttcctgcaactaataccacattccaaagattctacaacattcctaaatgatgtcaccatctggggactaaatgttcaaacacatgaatctatgggggggggcattttatatccaagctgtaacaattattctgtttcaattttttctggtgtgctgcccacctttttcattaatgcctataataatattatgaaaattacttaaattttactttcttgtatattatttcccaaatcaacataattcaattgtttaatattctctctctctctctctctctctctctctctctctctctccatatatatatggaatatggactgcatcaaagtgtttggtggtagttttttttttgtatagagcaatggagattgttataaacaataattgttttaaaggcagatggccatccaatatttgacaaaggcatcaaaacatagactgtggagggaggagacatcctattcaacacatgttgctgacaaaattggatatccaactacagaagaatgattatgtcctgacttttcaccatgcagaaaattcaattaaactaagccaaagaccttaatttaaatcccgcagctgttaaaagaaaacagggaatatatttcaagttatagggatagttcaaacctttctgaaaaggctctaatagaaaagaaaacaggaaatagtcctcaatgttaacaaatggaaatacataaaaccaaaaagtttctacatagcaaaagcagctatcatccaagtgaacagacaacctgcacaatggaagaaaaacctttctgagctatacctcaggtagagtgttgacatctatataaaaaccataaaaagtaaacacacactctcaaaacaacaaaactaccaatcagtaaatgggctaatgaagtaggcagttttcaaaaaaagaaacaaatagccaataagtattgttttaaatgtttaatactcttagtcatcaagaaaatgaaatttgaatgcactttgaaattacatctttcttctcaattagaatagctattataaaaatatgaaggagagtgcaatactgtgtatgaaagtagcatcatcactaaaataactatcattttgagaaataccatgaggacaaaacctaatgacttcatggttcttattgattacttttctaaggaacatgcttcattatttatatttaagagttttacctaaattgatgtgtaaaaattatttttcactgattacatatatactgctgatataagggtatgtggaaagaaaaactgttttcactgctggtgaggatataagctaatacaaccattatgggaataagtaagagtcttctctacctctgggcaagtgcccaaaggactgaatgtccctactacaaagatacatgtttatttctgctctgttcacagtaacaaggaaatggaaccagcctaggtgtccattaactaattttaaaagtttcataattccaatgagaaagcccatgcctatgagtagtcctttccagcttccagcccctgtgtccagcccttagtaaccaaacatattttctatctctatatttacctctttggaatgcttcatataaataggattgtataaaattatgatcatttgtgactgatataaaaatgaaagaaactattttccatctttatctaggaagtaaatagcattatcagcaccccattgtttcttaatgctgaacaacagtcctttgtatgcttaaaccgattttgtgtgttcatcagatggacattggagttgtttctaccttttgactattgtaagtagtataaaatagtctcatgttttggttaaatttttggttaaatacctagttcagttcatttggacacgtacaaacaattggaattacctgattatctatatttaacttttcagagaattcttctttgtgaaatggctgcaacattttgtgtttctgctattaacaatagaaggttttaagttctccaacaccagtatttattattgcctctattttccattatggtcaggctagtgggtacgaagtgatatctctggagtttaactcaaagtttctttatgtctagtgatattaagaatatctgtgtgctttttgattattgtgttatcttctccaaagaagcatccactcaaatccttgtcctaatttctaattgtttttcttttttgccatttatcttgtagcaaatataaacaacataaaatttaccattaagcatagttttgtggcattattttggaaccatctcttctatccatttctaagaactacttcatcattccatgctaaaactctaaccctcatacaccccaccctctgacagccatcattttcttttctctacagttttatataggttaacacatataaatagaatattacaatagctatccttttgtggctggcttatttaatttagcagagtatcttcaatgttcatccatgatgaggaatgaatcagaattttattcctttttaaggcagagcaggagagccgtatcagccatatgacagtatacttccccagcaacagaaatttatacccaactacaattaaaattactttggggatccttagaattcagttaagggtttgaactttggtggaaagcttattttaagagggtgtcagatttgccaacctttgtcctatttcctgaggctccatattctaataagctgagctacaagtctacttagtattggtattgctactaaaaccatctgatgggtttcttttgaaggagttacatatacctgtacctcaaaggataagcctgcacacattaaacctcacctgtccactggaaatatcaaacattctttgccgtagtccaaggtcaattgtgtgtgtacaagtattcaaagagaggtatacccctggattttggaatcagccccttccctgcctctacagaaattcagagacaagcatgtttatctgtatgtaatcttataaccagggagttctcatggaatatcccaaaatggacctgaaatatatttttagctcctctcaaccttgatttgaaaacagtctaccactcagagactttgcacactggaactgtccacacagcaagggacactatcatgctctagtaggtggagccaactttcttaccactatgaatcttgaaactgtattagtaatcagctctagctcctctcagctatggtctgtgagtagatcttcttgcttatctagggaatagtcaatagcctttttcatccatgagtacagagtaaaattcctatagatcccaggtcttagtctcagctgatgattctaaacctcccagttccagcagtccagaaaatgtacagatagctttaacctgttaaaatcagtctagaaaaattcaaagagtcaggtcacgtggtgcagaatactgaagtagaaggatcagaaattcaagccctgcctggtctacaaaggaaattccaggccaacccttgcaatggtgacagacgtaggtactgtctgactacaatgtgttgaaatatatatttcacatttccagaaagtaattaactgcccaaattcagttataagatgcatgcacacttcttgaataaccacttgtaaatgttggaatgtaaaaaaaattaactgggattatggatgctttttctgcagaacaggttagttttaggtataaatgccctccctttgttagatatgaaacaatattcagttctctttcaccttcaaaagactgacagtaggtggaaacgttgcacatgcagaatgtccttcctgagttttagtttagtagtaaacgtttcaaattccctcaaaagaaattggagaaacaaatatgtcacctgtgacccatgtcacagcactgagaggaggatgaagaagcatcagtatttattgcataacaaattgccaggcagcctacaaaacatagtgagacaaatacagacacagacacacatacacacactataactgtatgcatgggagggaggtaaaatgggagagcaataagagaaggtgtggaggagagagttgtcagaatacattataaaatgtataaaattgccagaaacaaaactaattagaaaactatatggcatggcttctcttttagaaatgaactaacaaaactatcacatttatactatgactacaggtactattgtcccaacaaagctggaaaccagtctcccacttataaagacgtaatttaatgctaggattaatgaatttaaaactgaagataaaactcattgagaaatgtagagatcatgtagaatttgacccatcaatttttaatatcaaacattgaaattaggttccccatttttatatgaagagatttcaaataaacgattaaattgtcagctcttcttggaagccagacattgtggcaatgcttgactgcttggctgctgaggagtgtgcagatcattgttcactgtgttgtatgtgatgctaaggtgcttgtctcctacctatcaatcattacagttacacttgtgttacatgtagcagtcaatttcattcatttatgttaccttcctggagccttaatcacatgtaatccagttctcatccccttatgttctctgtatttcctaagaatgccataaaagttactatgaacttggttgctcaaaatacatatatatgtatatgtgtgtatgtggtgtatgtatatatgtgtgtgtgtgtatatatatatatatatatatatatatatatatatatatacatacatacatatgtgtgtatgtgtgtatatatatatttaatatttgtttatacttatactactggaggtcagaagtccaaaatcaaagactattcaaagctgtctatgtcctttttctgtggcttagttgctgaggtctgctagcaaccttaggtatctgttgatttgtctttgttctcacaccatctcctcatgtgtgtctatacggcttaagttctcctttgcctatttcttataaggacacctggatttggatttggatttggatttggatttggatttggatttggaacttacactaaatgcagcataatatatcttaagttcgtgaacttatatctgcaaggaccatttctctaaacaagaccacatttacaggcaataaagttgtagtataggcatagttttttgtaattactattcaacccatcacaaccccatttacaaataatactgaaagcaaagtaggtttatgcatgcctgccaaatatacaagtatttgtgatagttcattcaagaatcttgatttctgccgggcgtggtggcgcacacctttaatcccagcactcaggaggcagaggcaggcggatttctgagttcgaggccagcctggtctacaaagtgagttccaggacagccagggctacacagagaaaccctgtttcaaaaaacaccaaaaaaaaaataatcttgatttcctgacactcagagtttccttttcattgatttatgcctgtattcacccctgatcaactcatgttctaaataaaatataaaacagaaacaataaatttcctttacctttgctattttgcctgtagaaatatttaagggtacagttccttttaaactttgtgtaatgctctttaagaacatgagaaataactgggtgtggtaacataaacctgtaatttttacttaggagatagaggcaggaggatttcagtcgagcatagatcacacagtaagaccttatctcaatccctgttctccccctaaaacaaaacaaaacaccatgatggagtaataagaaacaaattatatgttaattaaaatttccctgaaaaattttaagttcaaaacctagctctgtgactaacctgctgtgtaaccttgggcaggctccatcttttggggacttcagtttctgaactgtgaaacaaggagcatagacctgatgatgtctaagcttcctctacctgtaactctctggaatcccacttgtacagaattatcctcaatggggttatatagccattgtcgaggtactgtttattgcccagcttagcttttaaaaataatagtctctagcagagataatctgttccaccactagctctagtttagtgatgttacttaaatgtaatttccagtgttaggaatgagtttgtcttgaactgtagtttcaagaaatgtaatttccagtgtaggaatgagtttgtcttgattcctctcccatacccgatctttgtaaccttcttatacacacacacacatattactgtacagtagttaatgcatacaccctcatgatcatcttctgatctaggatatatgatagattgatatgtcaagccaactggcagaccaagatatcagccctgactttagatgtaatcttaaatttggtgctgatatactctgcctacctggctgctttttgctgaatttctgtgtttcagtccccttgactgaagcacatatcacgaagcctacacatgctgaaatgaagagccacaaaaattgatcttctatcaaaatcaccatgagcacagtttatgatatgatgtaaaaaaaaaaaaagtcaaagaatcttttggttttacacaaagagtatatgctgttcattggctaaggctatgtgggaaattaccacaaaacaatcttacaatcctaaaggctaatggctgagatgaagatagcagtaaggttagtttcttctgaggtttcccttattggtttgcagatggttaccttgttccattttcatgtgatctttcttttttgagtgaatactccttatgtttgtgtttctgagaacacatgccatactgaatttaggtccacattatcagccctgacacactgcttggtactaaggcttaaccctttaatatatacgaattaaggcagacaattcagcctgcaaaatgcattacactatgaaatattggagctagactttagagtttgcttacttttattttacaagccataaagattaaggtggaggacagttaagacctatcctaaggcaagtcagatgaaattagtggtagaggcaggcccagaaatcagatctctaagttcttgtccttcccagcataccatgctggcacatcatttcatctcacttattcacaccttaaatatcccacgcacttgcccttgcttgttcaccactgactattcggaataactttggcaaaagtaggaactcatatgcttttaaaactatgtttaatttttcttatacttatttagcttcaccacttatattttaaaagaaaaaattgaggttttcaacttaattgctttccctctttcttttaatacatatttttttcattgaaaataatagcaattttttccgaaggtgaatgaactcgactttgtcaaaactgacagtggattaaaagagaagcaacctcagcttttaaaaaaataaatcacctttcagatctgaagtagcaaaatatgattaggacaaacctttgccccccaccttcccctgtcttctttccgtagagcaggaattcagagcttctagaaaccttgatgtgcactcttccacctacagacagtaaatatcaggatggaactggtggggtaaaatggcctgtctttggccagaggtatttaagctcagaccttggaatctaaaaggaaattcaaaatgcaaatgcttcctgtcttcacttgtaaatcttctgtactttttttttaaaaaaaaaactgaaatatcaagagagaaaaatgaaaaaaaattgagttatacagacaggtaaaaggtctgatagttcaaaagatttatcaaaatcaagtgtactcttccatttaatcctcgaggagtttgcttttacttaactactggcagagctatttcttctcaacagcagttagttactgcagtggaccatagaatgcttaattcgatcatccctaaatcctcacttatttgcatcttgagagggagaggggtgtttaatgacaaaaagcttttcttcagctgagttcctgagtaacatggccccaaggctgccctctcaggttgtcatccactgtggagattagagagagacacatttgtacctcctgtgtattgtgtcagagccccacccttactcaggtcagtcagcaaccctaggaagtacaaaaatatatacagctgtgcctttgaggtagaaaagacattcaaaattcaaaacacttctatcaagcagactctcaataattttcactccatatgagatacaaatatagattaaattagactgatatgattttatactggtcttgaacaggggggaaaaatcagtacagaatcatataattctatttgaagttgagataataaagcaataatttctttattaaactataaagttttatgctgtgtgtatgttagtaactttgtttctatttagtaattcatttgaacacagtttctttggcctgacaaatattctaatgtactatcagaatttctttctgacttataaaatagtttatgtaatttttctaattaggttttattgtcacctgggaaaggagaacctcaactgaagagttgcctgatcggattggcctaaggacgcatctgtggggcttcttcttgcttgctaattgatgtaagagggtccagaacactaagggcagtaccctccctaggctgatgcaagtggtctatacctcagaaaggttgaatgtgaacctattattgagccagccagcaagtgctgtttctccatggtttctgctttgagttctggcttgagttcctgcccagactttgctcagtaatgggcagtgtgacctgaaggtgaagagctaaataaattctttcctcccctcagtaacttttttatcagtgctttatcgcaccaacataaagaacactagaacagtagttaaacaatttaatggaaataaaattaaggttgcaatggctgtgcctattgagcttattccctccattctctctccatttgcattttaagcagtcaggtggcgggcatcaccatattctttatgttcccagagttaggtaattagtagacacttaaatgcttgtaaagcctcttgctttgctttcttgtctctgtgcatttactaaggcttttggcagatatttgtactcctttaagttggtggctgccactcttacaatgatttttaagtgtttcttgaatatgattttacatgtaaagaagagctgttgtgtcataagaatagagctgttgagctctgcttgatgtgtctttccttaaatgtgagatcctagcatccaaaagcgcctgagaggaatatattataagaagatatgtgcaaatcacttgcattcttctgtagctcatcataggaatagaactatttcagtgaggaacacagtaagaatatatctaataggttacacatgctgtgatggtctcatcaaatggtccctgctaatcataccagtcgctgattgccatcccttgggttaccattgaaaacactcttccattgtttggtaatgaacagtccctaatctcactgctgatttcaggtaagtgtgccagacttgagatatcatcaaaagtatatcatttgtcatagcgtgttttagaattctaaaagaccatggcaaataggaaggagaccaagattcttctctttcgtttaattttttttttttttaaagaatagtctgtatctcagtctggcctcagattcactgttttgtcaaaaataaccttgaactcctgatcttcctgccctaactctcaagtgctggcattatcgaagtatgccattgtgactggccaagagatcatatttttttctgattattagaaattcaatttgttacaatatatgtgttagctatttacatatacagttagtaggtatatagagaataaatatcatgatatggtcaaatatgttgtatatagtatatattatatgtatgtgtatagttggttaactgttcctacatgctttctgcaataattttctacaaatatataactatatacatatataaatatatatagctatacaaatatataaacatacaaattaatacattctctaaaaacatcttacatacatcctctcttttaacttttaatccttaaagaatctctgtaagtaacaaaaaaaaagtaaggctaagagatatcatatatcctacaaggtttcagagccaggaagcagttgatcctgggccatttttctaagttcttactctactattttgcctgtatgccacagctatcattattacagagataatgtgctaaaatagagccagacctcctgtatttgaaacacagctattttgcttcctggtagtgttatttctgacaattttaagcatctctgtgccaaaagtttctcacctgaaaaatagggacaataagagtacctaccccatagtgttattgtaaagcttaaataagtagatttataggaggcattttgaacagtgccttgagtagttagcattctcttagtgtttgctgctatttttgtgttatctttattattcttattatgatcagcagcagcattattgcatagcatggcagctaaaattcacagtcattatgcacagactaccttcatttaaatccaaattccattaattatgtcaacttgcacaaatttctttgatttccccatgcctcggtgtcatcacaaatatatcagatactaaccacataaagctagagctgctgtgagtttgaatctgtgaaagattctgatgtacagaatccccatttgcctttttcctgctgtcttgcctgcaaactcagagctacgaggtgtcgctatggcagttatatattgtatgtgtcatatgtaactcatcagtcctctgtagtctaatcacagaagccagtggtttagttgtcatggcagtcctttggtaggaatgtatttgtcatataaaagttattttggtcaatcagtatggtatggtgaaatgaacatttgctggagattcagttctattgctaagtcgttttacaagtgaaattccagagcgtgaagaaatcacttagaaagagtaagaaataataactttctagtcatgcctgttttttctgtgaagagtggtgctatattttccagcatataatagtttgagtttatattagacaatgtgataactgtgcttggggaaaaacattccaagtttgatgtttttcctccacaattatattagaaattaattagaaaatgggacacacttagcagttacttcagaaatgacttggtaggctctgttcattaaatactactaattgggatactatggatatattcataggcaacacctcagtttatgaagtgattttattccaaaagattctaggctatttaatttgttagagtttcctgtacaaactatgttattattgtgaggaagtgcccaggttagctcacaacctgttataagacttgtatgtgcagtttacataagaatgctgctcggtgttagtaattaaagcaaaaaaatataattgagcagaaaataacacctggatgctaaaatgtaagaacagtagaattaattacaggttgaggagagagacggcagattcaagagggtctttctgaagagcacttctagccactttgagaggacattaggtgttgatggcccaggattttttggtctaatttcagttcgaaaaggatagcaatctcactaacattgctcttataactgtcagtcataattatagtcatttagggtccacaaatagaacaaaaggaccgatagagttcttgaagatactggacaagagaaaggggaagaacaaaagggtgatctgggtccatgagatgacatacaatagggtaaggtagaattagccccagcaaatgatgaaagaagagaaatggagagctcagcttttatgcaggatcctggtaaaaaacaaagacgggaacatttccataatacctgagcacctgcttaacttttattctcattctctcgtctctgctaggctggctcttaaagggcaaaatgatttcttattcatccctctgctgccaacaatagtgagtacataagtgttgaatatactagatgctaaatgaaatcagatttcatctcacaagtgaatttttttgcttgtatctgatcagagctttaaaaatctgcaaaattatgcctttgatcagaatgaggttcatagttttagaatttaccataattgaactcagagtttggaattgtggtattgcaaatggagaactgagaatccagtcacaggttgttgatttgatgaccagcaaagtcccttctgcctatttcataggttacagctcttctgactccatatctctccttgaagatatctgaccaaagtaatttgtaacactctgcacatagactccctgattgacaaaactctctgactgctataacttctcacaacatcctgtcacacacaaaaaggtgatggggagtttgactgttgattctttctcttcctcactatttttttttctgtttgaccccttccctgatgcattcctgctggagacaaaaccacatgctgaaccatgaggaacagaccgcagtgaaacaacaagctgctcccaattttaaatattgcgtgttggggcaaaggcagagttccttttactctaaagctataacattaaaaaaattctgtttgatattcagagttatttgatctggcagtttaacaactgttgatgttttaattgcttctttaaaggatttcatctacattttaagctttatttttattttactctgaaggaatgtcaatattagccatcactttgcccagtaacttaccactgcaagatcttggagtaaaatccagtaattactggcgctggtaacttaagaccctgctgagaagtttggcagtttcccttctcctgaggaggctctcttcccatggagctagcaatcttttattgttctgaatcaattttaagcaagtgttgtaccttcaagatcagctttctatgttcctctagaagagattgaggtcactctattctgagtgaaagagaaatcttaggttactcttaacatggacaaatgtacaattgtaagatgtgttaacatgaatgacttagagattttataatcccttgggggtcttagttcatttttatttgtctatttgttagtctacttccaggaccaaatagaatgcttaattggcatgctacttacatgcatgtaactatccatttaaatcctctgaacaaaactactaacattcaaagtgctttagagatgaaagtgccctctgagatcatctggtccagcctcttctaaatgctttagcttgtattcattaataataataataataataataataataataataaaaagatgcttgctttcagacctcattagatgagtttctttgtgtaatgggttgtgattaactcagaagctcacaactggttgaagtgcatagtataatgtctgtggagtgctcagttacaaataaggcatctgtatcacatccaatgcacaaggctcagggaccatctaggaaaacagggaagaaagattctaagagcaggtttgagaggagctgagcaaaacaatgtgttctgtacatgacaactgcactcatgaactcacagcaacagtggttggccggtaaaagacctgcacaaaatcaagccagtcaacattccagcatgaatgaaatagacatttcatgagctaccactagctggggagctatggactgttaaatgcttctaggagaaggagagtctattttatttaagggtatgatggcttctagtattccaaccattcttcagtgaatgaccccatacccaagagtatgtaggtcaatagattatttataaaaagaatatgaacttgggggcataagaaggtagtggtcggtctggaaagtgccgagggggaagtttgaggaagaatatgatcaacattgtgtgaaattctcaaagtattaataaaaatatttgaaaagaaagcacagaaaataaagaagtatgctagagctcacattctcatctatttgcatctatatgtcatttgaattatttacaccaagaaatatttataaaatgcttacaatattgaacccagtctgaagcaatacttagagtttgagagcttacacactaaaatgagaagcactgacaggccacatttagagaattatattctctcttctgaagcttctttatactctctgtccaacacacacacacacacatgtgcgcgcgcgcacacacacacacacaaacacagaggggggatgacgttgaggccatagaaactaatctccaaaccagttgcttttcttcatgaagcagcactgctctataagacttcctttttcaggaatacttcatccttatcaaggataatcaaaagttaatttaaaggaccagccaactggttgatgggggcaggaacccctggctaggatatatggaaagcagtatacttaaacatgaggtatattattcagtcatattatccttttctgcctatactctatctcctcaacacagaaaacaactatatgactttgtgcttagaaacataatgcctaagttttcatacttacatatcattctcaaccacccttttgggaaagtgggatcaaatactagtttaagtaatatttacaagtcagaagcttccaaaaggatctcttgactttctactgcttctttctggtatcacttcaatagccttaaaaggccaacttttgtgggtgatgatatgattttaagtcttggcatcctttcctgatagacatctctcaatctttgaaaagtttaaatattactctgtgaagaattttgaaatataaattatggtagttaaaaaaaatttacatggagctggagagatggctcaccacttaaaatcactggctgttcttccaaaggacccaggttcaattcccagcacccacatggtgtctcataaccatctttaactccaaccctagtggatctgatgcccccttttgtcctccataggcactgcacacttgcagtgcacagacatacctgcaggtaaaatacccatctgtactggctgattttgtgtgtcaacttgacacaggctggagttatcacagagaaaggagcttcagttggggaaatgcctccatgagatccagctgtgggacatttctcaattagtgatcaaggtgggaggtccccttgtgggtggtgccatctctgggatggtagtcttgggttctataagagagcaagccgagcaggggaagcaatccagtaaggaacatccctccatggcctctgcatcagctcctgctttctgacctgcttgagttccagtcctaacttcctttggtgataagcagcaatgtggaagtgtaagctgaaaaaaaaccctttcctccccaacttgcttcttggtcatgatgtttgtgcaggaatagaaaccctaagacaccatccatgtaaataataaatgaaaatttacaaatataaaaatataacaaatgaaaatgtatacacatatagcataatattaaaacttaatattttcttggattgctttttctgagtctattgatgtagatctaaccttctctgcctaagatttcagtttttgtttctgcttgatttctgtagatcataagcttgatagaagaggagactaccctgtctattttaatttttactaataagtctttattattatctcatataccaaaaatagtacttagcaataattggcattcaatattttatttatccatccatttgttaatttttgagtcgttttctcactatgtagtccagggttgtctcaaactctaactccatcctccacttctcaagcccttgaattgtaggagtgtactaccatgctcattttaatacttagctttagactggtctatagtcttagcctcatcccatgtttatgtctatctttgctctgattagatgcctctatctgaactctgggtatttattgataaatcacaagattgtgggcatttatgtttgatatcaagtatatctggtattttcccaaattcctttctatttctggagacatttctctgattacctactcttgaaactctttaagtgttctcttttcacactagatttctctcctaatcgcttctcagacttttggcaaagatctagtgtagatttctctcctaaccaattcctacccttcatttctgactcctattcctttatctattgttccctgtttaacctaggttgcattttggttcaaagcattttatatattaccatccagtcatgtctgtctcttgtttgatattctataaagaacaaactagcatttatgttttatttgtgtaataaaatacaactcctttctacctgcaatttataagcagtaaaaaggatcttcaaaaacaaagacaaaaagtagctgagtaattgttttttaaaaataattttaaaatcataacattgagataatagtgtgaaaggacttcctaaagttaaatttgtaagtttctacgtatcttcttcatttccctacatatatattgcacttacatatctaccatttgaattggattttgtgaagcttttgatttgggagttatgtcataactatgacttatagaatgtctttgtattattacctcctgagagctgggattatggcatatagtacagtcattctgtctctattcccaatcaccagtgtaaattgatagcagtaccatgaactcaggtatactggcaaacatgcaaacacacacacacacacacacacacacacacacacacacatcacagtataagttctacaatatgccttaaaaatacatcacttcttagccttttggctaagataaagtataaaaatatttatagctaaaagcaatctctttcctatttccatgcatagcttagatcagagaaaatttcaactaagtagatggcaaagttagaattgttgccttgatgacaatttcatttctcagcatgtagaataattcaagcaagtaattgctactgtgataataattccaaacgtgaagaataactatttggtgaaacagtggtgataagaaccttggagaaagaagatgtgcatcttagagtttgtaatgacagaagtggtattgatgaccattcatccttacagaaatgtgattcacgatttgactgaaatatagctttttcatcctgctactgaaatcatgaagtctttcagaactgaacaattctaatttctggacaatagacaaggaaaagaactgtctaaaatagtcaaattcaacctttcttatgtcccagtacaccagaagggatatgacatatatcactccagaaagtgcatgagcacacatcacaattttcagagaagcatatataatttaaaaatccacccaaaagggcattctcaattccctaaccccctcacaaagacataatttatctgtgggactgcacagtacattcttcaatatgtccatatgtgacatgatacaaagagtacacaaatctagttttagtaaagaacataattctaagaatagtgtcacagaggttaaagcctttcgaaaatgctaaggacctctgaatgtatgcataataaatagaactaaaaatagttctctttaaagcaagaaaaagaaagatctggtcccacttggcatcctgttgaaagtgacagctggcagtactagttgcccagacctctatcaatgagaatggtatccaagtagaaaggcatggataaaataattaagaaagaaattgaagctcaaagttagtaaaaagtatgaaaatgtatatattcttttttgagtctctaagaccagacaaactagagtagagctaagggtacagaaagaggctgtaatcacaaaaccactacaatgtgaccatccttaatatgaaaatatgaaatatacaggagcattggcataaacctataatcctagcacttgaaagactgaggccagaggatcacaagtttaagaccattcaggtctacagaataagacccctaccaccaaatatagataggtaggtaagtggatggatggatggatgaataaacatacagacacagacagacagacacatgagaaatagatacatatatttgaaatgcaaactgcactggatgctaaactatttgaaacccaacatgatactacaagtggaaaattctgtattcaaccttatgagacagattacaataaaaactggcatatttaaaatgtattacatttctttcaggtagttatacatgaaagaaatgaactttatatttagacttaagtacaaatcccaggatatcttatatgaatatacaaatacacttaatttaaaaaaaatcctagatttgaaacttttatgaccactgtaatttcaaataaggagtatttaaccagtactccagattataagaaattatattaagaataatctccaaaagacaagaataaacaaattattttttctcaaactgagaggcttggagtgatttggaaatactgtgtatctctaaattgggcaactactatcaggaaaattctaaaagtattgtttcagggaaatactttatgatgtagccagtgaagaaaatgtttgacaccagaaccttcaagttcattctctgaggataagtcactaaggaaagtatagatttttgggttttgtttgtttagtttgtcggttggtttttttgttgttgtttttgtttttgttttgttttgtttttgagacagggtttctctgtgtagccctggctgtcttttaactcactctgtagactaggctggcctagaactcactgagaaatgtgcctgcctctactttctgagtggtgggattaaagaatgcacccccaccactggctgatgcatcattttttgatagggttactaaattagacataaaaagagaccatgaggaaattctgatccttcaggggtgcacgctagagcaggttgagctgcattcgctgtaacctagagggagtatccagtggattactgtagagcattgtgctgcttaaaattcccaccaataacttggacaaaagtattgaagatttgcatattgaatatttagatcatagaaagccataaataattacatatttgaaaattggtatatataagaaaaattagaatgagataatatttgagaataagaggaagaagccaagagaagaagttgtttgtttgttttttttttttttttagtgtagaacaaatttctgatagggtttgacagtttaatatttaatattacagtggtatgtctgatatgataatgagtaccctcatttccagtagatggatttaaactgaaattagatgaccaactctcagactgattgttaatgtaactcactaggtagaaaagtttaggaaactgagttctaagatctcttccagttatgagatggtacaatattccctgtacaggctgttttgacaatagctatttctatcattcatttcaaaaactaaaattcagtaattccaaatgtcacaccacagatacttcattcaaatccaacccaatggtgatatttacatttttgtgtggaaggggtatgtcctccttggtcttgcaaatatcagacaaatttctaccactgggctataccctcagcccccatatatactctgcatggaaagctcccctgtgtggttactttcttctctcattctcctctgcttccaaatatctaaaaagggttcattaaattagtagtagaccttttgtggtagagttctacttgtttatgtctctgtacaaaacattatccctgccatcagagtaaacaataaatagacttattcttttgttttgtatatgtatatttcaaaaataaacatcataatcatgttttttaaaaagtcagtgtttcctttgtagaagcagtataggctccatttccacatctagccagtggaacactctgtcttttagaagtatggggcactgttttataatttagggtgttttctgaaagaagtctagtattctgtattaaactactgtggatttatcatttatctatgaatgtacatgaatttcttagactttctttcctatttgtgtatctagtctaattaatttctaaacatggtgttgaaaatatacccagaaagctaggtaaagtaaaatatagtttcttcagcacaaaggtttgtcactgttgcttatctcttttaacaattatcaggcccctattattgtgctagacagtttcatagttgtctgatcttttccaaaaatatctgtgaagtaagcaagcaatactcatagattttaacttcagttttcaacagtataagcatgcatgcatgtatgtaagaattacccttagatatttgctaatcatttttcaacttcctgctaattgtcttatgttcttactattttcagcagtgagtttcatttcacaagaaacaaaaagtctgttgccttttttcagggacctttccaaatgatgccttagcaaagtcttcatagaatggattatagtgttcttcggtattgctgagttaaatggcctagtcggccatcactggaaagagaggtccattggacacacgaactgtatatgccccagtacaggggaatgccagggccaaaaaaaatgggaatgagtgggtagggaagtgtggggaagggtatggggaacttttgggatagcattggaaatgtaattgaggaaaatatgtaataaaaaaaagcagaaggtgagagtttaataaattcctattattctcttccttaatatggtaccttattcattcataaggaagtttaacattttcttctgtttcattaggtatattttttttagatttttttgctttaaaatgttatgattctgagttgtagtagatttaaaacagcattacaacagttgcatgtctgtgtgcaagtgattttgtgagtacctagtgtgctagtcattctggtgggagagggaacaaaacagacatagttctcaccctgctagaacacttctgatgtacgggcaaagtccctcatgtaatcagcaataatacaatgacaagttcatatatatatgtgtgtgccaaagataacctttttagggcactttagagaaaagaagactctaaaatgaaggcatacattccaatcccacttctaatttctttctatggcttccttgtcactgattctccctagcttcttttctctctctcacacacacaaaatgaacatgttgtgcaagactgctttcaacttcttccctagtcagttaaatactcagtctcaccagtgatacataggtacaggcttttaagacagatacatggattcactccctgcatcgcaagtccaatttgtataatatgtaaatgaatatttcagatcttgggtaagaaattgatcatttttattttttaaatatttattttacttatgtgtgagtgtgtatcatgctagttgcctttaatcccagcatttggcaggcagaggcaggcaatgtttgtgagtttgaggctagcctagtctagatagcaagttccagactacccagggctacataatgagaccttgtctcaaaaaataaaatataagtcaattaataagtttaaattaataaaactttaaaataaaaatggagccaggcggtggtggcgcacgcctttaatcccagcacttgggaggcagaggagaccagcctggtctacaaagtgagttccaggacagccagggctacacagagaaaccctgtcttgaaaaaaaaaaaacaaaacaaaataaaataaaataaaacaaaataaaataaaaatggggcctttgagattgctgagtggttaagcatacatactgctcttgcagaggacctgagcacaattccaggcacctatgtccagtagcttacaactgctgtaacaccagctccaagatacctgatgtcctttggtctccatggacacttgtattaatgtgcactactcctaaatgattggattaaagcatttaccacgatatttgggctgataaaagaattatatgagggcaaatatgcaaccttggtattagaagaagacaccattttccatttgtattaaggtaaaataagcaatttataataattcttttaataaaacatacttataaaatacaatttaaaatttgccaattgttaataaaaacaaataattttctacctttgcatataccttttgacattaccagcattagaactctttggctttagtggatgctttcattgtaaagttttaagaagcatttcataaaagtccctactaaggtgcatagtacataacgggacttcagtagatggtagtccgtattatcagtatagctctcagaagtgttcactgcttataacttccaatcttgagcttatagacacctttgattttaaaattgttttcctggttgtacctcttcattaattcatttccatgttgaagcaacctttggtatgtgactgtggaaaaaaagagaaaactccctagaacccaaataaattgtgcatccattgatttttccactggctacatctttacctccttaacgagctcctacaaatttaatcagaatgatttctacttttaaaatgtgttgctacttcccactgagttattaccttgtagacatttgttcttagagattacagtgtttaaactccaaagaacatttctaaagcacagcaacctaagtgaggtccaaatgctagtgtatggcatttctaggcagagttatcaaagattaaataggatccataggtcagtgccaaactttcccttatctgctgctctcattttcataagccccttgccagaagacaaaataatctaattccatttctcctctggtcaagtaataacacatttagtctattttgtgttaataacatattaatccaagtttccatatatttcagcatttcaattttcttttgtcatgaaataagggcttactatgtacacaggctagtcctgaacttgctatatagcctagcattactcagaaatttcactgttcctatcttatcctctcttctgctttgattatagatatgcaacaccaaacccaggtaaattttaaacgatggtattattttaattgtatatatttaaggcaatgacaggatttcatataccttacattttactaaaagatcttaagcccatgtgacatggtggcatatgcttcttatcccatagtttgagagacagaagcagaaggaccagaagttcaaggccagccagcctaacttcataatcagtgtgtagcctgggctgcatactatttatctcaatcaaaatgccaatgccatccttcacagaaatagaaaagatagacttgccctttcggtcggcaccagcaccaggtcaccttgggcacagagtcagcgcataaccccaaggtcccctagaggactctccatgccgtcttaggaccactggtgagtggaacacaacttctgttccaatccaatcgcgcaggaccagagacagcattagggaagcagaaaacccggcctgactagggtcacaaagtcccttcctgtgggcgccagcaccgggtcacctttggtgcagagtcagcagacacccccaagctcccctagaagactttccacgtgatctttggaccactgatgagtggaacacaacttctgttccaatccaatcacgcaggacctgagacaacactagggaagcagaaaaccgagcctgaccagggtccaaatcccttccggtaagcgacagcaccgggacaccttgggtgctgagtcggtggagaaccctaaggtccctagaggactctccacgcgatcttaggacctctggtgagtggaacacaacttctgttccaatccaatcgcttgggacctaagacagcactagagaagcaataaacccggcatgaccagggtcacaagtccctttcgttcagcaccagcaccagttcacatgggcaaagagtcagtggacacccccaaggtccccagaggacagcttctgaggcataccccgtttcgggatccagacattcgggcaccttccctgccagaggagaggtgtccaccctgcccgggagagctttgccagagcacctggtggagccatcatggctcccgaatcccgctgagagtagtctgcacaggtgagagtgaggactacagaagctaacagcttctgggacaggccagagtgacacagcttctggacacatcctatttcgggccttcatcttctgctaggagtcaggtctgaatgccagatatctttgcaccttccctgtaagaggagagcttgcctgcagagagtgcactgaccactgaaactcagaggagagagctagtctcccaggtctgatgatagaggctaacagaatcaccagaggaacaatctctaaccagagaccactataacaactaactccagagattaccagatggtgaaaggcaaacataaaaatcttactaacagagaccaagaccactcaccatcatcagaacgcagcacccccaccttgcccagtcctgggcaccccaacacacccgaaaaggtagacccggatttaaaagcataactcatgatgatggtagaggacatcaagaaggactttaataaataacttaaagaaatacaggagaacactgttaaacaggtagaagaccttaaagaggaagcacaaaaattccttaaagaattgcaggaaaacacaaccaaagaggtaatgtaattgaataaaaatgtccaagacctaaaaagggaagtagacacaataaagaaaacccaaagtgacgcaacactgaagatagaaaccctaggaaagaaatttggaaccatagatgcaagcatcagcaacaggatacaagagatggaagagagaatctcaggtgcagaagattccatagagaacatctgcacaacaatcaaagaaaatggaaaatgcaaaaagatcctaactcaaaacatccaggaaatcctggacacaatgagaagaccaaacctacggataataggagtagatgagaatgaagattttcaactcaaagggccagcaaatatcttcaacaaaattatagaagaaaacttcccaaacctaaagaaagagatgcccatgaacatacaaaaagcctacagaactccaaatacactgaaccagaaaagaaattcctcccgacacataataatcagaacaacaaatgatctaaataaagatagaatattaaaagcagtaagggaaaaaggtcaagtaacatataaaggcaagcctaccagaattacaccagatttttcaccagagactatgtatgacagacaagcctggacagatgttatatagacactaagagaaaacatatgacatcccaggctactatacccagccaaacttttaattaccttagatggagaaacaaaagtattccacaacagaaccgaattcacacattatctttccaagaatcccacccttcaaaagataataacagaaaaaaaccaatacaaggatggaaaccacaacctagaaaaagcaagaaggtaatccctcaacaaacctaaaagaagacagccacaaaaacagaatgccaactttaacaacaaaaataattggaaacaacaattacttttccttaatatctcttaatatcaatggactcaactccccaataaagagacgtagactaacagactgcctacacaaacaggaccaaacattttactgcttacaggaaacccatctcagggaaaaagatagacactacctcagaatgaaaggctggaaaacaattttccaagcaaatggtctgaagaaacaagctggagtagccattctaatatcggataaaatcgacttccaacccaaagtcatcaaaaaagataaggaggggcacttcatgctcatcaaaggtaaaatcttccaagaggaactctcaattctcagtatctatgctccaaatacaagggcagccacattcaataaagaaactttagtaaagctcaaagcacacgttgcacctcacacaataatattgggagacttcaacacaccactttcaccaatggacaaatcatggaaacagaaactaaacagggacacagtgaaactaacagaagttatgaaacaaatggatctaacagatatctacagaacattttatcctaaaacaaaaggatataccttcttctcagcacctcatggtaccttccccaaaattgaccacatacttggtcacaaaacaagcctcaacatatacaaaaatattgaaaattttcccatgcatcctatcagatcaccatggactaaggctaatgttcaataacaaaataaataatagaaagacaacattcacgtggaaactgaacaacactcttctcaatgataccttggtcaaggaaggaataaagaaagaaattaaagactttttagagtttaatgaaaatgaagccacaacatacccaaacctatgggacacaatgaaagcatttctaagagggaaactcatagctctgagtgcctccaaaaagaaactagagagagcacacactagcagtttgacaacacatctaaaagctctagaaaaaaaggaagaaaattcacccaagagaagtagacagcaggaaataatcaaactcagggacgaaatcaaccaagtggaaacaagaaatattcaaagaatcaaccaaagaggaactggttctttgagaaaatcaacaagatagataaacccttagcctggctcactagaaggaacagggacagcatcctaattaacaaaatcagaaatgaaaagggagacataacaaccgatcctgaagaaatccaaaacaccgtcagatccttctacaaaagactatactcaacaaaactggaaaacctggatgaaatggacaaatttctagacagataccaggtaccaaagttaaatcaggatcaggttattgatcgaaacagtcctatatcccctaaagaaatagaagcagtcattaatagtctcccaaccaaaaaaagcccaggaccagatgggtttagtgcagagttctatcacaccttcaaagaagatctaattcaagttcttcacaactattccacaaaatagaagcagaaggtactctacccaattcattatatgaagccacaattactctgatacctaaaccagagaaagacccaacaaagatagagaacttcagatcaatttcccttatgatatcaatgcaaaaatacttaataaaattctcattaaccgaatccaagaacacatcaaaacaatcatccatcctaaccaagtaggtttcattccagggatgcagggattgtttaatatatggaaatccatcaacgtaatccattatataaacaaactcaaagacaaaatccacatgatcatctcgttagatgtagagaaagcatttgacaaaatccaatgcccattcatgataaaagtcttggaaaatcaagaattcaaggcccatacctacatatgataaaagcaatctacagcaaaccagtagccaacaccaaagtaaatggtgagaagctggacgcaatcccactaaaatcagggactagacaaggctgcccactttctccatacctattcaacatagtatttgaagtcctagccagagcaattcaacaacaaaagatcaaggggatacaaattggaaaggaagaagtcaaaatatcactatttgcagatgatatgatagtgtatataagtgaccctaaaaattccaccagagaactcctaaacctgataaacagcttcagtgaagtagctggatataaaattaactcaaacaagccaatggcctttctctacacaaaggataaacaggctgagaaagaaattagggaaacaacacccttcacaatagtcacaaataatataaaatactttggcgtgcctctaactaaggaagtgaaagatctgtatgataagaacttcaagtctctgaagaaagaaattaaagaagatctcagaagatggaaagatctcccatgttcattgattggcaggatcaatatagtaaaaatggctatcttgccaaaagcaatctatagattcaatgcagtccccatcaaaattccaactcaattcttcaatgaattagaatgggcaatctgcaaattcatctggaataacaaaaaacctaggatagcaaaaactcttctcaaggataaaagaacctctggtggaatcaccatgcctgacctaaagctttactacagagcaattgtgataaaactgcatggtattggtatagtgacatacaagtagacaaatggaatagaattgaagacccagaaatgaacccacacacctatggtcacttgatctttgacaagggagctaaaactatccagtgggaaaaagacagcattttcaacaaatggtgctggcacaactggtggttatcatgtagaagaatgtgaattgatccattcctatctccttgtactaaggtcaaatctaagtggatcaaggcactccacataaaaccagagacagtgaaatttattgaggagaaagtggagaaaagcctcgaagatatgggtacaggggaaaattcctgaatagaacagcaatggcttgtgctgtaagatcaagaattgacaaatgggacctcataaaattgcaaagcttctgtaaggcaaaagacaccgtcaataagacaaaagggcctccaacagattgggaaagtatctttacctatcctaaatcagataggggactaatatccaatatatataaagaactctagaagggagactccagaaaatcaaataactccactaaaaaatggggctcagagctaaacgaagaattctcacttgaagaataccgaatggccgagaagcacctgaaaaaatgttcagcatccttaatcatcagagaaatgcaaatcaaagcaaccctgagatcccacctcataccagtcagaatggctaagatcaaaaactcagttgacagcagatgctggcaagtatgtgtagaaagaggaacactcttccattgttggtgggattgcaagcatacagccactctgggaatcagtctggaggttcctcagaaaattcaacctagtactactggaggatccagcaatacctctcctgggcatatatccagaagatgttctaacgggtaagaaggacacatgctccactatgttcatagcagccttatttattatagccagaagctggaaagaacccagatgcccctcaacagaggaatggatacagaaaatgtggtacatttacacaatggagtactactcagctattaaaaagaatgaatttatgaaattcctagacaaatggatggacctggagggcatcatccagagtgaggtaacccaatcacaaagaactcacatgatatatattcactgataagtggatattagcccagaaacttcgaatacccaagatacaatatacaagctgcaaaacacatgaaagtaaagaagaacgaagaccaccatgtggacactttgccccttcttagaattggaaacaatcacccatggaaggagttacagagacaaagtttggagctgagacgaaaggatggaccatctagagactgccatacccggggatccatcccataatcagcttccaaacgctgacaccattgcatacactagcaagattttgctgaaaggacccagatatagcagtctcttgggaggctatgctcgggcctagcaaacacataagtggatgctcacagtcagctattggatggatcacagggcccccaatggaggagctagagaaagtacccaaggagctaaaggagtctgcaaccctataggtgggacaacaacaacaatatgaactaaccagtaccccagagctcatttttctagctgcatatgtatcagaagaaggcctagtcggccatcattggaaagagaggcccattggtctttcaaactttatatgcctcagtacaggggaaagccagggccaagaagtgggagtgggtgggtaggggagtgggcggagggtatggaggacttttgcaatagcattggaattgtaaatgaaaaaaatacctaataaaaaacttttcaaaaaaaagaaaagatagacttaaaattcatatagaattataacagccaacgtcaccataaacaaaaagaatagtgtgggcagtatcaccattctggctttcaaattatactgaaaagtgacagtttcataatcatgatggcactgaaataaaacagacatatatatcaatggagaaattatgttgtctccaataaatggttctaggaaaactatttatctacatataaaataaagaatatttgtggagtgcaaattggtctttttggggtttattttataaatagtgggtagaaaaggtggtgggtgggactgcagagagttgagaaaggttagtggatatgatcaagatgttgaatgtaactatgaagagactaataattttaaaatattgatagcctctacagagcacaattctgccttcctgtatttgcaacaaaacataaatttataaaaataatttgtaataacgatgcaaatcctggaggtgaacatgaacatctgcacacaaagcttatagaattgcctgaacgacaatgtaaaatgcagcattttgaaataacaatgaaaatatataaaaggaaagttataacatggtatacttttaaaataaatacttatttactaaaaaaataagtgaaggaaagaaggaaggaaggaaggaaggaaggaaggaaggaaggaaggaaggaaggaaggaaggaaggaaggaaggaaatagaaccatctccctcaccatacataacagttcatttcaaacgatcaaagaccaacacttttgacataaaatctgttctgtctaaaagaaattcagggacaaagatggagcagagactgaaggaatggctgaccagtgagtggcccaatttgagacccattacaagggcaggcaccaatccctaacattgctgatggtatagtgtgcttgcagacaaaagcctagcatggttgtcctctgagaggctctacccagcagctcactgagacagatgcagagacccacatccaaacattagactgaggttggggacccgtatggaacagttaggggaaggattgaaggccctggagggtatggctaccccacaggaagaccaacaatgtcaactaactagggttcctgggagctcccagaggctgagccaccaaccaaagagcatacatgggctggtctgaggccccctgtacataggtagcagacaggcagctcagccttcatgcgggtcccccaactggagcgggagctgtccctaaagctgttgcctgtctgtggaaccccgtctcctaaatgggctgccttatctggattcagtgggaaagaatgcacctaatcctgcaataactggatgcactagggtggtggatactggggaggggggaaccctcccagaggaaaaggggagaggggatgggaagaattctatgagaaggagttgggagggggcattattggaatgtaaattaatataaataataaagatctgaaactattaagagaaaaaagtaaggaaaacatttccaattataggcaaggacttcagttactcaagaaataatgccagcagttaacatgtgggacttcatgaaattaaaaggcaagtaaaacagttaatttggtgaagaggtaccctagagaatggaataaacctttgccagctctaacctatcaaggtcccaatatccagggtatacagataacgaaaagacaaagctgagaaattaaatgtcccaatcaacaagtgaggtaatgaaataagccagtagttctcaaaaaatgaaatacaaatggccagtatactgataaaaaacgttcagcctcatcagcctttagagaaatacaagttcaaactacactgagtccagttcatgctgctcatatacttacaaatttgagtttctgatggttgtggattttttttttaaaaatgagaacacaaagttggggatatggaatgtgggtggatctggaaagagttataagaggtggtgaatatgatcaaaatataacacatgaaattcccaaagaattagcatttttgagattataatttaatcataacattttctcccttaaatagtctttttaaaaactacattggtgggctagggagatgggtcagccatcaaaaaacctagaatacagagcccatcataatctatatcttatgggctgcactatagtatgctctcaataaatgcctattagactgaggcgggggtaactgcattgagacctaatctcaacctactcaaaatggcaactatcttggtcagtgttctattactgtgaagagaagacatgactatgacaagtcttataaaagaaagcatttaattggagcttagtgacaatttcagaggtttggtccactgtgatgtcagggagcatggtggcatgcaggcagaaatgtagctgaggggtttacatctggatccttaggcagcaggaggagagagacactgagactggcttgggcttttttgttttgttttgtttgtttttcaagacagggtttctctgtatagccctggctgtcctggaactcactttgtagaccaggctggcctcgaactcagaaatctgcctgcctctgcctcctgagtgctgggacaaaaggcgtgtgccaccacacccagctggcttgggcttttgaaaccccaaagccaacctgcagtgacacgctttcccaacaaggccagacctcctaatccctttcaagtagtgccatttcctgatgactaggcattcatatgagcctatgggggggggcatgtttattcaaaccttcacaaccactattaaggaaacaaatgttaatagaatttagacaaaagagaacctttatacagttttggtaggaatataaactagtccaactactatgtgcagcactatagtagtctttaaaaaattaggtctaccatataacataaatataccatgccctagatttacccaaaggactcttaagtcaacaaatcacagagagtcttgcatattaatttttaaatgaaatcctattcaccatagttgagctatggaaacaacctaggtatccattaacagaagaataaataaagaaaacacacatatatacatgtatatgcatatatatgtatatttatatgtatatatgtgagagagggagccttaaaaaacaatccctatcaaaattctaacaccattcttcacagaaaaactgtatatacaaagtatattcacattgtaaataaagaatgaaattttgtaaggaaaaattgatgcaaatagagataaccatattatgcaaaataagctagtgtcagaaatgcaaatatcgtgttttctcttatttgtggttcctagattttatgtagacataaaatcataatgtacaagtagaagaaacaatgtctaggggtacaaagaactaatgggagcagagacatgggatggtgcgattatagaggaaatatgttcaacaagctatatatacttatataaaatggtccttatgttaaaaaatgtaccatgtatagtaaataaaataataaaaaccaggaaatttttaaataaaaaaggataaaaaatattccagactcctgtgcaagcatgaaatatatttcaaggttctccttattttttctgtaatgtctgtgatttatagacttctatataatgtaggtgtttagttagtgttaactggctttacactgtctcatatctgtaagtacattaaaaagggagcaaataagtattagcaaaaatatacatgaatggaaatttaagttgatacatgattgtaaggatgaattagcaccaaaatgactaaattcccaatatcagaagtaaactaattcatcctttctgctaaaggaagctggattcctattgaaaatgaaaggcaatttgaacagtctgcaaagatataattattctgcctgggaaatatgagaccctgcatctctcctgcaacccccaaaagaaagaaaaataaatcactattctgagataacttgcctttctgtgaagtgacagttctttaagaaatgcatttacctacttcctacaaaggtaacaaccaagtgagttaatatcctttcagctttgtcaaaaccatttctataccccatgttagtttgtgaaggcagtcaaatctggtagcaaaatactgatttgaaaagaaaatttccagaagaattaaacatatggttctttcctaagcaactggctagattaaatctaaataaatgtatttttaacatatactggaaacatttgtgactgcttaatagtggggactgtattagattttgtagtgtgacaggagctgaaacttgataaatggacattgatgaaaacccataactggtcaataattaaccatttggagttcagaacatgggacagaaaaggcactgttgatttattatatttttgttccttctacaaaagcccattgggtgtatttacaaacatgtagacaccaaacataaccaggatcacacctgggctatacaccttctccaaactcattaactgaaaagatatagattaattggagggagttcagagaagagtaacagaaatgattaaggggcaagagggattgatttatgagcaaagatgaaaagaattttgtctatacaatttagctaagtgatgactaagggagaagggggtggggacccaactgtctgaaggatgtaaacaccaacgagtaaagagaataatttactatgcaacatgggaatataaatagggctaataagctgtaattacccaaaggaataacagaataagtagttcagggaagcttagaaccatgagactgccaacttatttcacaaggagacaccaacagacatttctagtcttatccaaattaacaagtatttcgtgtgaaataatcatttggtgtcactaagtttcctcttcctcagccttgtcaatgactgtgccttttctatcactacgatacagttcaagtctagtttaccagagttctacataatttgcttagcactggtgggtctttgagcgttttattccagtagtggccatgtaagaacttctccttttggatgagcactccttaagtactgtgaacagagctgtaaaagcaccagaacaagggctcaaacctggaggaggggaaatcttggattcaatttaggattgtaaacaagccagaattcagagtgtttatgtttgggtctccagtataatttttcaaaatgtagctcatgttgagaaaagttcaattttagcattattggaaaaaaaaggggacactaaaaataaatctttgtaagcttcatgatttgtgtaaactttggaatgtggttcttcaaaaaacaagttggtctgtgggttcctgccggctaagttatttggctaattcctagtgtgctatcatgatggtccaaaagcattgcatctaactgctccagagaagattttgcatgtcgctgcagtgaacgcagcctcttttgtatgcatacttttcctcttttcttttgtgttgagaagcttcacagcatgagtcaattctggaaatcattttgggggttgagttaaggttttcccttggtcactgtgttgacatgttcctctggttttgccttacattttatacttccttgtcatcacctttgggggcaaacaacatcttaatgcaatgcttcatttgtcgtattgaagtgtgttttaatttttacacggaggagtttgaactctgagactcacacatgctaggcaattgttgtagtactgagttattgttttggtctattttgtttgtttgtttgtttgtttgttttagagaagctttagatttccagaaaagcagtggcaaagacaccctgcccctggtgtcttttatttctatagtccacatgccacaccaaattaacattaacagaattatcaagtgatacattcttatgaactagaattcctgattgagtcacattgccttagatttgatctattatctaatatctgttttattttccagggttccatccaggaaactatagtatatttgatagtcatcatgtctccttaatttcttcttgaatgtagtaattaattagacttcccttgctttcaaaaacatttaacaattttgtagaatgacaatcaatttgattaatctgatgtttgtttcatgattaagttttggaaggaattaagaccataaagctaaaatatatagtatcaatggtacatggtttatattcagagttaaccttggtcacaaggtaatattttttaagatttctcaactctaagattattttatcccttttaaaactttattctttgtaggggagttgtgatgtccagcccccactcaagaaataaagatttgtgctccatctccttgagagtggaaatagttacatagattatatggaattatgcaaggttgatttttctgatctcatatatatatgtatatatgtatatatgtgtgtttgtatatgtgtgtgtgtgcgcgcgtgtgtgcgcacgtgcatagtagtttaaaattaacacaagcctctgtgggaatgttactatattagtattcatggttatctagagtttctttaccattatgaataacactcgtcccaaagttcccaaattaaactttcttgcttaaaccctttcaaaacaatttctcagaatgagttacatatggccattttcataaaagtatataatgtacattgaacatgtttttctcatacgtccctgtggctcctttagtcccctaattagtttgacttctactttcatattatatgtgtgtgtgtacaaacataataagtaaattatatattgtatttatattatatataataatatgtatgattttatgtatgtatataaattctatggcctacaaattagagaaaatgtgcaacatttttctgaagctggcttaaattccttaagcactggtctcaccatgtatttcagtgagattgtttcaaacatacataataagattctcttatcaaattctgtatcccaccctcagatcaatcccaccatgactttttaaataattttttttcattctgtaaggttcactctactataatgttctgtgtagtttgaaaaatgccatgtatctggtatctggtaagtgctatttaaagtctatttatcatctgcataggccatccctttctaaaatgtcatgtaaataggatgataaagtatatagagttttcaaacattttaatttattgtgggttgtgtgtctatgtgtgtgtgtgcatgagtcacattccaaggggtttgtgctggctggttttgtgtgtcaacttgacacaggctggagttatcacagagaaaggagcttcagttgtggaagtgcctccatgagatacaactgtaaggcattttctcaattagtggtcaaggggagagggccccttgtgggcgggaccatccctgggctggtagtctggggtcctataagaaagcaagctgagcaagccaggggaagcaatccagtaagtaacatccctccatggtttctgcatcagctcctgcttcctgacctgcttgtgtttccagtccagacttcctttggtgatgagcagcagtgtggaagtataatctgaataaaccttttcctccccaacttgcttcttggtcatgtttgtacatgaatagaaaccctgcctaagacaagttggtaccagcatagtggggtattcctgtgataacctgaccatgttttggggaggactgtggaagaactttggaactttgggctagatgatccatttgatgttaagagctatttcaggagtgggtgataactggtgatgactcagcagttaagagcactgactgctcttccagaggtcctgagttcaattcccagcaaccacttggtggctcacaaccatctgtaaatgggatctgatgctctcttctggtgtgtctgaagagaatgacagtgtactcatatacataaaataaataagtaaataaatctttttaaaaagtgctctgtagtatgatatgtaggaccatggaacataatgttgagaacagtgcagaagatggaggcttggcttggaaaatttcagagggatgactaaagactcttttcagggccattgctattttgattgtgaagattctgtggttttggttacctggggctgaagaatcagctgtgattaacaagataccagaactactaaagcaaaaacttttcattactgggactattgatgctggttagttggagctaagaaattagtggtgattaagaagagaccagcatcactgaagtgaaatcttctgggaagtgttttctgagagcacaaagaggctgtgttccagagatagccaaggttgtacctcctgctgcagcaggacttggtaatgtataagagtcactcaggtggtactggttttgaaggcatggaggagtcatgaagtgtagtacaatgaagagcagctgaggcttggcactgtgagaggccatggaaggccattggtaaaggtgcagactcagttgcaattgatggcccaggtcaaaggggtcatgtcatgtaaaggagttgaggcttggcaccatgaagagagcccatgagaggctattgttgaagcctagttacatcggaagacagcagtgttttggagatgccagtattataggatgaccaccaagaacagcagcagcagtggagtacaggcgccggagcctagaaggcaaagtgtgtgctacaaagggcaaggctgcagaagtgacccaagcccttggaggagcttagaagatccggaatggatcccagacattggacagttggagtttgattttgtttttgattgtgactgtaccctgataattttccttcctgaagtaagaaggtattttagtggagcccacagttaaaagactttgaatttttaaaagactttgaaatttaaaagatattggatatactaaaggaattgaaattttaatatgtaagaatttgcaaagactgcaggacttctaaaattatttagatcttggggatgaataagaaagtaagagttgaggcttaatagtgagtgatgtgtttgtgtatcaggttgacaaggagtcaattgtactggctggttttgtgtcaacttgacctcaagagcaatgtggcagtgtaagctgaataaacccttttctccccaacctgcttctgggtcatgatgttctgtgcaggaatagaaaccccaacttagacagcgttcatatggtagtcagaggatgacttgcagaaatccattttctctccacaacttgaagactagagctggaactatggtcatgagacttagtgacaagcacctttgcctacccagctatctctctgatcccaaaagtctatggaatttccaagtgacttacttacttatcaatatggttttcaggttaatccaggttttatgtgacctcatgacatactcccttttttaaaatagcattctattatatggatatatactatattatattcatatattcattcatttaaattacatcttggttgcttttaatttggataagtataggtaaatctgacctaggcattttattcatatgtttatgtgaatataaatattgaagttgttggataaatgtcattggtagatttgtacatctagtacattcttccaaaatagttctgttaataagctttatcattgctgttaccaaaataccttccaggcacaactttagaggggaaagatttattttggctcttggtttcagagatatcagtctatcatagcaatgaaggcatagcagaacgttaatgtcaatttatgccaggaggcagaaaaggggtgaagggaagccagtactcagcttgttttgtactttttcccattttacttttatctaaaccttcagtccatgggataatgccacccacattcacaatgggtcttttttatacatcatttaatccttccttgcaacacgcaagcatactgaggtatatatctcatcaatctaatgaattcttcatgcagtcaggttgacaatgaagatttacaaccacaaatgatttatcatcatttcattctcactagcagtgagtgagggtacctcctgctgtgtacccttgccaacaattggaattgtttaaaaagttttaacctttttaatggtaccttattgtctttatattacactaatgacaagctaaacttctgttttttattttgttattagatattttcttcatttacatttcaaatgctatcctgaaagtcccttccaccctccccatgtcttgctccccaacccacccactcctgcttcctggccctggcattcccctgtactggggcatataaagtttgcaagaccaaggggcctctcttcccagtgatggctgactaggccatcttctgatacatatgcagctagagatatgagctctgggggtactggttagttcatattgttgttcctcctatggggttgcagaccccttcagctccttgggtactttctctggctcctccattgggggccctgtgttccatcttatagatgactgtgagcatccacttctgtatttgccaagcactggcatagcctcacaagagataagctaaacttcttttgaataatagaaaagtaaaagcctctctctttccttccagcccccccccgtgtgtgtgtgtgtgtgtgtgtgtgtgtgtgcagtacaaacacacatgtagttcaaagatcaacattaggtatctcccataattggtcctagctttttttttttttttttgagacagggtctctcactaaacctagatctcaattcagtagcaaagtcaggaatctgccagactgtgtcccctctaaatccccagtgctaggattacagacacaccacatctggcattaatttggatgctcattatcacagctcaggtcctcatggttgaaaggcgggtgctttactaacggagcgctctctctagcttctccaaatccaacgttttaaggaatacttctactttcaccatttcttcctttatcgaaatcgaaggaccaactgtttatcaagtggtagaattaatttatataggaaaggggttgcttagcattcaggctgctacattttataactgtgtaggttttgtgtttctgtattaattagctacaagttaggcaaaaagaaagatttactaaggtgaacattaagtcactggtggcagagaatcaatcctatgtggtgattatgaagaaagtggaaggaattttattagtaagcaagatgcctataaggtcattgtctccctcttaggtccatcacaccctatacacacattcacatctcccattctccatccttaccacatgaatgtggaaacagtggtgaagaagactaaaatgaactcaggatatataccagcatgatttcttcagtacctttaattccttttaaaagttattaattaatgcctgactcttttacacacacacacacacttgtacaagggataaaactagggcctctcgccgggcatggtggcgcatgcctttaatcccagcactcgggaggcagaggcaggcagatttctgagttcaaggccagcctggtctacaaagtgagttccaggacagccaaggctatacagagaaaccctgcctcaaaaaacaaaacaaaacaaaacaacaacaacaaaaaccttacggcctctcatgcatgctagataaatagtattccactgatcagtattcccacagctcaaaaccaaattttgtttaatgtttttcagtgctaaggatttaacccaaggtcttgtgcatatcaggcaaacattatcactgaactacatcttaaattctattacatttaacactgacttaacttgtattttgtgaaatatatttagagcatctatgatttgggtagctcttccaagctgcaaacttgcatttccctcttcaatctatattatatctttatagtttcatgtaaggttaaaaatgcttaaacaaattttattttaattgttaatagagaacaatacagataacactgattggacatctgtgagcaccagacacttttatacatattctcattacacctcttgaagtaattgttgctccatcttatagattacaaatttcagaggaaaatgacatactctaaatgaggcatttgtacatgtgattccttctgcctggaatagcacttccattccatttccaatagcaaagtatcaaacctacaataatcacttcagataccatctaactccctagacagtagtctcagttcatcagaaatctgatacttacccttgtcaagagtcaccatacacagaaccatgccatctgcaaatagggatgtgttaacttttccccttcctgttggtagccttctgtttcctgctttcttctatgtccttctgttgtcttgttgctctagctaacactattctaactagggatggtgaaaatgaacatccttgtgttgttcctgatcttagtgggagtgtttcaagttcttcatttaacacaatagtgactattggtttatcatatatagcctttagtatggtaagataccccattcctagttttatcatgaagaggtgttgtattttgtcaaagatcttttttttttcatcaattgaaataatcatgtgatttctgtgtgagtctatttatgtaatgaattatatttattgatatatatatatatatatatatatatatatatatatatatatatatatgtaatccctgaatgaagataacttgtcttcccaaattttgtttgcaagtattttactgagaatttttgcatctatgttcactaagaaaattgagtaacactggtgttagttttctttgatggcctagtagagttcttcatttaacctatctggacaagccagttgggagatatttgcttgtggtgtgaacattgattaatgcagaaaaaacactaatggtccaagtgcagagagagagacttctggagagggacagtaagttttctttaagggtgtgatcctagtaggtgtaaatgctgctttcatttcttcagataaagggatgaaaggaaagctgtacccaagctgtgtgaatacacagatcaggctgagcccagagcatttccttctctgttctaaccatccctgggcctgggcctgggcctgggcctgggcctgggcctgggcctggaagtttctagcctctgtacaatctaatcttccaagcttactgattcaatcctgttgtgggttggcctcgtgttgtttgtcttttgatgttaattttgtttccttaaaaggggctgccctaactaggagtggatcacacactcaggtgattccatgtgaaccttctcccaattctagctggtcaaataaaggcgagggcctgtggttgaacagttagaaggaaaaggtagagctggaagattgagagcatggaggaagaaggacagaggaagaagaggtggaaagaagttggagcagaagcacatggcctggagaagctagcaagggacctcatagccgggaatagattagtggagtggtatatctgagttctctaggcttctaactgaattgcattgcctggcctcatactaactttggcaaaatattcgaatcttccggctccttttcattctctgactccttctgtcttcaccagtgtctagcttgttctctctgtaacttgtctctgtaaaactatcctggtcaaactgccacatagacacacctaccactaccaccccttttctctctctctcactgttcttaggtagcctctcttcccctgctgttctcatatgggttgggtgtagcttatctctgagtcattctgccaaatctttctctgattcatcactttgtcccttaattaaatgtcactttcaaacctatctccgtccttctacaaactaatcttaccttcattgttagggactaaaagtgtatactaaggacttgtctacattctttggaggtgatcccctgccagaacaaccatgttgctggattaaaatttcgttacaggtagatttattaagctccatggatggctttacacctgtgagtgtatgatcagcacaaattgaacttggtaggttattacaaaatttaaaaagaggacatgaatttaggagggggaaagagttggagatgagtatcaccaaaagacattgtatgcatagatgagattctcaaaaagttaataaaatactatagttctaaaaagaatcaccatacagatatgtatattcctattgaatttctcagtcccttttgcaaaatacagtagtttgtcactcactacatttagcaaacgaatcaggagcttatagaaatgcatttctttgttgttgttgtgggtgaatggataaatggatgtagagccacttgaacaaacttactcaaacaaatgctgaatctctgggaatgagtagaagtgaaagattaagaatgttattctaccatgaaaggggtggttttcctatgtatatttttgtaaacagaattagttattatcttgcacactataaagataagttttggtaaagtcttttggcaggtggagatgtaggcaattttacatgaggagtacttgttggggagcaggttgccatcaggaagaaggactgcacattaaagcaaacgtgagctacatagtaaatacatattaatacagttgacaaacactgtattaggatcacatagaaaattttaagaaatgtactacaaaaattagttattcacactttggttactttgatctttactgtattgaacattgctagcgatatggatatcttttagagtatattttaattcaatgaaatcaacttagtagtataacaagaaatgaagatgaacataaataatacaattccttctttcttacaacatagttaacatctagttcagttttcatcatgtaaaacctacataggaaaatattgcatgtgcaatcatgcatgtacacatgcacacacacggggggattttataaaaactatttgtttacattacatagttgggatattttgcaacttacaaaatgatttcataagagatcctaggaagctaaaattagtgatatgtgtatgtttatgtgaatatatttaaggtacattttcatagtgtgatgacactgtaagtaaatggcataatagctgctacaggattgacagctctgtctagcaaatgccaatcccactttatgtttttgcatttgaaggatatggaaaatttgtcattttacaaaagtttctagccaggggtggtagcaaatgcttttaatgctttctcaacactggaaagacacagtgaggtagagccagcctagtctacataatgagttctagcccagccaaggccacagagtttctcttgtatgatacaggtatttgttgaatacaatctcacttcttgccaaggaatgatacaaaacattttcttttttattagatattttatttatttatatttctaatgttatcccttttcctagtttcccttcaaaaaatccctatcccttccccctccccctgctcctcaacccacccactcccattcctggccctggcattcccctaccctggggcatagagccttcacagcaccaagggcctctcctcccattgatgaccgactagaccatcctctgctacatatgcagctggagccatgggtccctccatgtgtattctttggttggtggtttagttccagggagctctgggggtactggttagtccatattgttgttcctcctatgggactgcaaaccccttcagctcctttggtcctttctctagctccttcactggagactctgtgcttagtccaatggtaggcaatgagcatcaacctctgtatttgtcaggccctggcagagcctctcaggagacagctataacaggtttctgtcagcaagcacttcttggcatccacaaaagtgtctgggtttggtgactgttattgggatggattccccaggtgagtcagtccctggatggtcgtttcttcagtctctactccacactttgtctctgtaactccttccatggttgttttgtttcccccccttttaagatggatatcagtatccatactatagtcttccttcttcttgagtttcatgtggtttgtgaattgtatcttgggtattccgagcttttggactaatatccacttattaatgagtacataccatgtgtgttctttgatacaaaacattttcaagatggcactttccatacaactatatatgatccgaggtaaggtctttgattactatttcaaccattagtgtaagtcagactgaagattgggactgacccacggatgtcagtactgacatgattatttattgcttagaacttgactctgcatagtcccagttcaatgacaattcaagaccccaggaagatattatacagatgactagatttgctaaagaaattttaaaacttttttaaaggtatttaaaattcctgcttctttttggcagtgctaggtggaacttggctcatcatagagctggagtaatcaaagagtgagcaaatgataatttagatccttaggcaaacttacaagctttgaagctacagtatttctaattgcatgcctaatggctgattgacgtgattctgacaattacctcaaaatactactcttagttgttgattgtttaccagtcaccttccactcctccacataaaactctgattcacagactgacaatgatctgccagggttcaggttgtatcttgctacagtgtagattttacttgggattaaatgaaagtatttcataatttcatatttacttgaatgtatattatatggcatatattcacacacatacatatacattcttctaaagtagaaaacaccctaatacttaggactgttcttccttcttctgccatgggaaaagcagggataccggaaacattgggaagtgtggagaaacttaaaagaaagacactgctgtgaattatggccacttttgtggagttcccttctctctcagacctgctcagaaatctctggttacttcctaaaagtcagctcacaagtgattctccctaacttccctccattttaaggaaaagctctctcttccgtggctccactgagttccttcagtgaccttactatatggccctggtcccattggagtgttcagtcttaactcctcactaaattgtaagccttaaagagcatctacgattcattagatgtgcattgttgtgcacagtatttgattaagacaagtactcggtgaattgttgagaaatggatggatggttaaatggataagcgataagacaaacaaacaggaaaagtacatccattcatcaatgtccgcatacttcaacaaaagtctaaactttcttcctaatgttctatttcaggcatctgcatataggagtagatgttcactatgttgctttcaacttatatatcatctatggatatcataattttaatacggaaaaattcaatataatctacttcattaaaaatttcaggaataaaaaatcatatgatcatataagtacatgcaaataaagtatttaatgaaatcaaacaaattgtaatatacagatatattctcattcttataaaggacaatctatagctagtgttatcttgagatgaaaatttgaagactttttttctaaaatcagaaacaaggcaatgatgtctgctgtcatcacttgtagttaatgtgctagaaattctagccgaatatatagaaaaaaggcaactaattttgatgctgtttattacagtgtttgaaaatgatgctatctttatatgcagacagcatgattatctttgtaagtcataagaaagttacaaagcaattacaagaactagtaagtcagtataactagttcacagaatatgtcactattaaaaccaatcatattccatagttagcatgccacacactctgcccctaagatccttccatgccctattttcttactgtttcattgtcctcatatctgcaccttgtacgatgtaagatcttttgacatgataatccaattatttaaaatttgttacttgaagctgaaggggtctacaaccccataggtggaacaacaatatgaactaaccagtgcccccagagctcatgtctctagctacatatagcagaagatggcctagtcggctatcactgggaagaggggccccttggtcttgcaaactttatatgccccagtacagggaaacaccagagccgagaagtgggagtgggtgggtagaggagtgggggtggggggagggtatagggaactttcgggatagcatttgaaatgtaaatgaagaaaatacctaataaaaaattggaaaaaaaatgttccttgagaataattctaattcaaaaattaaataaactggttaaaactcaaaataacggatcatattccaatgtatactaacaataaacgatcataaattttcaaacactataataaaagcatcaaatttttgcaatattaaaatctcagttttggtttgcaacctcataggaagaacaacaatatcaaccaaccagacccctcaaagttcccaaggactaaaccaccaaacaaagagtatacagggggtacccatgactccagcaactgtagcagaggattgccttaactggaatcaatgggagggaagccccttggtcctgtggaggcttgatgacccaggataggggaacactaggccactgaggcaggagtaggtgggcaggtggggagcaccctcatagaggaaggggaagggaggaggggaaaaggggcttgtggaggggaaactgggaaggggtataatatttaaaatggaaataaataaaataaccaataaaaaaaatgaaaaaaaaatctcaattttcacaaacttgattttataaatgtaatgcaatcttagatttttggcaaaaaccaagaagatgattttaaaacttctgttgacaaatgatccagaatgtctaaagcataaaggaaaagttgaaggtcttatgctgactgatttcatagtatattaaaaagttatagtaatcaagacagtgtgttaacaaaaatcccaacacaaagggggaaatggacacaaaattctacccctaagaagttatttgcaattggtacatgttggaagacagaaaatcagtgttcttcaatggaacgacactgggtagatctgccatgcttcaggacaaccccatgtccaggagtagagagccaagtgaaatctcagttattttagtgctttttagtgactttttgcttctttttgaaaaaaagagggaaatatcataaagttgggtaggcggggaagagaagaggttctgggaggaattggaggacagagaagaatatgataaaactgtaccacatggaattctcaaagaaaaaagaaactgaaatacatggcataggttagaataaaatatttgcatagcacttacctggcttatatcaagacttttggataaattattaaaacctggataataaatagatatctcactattttaaaataattaaaaggattgaacagaaatttctccaaagaaatgtatgaaaagatgttcagcacattagtcactggggaaatgcaaactaagacaacattgagggctgaagaggtgacttcatttgtaacgtgcttaccatataaccatgaagacctgagttcagctcctcctcggcacctgagccaggagcatatgctagatctgttgctagagttttgaggaatcgccatactgatttccataagagatgaaccagcttgcactcccaccagcagtaaagaggtgttcctccttccccacatccccaccagccattgttatcatttgctttgttttctgtctttagccattctgactgggctaagatgaattttcaaagtagttttaatttgcctctctgcaatgactaaggatatggatcatgttaaaaaatatttctcaggtattgcatttctaattttcagaactatttccatgccacaagttttaattatgtttgttttctttatgcttgtgtgtgtttattttttagttcttcccatattctagacagtaaccctctgccagatgtatacctggtaatgatattttcccattctgtgggctctctattcattcaaatggtgatatactttgctatacataagcttttcagtttcatgaggtcccatttttcaattgttagtagcctgtgctaccagtatcttcttcaaaaagttctttcctgggtctataagttgaaacatattccctactttaacctctaacagattcaggatatcaggtcttttgttaaggtctttgatccatttgtagttaagctttgtgcaggtgagagataaaaatctagtttcattcttctccatggagctatccaattccaccagcagtgcagagttaagattctttccttttcagtgtgtattttggccactttgccaaaaatcaggtgtctataaaggaacatagacttatattggggtgctcagttttgttcccttgatcagtgtgtttgttttactatcagtaccatgctggtttgatggctgtatactataacatgaaatcaggggtggtgccatctccagcaatgcttttattgttaacagttgtattaggtatcttggtctttgctgtttccatatgaattttgagagtgcttttttaattatgtgaaaattgcactggaattttgatgggtactacattgaatatgaagattgcttttgttacagtggacattttcatgatattaatactaacaatccatgaacacgggattgttatatttttcaatcttatgttatatttttcaaatctttaagtgtcttaaagtttttattgtttatatttattcccagatatttttgaagctattgtgaatggaaatgttaccccgatttctttcttagtatgttcattattggtatataggacgccggctatttcagctgtaccactcctgagcatattccgaaaggactctatcctactacagagatacttaatcttaactccatgttcattgctactccattcacaacagccaggaaatgaaaatagcatagttgtccatcaactgaaaaatggacaatgaaaatatgatacatatacatattggttggaatttttgtcaacagataccaggatcatttggggagactgaacttcaattaagaaaagtgcctacatcagactgatttgtgggcatggctgtggagtattttcttgattaatgattgatgtgagtggaggacctgacacattgtgggcaatgacagctctggatgggctgtcacatggagggacccatgactccagccccatatgtagcagaggatggtctagttggtcatcaatgggaggagaggcccttggtcctatgaaggctggatgcaccagtgtaggggaatgccagggcagggaagcaggagtgagtaggttagtgagcagggggagtggggaggggatagggggttttcagaggggaaaccaggaaaggggataacatttgaaatgtaaataaagaaaatctctaattaaaaaaaaaaagagaaagaaagcaggctgagcaaaccatgaggaacaagccagtaaacagacttcctccatggttcatggtctctgcttcagtttattcctccaggttcctgctttgagatcctgccctgactttccttcatgatagactgtatgttttaaagtaaaatagaccctttccttccaaaattgcttttggccatgatgtttatcacggcaataaaaagtaaactaagaattgttcagctataaagaaaatgaggttatgaaatgtgcaggtaaatggatggagctgaaaaataatcattctaaatgagataggtaaaccagacaaaccatataacatgtcctatcttatatgtggatgctaactttaagatgtacatccaaattgaagtacccatagaagtcggaaaactaggaaggagtcaagatttcaacagaagagggctagagcacaggtggtatgaaagtctaaattggagttctccattgactcccttttttgccttgtcttattctatcctgttttgtcctgtttggcctgtttgaggcctactcttttctgaagggagatggaggcaaagtggatctcgggaacaggggaggtagagaggatcttggaggagtggagggagtggaaactatggttgagatgtgttatatgagagaagaacctgttttcaataacaaaagaagttttgctggaaaaaaagaaagagaaataatagaacaggaaagattaaatggtgagggagataggagattggggtaaaagagggagtatgagaagggattgctaacactaaaggcttttgaaaataccatgtagaagtctactactctagaagcttcctgaactatatatgcatacatatacaaaaagagttagggtggagttaccctataacatgtgaacaacctctctctcagataccatagtatcctccttttgtgatgttgtcttgtctgacaccattaactgggtgaaaaagcatggctggctaggtcataggtcctaaggaagaagctaatgctattactctgctaaatggacttagtattacactgccccctgaattctcatctttatgcccagagagattagtgctctttcagcctttatcggagaagcttcttttcagccgatggcagttaataaagagaataacaactgatcactttacagagactaggggattttaggatgctcaattctaattggacatctgtcctacactgctacaccaaagctcaaaaaatatttgggaagaagggaatagagttataaggagaatcagaagtttagagtgcctgtagcaaaacactattgttgaacatgacaccaccattgcacacagaattaatagggaatggataggactatatgcctccgaactctacaggctcaagcaacccaaaattccatcatgaatgggagagggggtcatgaagtcccacccctacctgaggaggtattgacaagtgacatctgctaggagagggagagagttttctttagggatatgtcccctgagaagctacccatgccccagtagacagtcctatgcccatgcatatgcaggcaacattaaagagactctaagatggaaatgaagttgggagggaaatgtggtttagggagtgaatggggatgaatttgatcaaaacacattatatgcatgtataaaattctcgtgtgtatccatgcacaatgccttgtaatttcagctcttgagagcatcgagacaggaacctagagtgcttgctagacagtcaatctaattagaactgtgaattctgcttcgcatctgcgagataacctgtctgaactatacaaggtggagagcccccatttcccctctccaattcctcccatctctatattatatcaatcgaaaggaatacacacacacacacacacacacatgcaaaacaaatatttaaacagcatggagaaacttttctgggtgttagacattgtcattattttcattgcgatgatatttttacacatatgccaaaatttaccaagttttacactaaagaatttccaggttttataagtataaaagaacataaaataacctctgtggatgaaaataaagcaggtcataactgtatccacaatttgtgttaagtttcaatagtttaagagagagggcataggctttaaggcagatgagagagggggtatgtagagatggctccttgtcaacactctttcaggtgaaatttctcaggctggtttgaatttggattgctattttaaggttcttggttaatttggaaatagccatatgattatttttatatcttataaagtagtgaatgcatgtggtttcagaaagtatgaactatgtacacataagcttataatatatggaattaactgggatccagctcaaggggagaccccaaggtctgacactattactgatgctatgatgtgctcacaaaaaagggatctatcatgactgccctccaaaaggcccaagaagctgctgaaagagtcagatgcagacacttacacccaaccaatggactgaagtcagagacccctgtggttgaattagggaaaagctggaagaagctgaggaggagggtgaccccataggcagaccagcagtctcaaccaacctggacccctgagatctcttactgaaccaccaaccagacagcatacaccagctgatatgaggccccccaacacatatacatcagaggactaccgggtctggacttgatcagagaagatgcacctaaccctcaagagacttgagaccccagagagtggggaggtctagtggagtggagggagcatcctcttggagaggggggcggaggaggaggtataggtagtggactgggaggggaataaagtctgaactgtaaaaaaaaaaagcttaaagaataaaaatattcaaaaacacacacaaaaaaccccaaaggaatagttggaaatttttaaaataatttttcattaaaatttttctctccaccaatttttaaaatagaaattatacttgtgtgattttttttcagttctctgattctgtttttcattgtattgtctatgataccataagtttctctactttcttcatgatgaatgtagttaggagcctctgctcctgcttcttgtggatgctaccctagttgtcattaattgtcaagttgacatagccccgtgtcatctaagaaaagaggcttgagaggcatttcctaggtcaaattaacctgtggatgtgtctgtgggacttgtcctaacaattaattgatacaggagggcccagcattctttgggtgtctcttcctaggcaggtggtacaaagctagcaaagcatgggcctgagaggtagccagcaagcagcgacctcccatgggtcttctctaatttcttacctgcagtttcctagtcagaagtaatgtcatgtggaatgacagttctgccatcatgttccttccttgtattcctgccctgacattgctcagtggtagattgtgagctgcaagagtaagatggggcaaattctttcccctccaagttgcttttgatcaagatgttctgtcacagcaacagacaacgaatggtaacaggcaccttccgttttcagagccttggttgcttcaatttggattttgtgctccgcaggcctgccgtgcagccctcaaccttggccttactttcattagtctctggttttaggtccactgttttctgaagctaatatatgtgtcaatctttgtttactcttacattttgctagaatatatccctgagtaactttgtaggaatagggtgtaaaatgtgaagtttgggaatttgtaaaaataaaaacatcattcttttgctgtcagactcaattttgagttaagagacagattacattttcaaaataatttcccttcagatagttgaaggtgtttctctattgctttctcttaaaaataggttttctggtaagaggatcaatttattcaaaatcttgtccatttaactgttgatgtttttcctttgtgaaagctcttagggacttgtttttttcctttctgaaagctcttagggacttgattttctgaactgttaaaatgtgtctacttgttgaggaaagtgcctaccatactctgtatgaagcctgcaaggcaataaaccacacccatctctatagttgttaggcttgggaacttataaaggactctggaactgtactcttcatactgtgtgcctcaattctttcacattttatttaatctctttagaaaaagctttctgatttgtagggggaacacttggaacgaaattcctgattactacagattctatacatggggaaagaggtgactgttctgtatgtagatgctcagtgaattcctcacatcctcacaatcacacccttttttatggttctgtaactccaggtctacatgctccatgatacactgtgttcccaggacctcaccctcttttcatttgtcctttccaaattttaaactactccattgtctctttgggcaggcccatatctccacaagctctaaactcccccttctattttctctttattagtccatctttattatccagaactctacctactttctgtgtttcagagacctattgaaatctcttttctgctgatatcctgtattgcttcgttatctgtttaatatcattttaatttgagtcttgggagccaatggtgctaacatggcttggttagtcagcttccttgtctatatgtgtatatccctgttaaatgttagcttttattagttttcttatgattcttttgaaaatatttgcaattaggggcaattaggtatgagctggacaaatctacaccgtttacccatcagtagaaactagagaattcattagggtaaaagccctgtgagagattagtagacagtggtggaatctgattctccattgctttgtgggaagatggctttctcctgaaaactaacaggcaaacataggatatacataaaattaactctactgaaactgttgttatacttcattttatcctaatttttatcctaatttcttttcaggggctagctctgctgtgatactatggggaaaaaaagttaggagacaatagtcagcaagaggctttcattgtgcagtggtgtggccacaaatgaaaggcaggaattttcctctgatcaaacagagttttccatagacacagtctagaagtagattctaatcagcagccatgttgaattttgtttcttcttgtctgttatacagctactataacaattttggcctgccattatatcccataaccagttatttggtatttaccaccaggaggcctggcccctcttggacagaggaggaacaagaatgccaagctgactgagaactgaactgtaacttcggatttgtctaatctcacagtgaaatggtctttctttatacccttgcaactttcttgccaatccctttataccacttgtggatctcattttacagtatttaaaatggtgaatttgaggcccaggtcttctactacttttttctaatcttttggcttgtttcagactattattgtgggctgaatctctcctaatcatatcactagtgattaacccgcctgtccttaagatatttatatcttagactccatcttaccttccctaacctttctctttgaagttatcaactgatatctgagatttctctctccctccttttcttcccccccacaccctctttcctgccctgtcttctctcttcatcttcccttccctccctctctcctccttttgtttcaccctctctttttcactctccctctccaccatcatgatcctcttaccctagcctttcaagtacttggattgaaggtctgcaccaccatggctcttgagatttgttttctattttctcattttggaaagccagtttgggattaaaactagttacaattgattttagcatcaacttaaacagaatgtgatttatgtctccctaaaatcctctccgcttaattttcctaagatatctgaaacatttgtttctgtctcagcatcagtagtgacctgtgtcttactttgattttacctagtcctcactgataagttcttatggttatcactttatagtcacaggctacctcactttacccttcttccatacttgatttttaatatcatggccaaatatattttaatttacatagtttacagggcttggggctctataaagaacaaaacagattttgtagaatgctgctgacagagaaattttgaacaagcagaaaagttctagtttaaaatagattatacaaacaatctcattttgttcaccttcgtgctctgacctgttagtccagctttaggaagataaactataacaaaattacacaatgttcagtctttaattcacaatcaagaggatgcacttgaacttactttcttaacccagagtgcaactggtttataatatggtcctactccaagtactacaaatggaggtgcttctttcctttaatatgccaatgtgctttgatctttagaagtatgaggaattacaaattaaattagcaaacaattcctaagggaagtaagtgatagccactatatatcattgtccttcttaattaagtatgttacttctaaatcttgaactgaaagtcctctctatatgacatacatagatacaaactactttttgatttatgcttgcagatgctatttgtacagtctgccactgcctgtatgtctctgttcaacttgtggtcagctaaaagcctttctccaaaaaagtttccaaattccatattagattgctagctggtctcttttgctattttacccagcaacccacagctatgctgtgttatttgaagctatgctttagtgcatcctttacaatgcgtcttatgttctgcctgtttgtggttatgctataaagctcgccataccaaagatgcttgagtatccttctgtcattgtgtctccacatatgtcaccaatgaacatagctttaatgctgatagaccagctgaactttcaaaatcccagtagtggtggtcctctcttgccatttcacattaagcatgattctgactctaacaatagaatagatcaatgagataaatgtgacatctgtgctggttatggatttcaaagtcatataaaagctgggcatgtttgtattgtccattgatacaaatcagttcaagaagcttgtctttttccacctctgttttgaacataggatatggaaaggtgaaagcactgcattcctccctctttcattagtagtcatgcttttataatagccctcctttcccccttgatatgcatcataagcagatttcacacttgtcctacggacaagtctaaacatattctgaaccctctttgaggtgcctataaagagaataaaatttatattaaaatatataaagcattatttaataaaggttaggtaacttgttcaagccaaaactgagtaagaaaaaaactaaacattgagctggtttattatgcaatttaacactgataccacactaagataatctccctaagcagaggtactgtactttctaattttttttttatttttcagtaacttgcattgtttgacattgatgttttttagtcaggctgcctaggaagcagtatccagagactgcatttagctctatgtgtgatgaaagtgttcattctgtttagctttactacataatttcacatgccttccagtggatctattgaatggatgaaaaaaacctagcatccccatcagagatactcaaggagccaatttcacttcgtgtataggcacactgctaccactgccaccccaactcagctggtggtatctcctatgggatgacgctttgatcaatgttgaatgcccttgtttgcttactcccagaaagtagcacacagcactgcactctgttcagcagtcagcaaatactgtgcctttcttcttaccattgagttggaaacatttttatctccaattaagtactatcattccacttcaaataaattgtgtggtttgccctttttctacatatgtttagaatattgtctaattcagaacctttcatgtgctatgtacaaaatgtttgttcaaaagacagcactcgggtccgagacccgccgaacttaggaaattagtctgaacaggcgagagggtgcgccagagaacctgacagcttcaggaacaggcagaagcacagaggcgctgaggcagcaccctgtgtgggccggggacagccggccaccttccggaccagaggacaggtgcccacacggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccagccaccgtccagaccggaggacaggtgcccgcccggctggggaggcggcctaagccacagcagcagcggtcgccatcttggtccgggacccgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtccaggacccgccgaacttaggaaattagtctgaacaggtgagagggtgcgccagagaacctgacagcttctggaacaggcagaagcacagaggcgccgaggcagcaccctgtgtgggccggggacagcggccaccttccggaccggaggacaggtgcccacccggctggggaggcggcctaagccacagcagcagcggtcgccatcttggtcccgagactccaaggaacctaggaatttagtctgcttaggtgagagtttgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagacggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgaaaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaactttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctgcatataaaattaactcaaacaagtcaatggcctttctctacacaaagaataaacaggctgagaaagaaattagggaaacaacacccttctcaatagccacaaataatataaaatatctcggcgtgactctaacaaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccatcaaaattccaactcaattcttcaacgaattggaaggagcaatttgcaaatttgtttggaataacaaaaaacctaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggatctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatgaaaaaaaaaaaaaaaaaaaaaacaaaagacagcactctgaatgaccctctccagacctgtttataatcaaagcgtattaagtgtccttaataagattaaaaatgtgttcagtaccaccttttgattcattttctatctaagatgtgttaaccaagttcagtgcttcactaattactacaggaatacccctatcttgctatgatggaagcacttgaagattttgttaagcatttaaaatacagcttagtagtagaatgcttgcctagcatgttcaaagtcctgctcaatccctagcacggcaaggggaaacaactcacatttcagagaataaattatcttatttttaaagctgtagagtgtgtgtgtgtgtgtgtgtgtgtgtgtgtgtgtgtgtgtgtgtatgtgtgcacgcgcgcacactcacgcacatgcacacacgcacacacacacctgttgagtttcaaagagggcaaatgatcccctggaatggggtaataggcatttgtgagctcccagaaattggtgcaggtaactaaactcagtcttctgaaagaaaagcaagcgcttagccactaagtcttctcctcaggccctcagaacgtatgacattttaatgtttcagaagtctcagctgattattgatagatgataatgatgatgagatgacattggctataataggaaagatagattaaataaattaactccagaatattgaaagagaaaactttttaaagtaaatgatgtactaattttagaaagtctgatatgcacatgtctcctgttgagatggagtattgactttttataacctgattaagattgacagaagaaaaggtaaaaaaaaaaaaaaaaaaaccactagctgtccaggaacccttttttactaaggaaaagaaagacaacttaaccttttcagtctaggttataaactagtttcagaacacacaatacagaagtctcttgaaatgtatctcagtgattatgtgtgttgcgatcccctaaagagcaaatttgggtcaggttcttggatttcacttcaggtctacacaatctaaacttagtggaggatggggatggaggcctgggattctatacttttaatattcatatgtagtgattctgatcaagaatgtataacactcacctacaaagtctctcagttttagcatcctatcaatttcattcattattaatcatataagatttagcctgtcccttcctggttggtctccaaaacaggcccaattagaatgaaatcatactgtggcttcaagaagtgtgtaataatacagtttgaatgtggagtccctaaaatttcaggtattgctcgtaagatgacatcatcatatggcaggactctaagatttaattaggccatgagagtaccttccttataaatgcgattaagtccatataaaagggtcttggtaaaacagtctgttctccttcccttcttctttctaccttccagcacacagtattccttctggaggatgcactaataaggcaccatcttggaaatgagtgcaatgctcaccagtcatcttaacattaattttgccttttcagcttccagaactatgagaaaatgaagttctgtgctttataaattactcaggtttaagtgctttgtgttagcagaaaaaaaaaaacttgactaaaatcgtttagattattctcttaacacggagatatttcttaggggcctactgtgtgctaggaccaggtctaggcactagttataaaaaaattggatgagctgtgctccttccctcaaaaggcttctgagtcatttcctgtgaatcagctagtacaatccagtatctttgcaatgaaatagaaaatgaattaaattcaattcagtctatgtcgagtgaaaagtatccaataaatttatagggtttgctattagaaaaaaaagtttgtagtagtaatccttggagagtcactacaataatgtatgtagcctttgtgtctcactgttagcaaattgtttctagctgtgatccctgtaatctgcaggtgctgtttaccatgtaattttaccataagaaacaagaatgtaatcacataataaagtgtaaagaattagattttcttccccttgagcaaaatgcctgactgtggccaacattcctggtgctctctccttgtgcaataggaaagcaatatgctgaaagagaagactattttgttcatattctacaacgtgcctctggagaccatactaatgaatgcagaactaaagctagaattcaggattcttgtgtgagaagctactgatgggttttttttgtctttatcattattctatatagaatatagtttccctcctgcctttaattgaggctcaaatagggcactgtgaatagggaaacattttgattaaaacgtgttttgtgttgttttctttcgttgtttgagaaaatatgacatattcaaagaattttcatgttcaagcaatccctttctaatgaatacttgacttatgaatatcctatactatcaacagcttctctttgagggactttgagatactcctacacctgtggaaattggaattgtttctgttgattgcataaatttgtctctcccccagcactcctgttttggaaggttgaattcttgtaagctgtcatcagacactttggaacaagtgtgaacaactttaatatgtgaatgacttctctttctgccaccaccaggatataagaacgcacaaaattccataccagacctcacatagaagttgtgcttaagaggaaacccaaagcacatgaagccatgtctgggagtgtagttggcaatggtaaagaggtgctccacttacatttggagtcctttatcccagaaataccattgtactttaataacatacccttctagaatttgggtatagacagactcatattgcagccacaattgaagcagtaagcaaatggtctctaatacagtcaatgtgcatcttatgaaagcactattcaaaactacactgcttcttgtttattgtttttacatgagcttaatcggtttttaattagatgatatgcctgtagccacaaatttgaaggatctagagaatacattctaggtgggtgacttgaaatctagtagttgacaacaaggtgacagtagaaaagaaagttaagaactcaaaaaacagtcataatgaatgtttcatatctatcatgaatgaataaaataaaaattactgacattaccaagtattagtgaagatggaaaacaccaagactcacatacattgatggtgggcacatacagtgctgcaatcactctagaaagcagtttagtacctatcacataaccctgagggccaactcttagatgtctttccaggaaaaatgaagatgtatctgcacaaaacttacacataaatgttcacaactagaagtaaccgagatgtacatcagtaagaggatgcacttaaagagtgataaccctatgctgcaaactcggggatattttaatatcttggaaagaggggttgaaagaacatgtgagttctggaaaacacttttctggagaagacatggatataacactcatgaactcatagcatctgcagttacctacataggatctatatgacacaggacccattaacattccagcatggatgagggagggccatagataaccttaggagctattggtagttcatggctactggatgagaaggagtcttttttgttcagggtttagccactggtaagaaggccaaactccattagtaacaccacacccatgtacatgcaggcaaccccaatgaaactcaaaagagttaaaaagagaaataagaaaaagaaatacataacactaggaataggacatgtggggaaaagctttagaaagaataggaaggcaataagagaaagaaatggggtaaatagaatggaaatacattatatacatgtatgaagttgtcaaagaaaaacttttaaaaattcaaaggacagagtcttatgataaaatactactaattactaaaaactaatggaatgcttatacatataacaggaattaatgtcataggcatactgaatgaaaaattatgcatatgcatatgtgaaagtttattctaggatgggagaaaccaaactgtgacaatagaaatcagaactgaagtcaacttggggcagaagatactagagaatgactaaaaggggcaaaaaggaaacttgtctagtcatggaaatgatctatattttgagttgagtagagattataaggattgtacatttgtcaaatctcttgctttaaaataacattttttattataggtaaaatatatctccattttcacatggcaagaattttaaggaagaaaaaaaacccttcacctgaccccctcctgttgatttggcataaattccttaacctgatccaatcccataacgcccccctgttcatctctcaccattcctctctacctcctattctaagttacaagtagttttacaaactgtgtttgtttttcttcttggaatttcaatacaatgttcctttcatctggaattccttttccatttgtaattaatcattaaatcctttccatcattcagggcctatgatgttacatcttctctaagaagcctcatttattagcaatctgtagtaggtgcttccctcttgctcaccaggtgatctcaagctcctttttaacaaagcatgtatttatttgtaatgtgattataataacaaaagcccctcaagattgtagtagactggggtcatttagtttacaagcaaataagccttcacttattctgcaaagccttgaaataaaagtaaattctatccaaaatagctcaggttctagtactcaaagttatagaaataatggataaatagttaggtagatagatggagagatagataaaaaagtactcagtgttaaaaataataaataaataggtagatagaataaagtactgttataaaaattaaataaataaatgtgtagatagatggatggatggatagatagatagatagatagatagatagatagatagatagatagatagatagataacagcttgttctatcccaagattattggcagtctttctgattcaggagtttgctttgagtctttattttgtttatttatttgattgtttgtttgttttccagacccagttttattaagaagcacctgacactgggtttatgatcttctgtctcagcctgcagagtgctgggattatgaatatgggccaccacacctggcaagatcaagatcttactttaaatgccagtttgatttcatattattagtgttgtattagctcatttatatggtggtttaagtaacatttctgtgggcttaaccagatttttttttgattctatggaaaaaatacattctctattacagtcaagtgaccccaaaatactaaccagttgaaccatgcgagtatgcatgtgtggatgtgtgcacgtggaagctccccagtgctgggatacgtataaatatacatatttagaaggcaacttgactgcatgttcatttagcaaaacatcaaaatagtaagcttccatctagggcctatgatttccccaatatggacttttgagcacgtttgcagtatcaagcatgcatttcctcctacgaggtaggcctcaaatccaatcagaaaacaacatgttgccctcagctaatgcaccagtgggcaaatcttgtctgaatagtcagttttgctacatgcagggttcttagctggataagaccattgatgacttttctccctaaatagcctgtatagcatctttcaatactacgaaagctactaccaagcagtatgcttctagctaagttccaacttcatttctctgtgtcctctaacctaggtgtgttctgtcttcaacaacagggtcataccatctacttctgataggtaattaagagcaattggcaatagcctgtattgttttaggggagtctgtgggttccctggagaatagccacttcatgtggataaatgtaaatgttttgaaatgtaacatgattaataatatgcaggttacatatattcatttattcattgatacttaataaaagaatctattctcctagatgactgtgcttaagtctactggatatagttgtttgatataaacaatgaatcataggaacttaaagaaagtttatatagactgttagggtttccatggggccagcccattttttttaactaataaatgcaccatacatgcagattcaggaattactatttttccagctggcaatagaatgaaaatgcattcattttaattttcaaaatcattaaggtatttaaacatagtaatatctaacttttattgagtatatattatatgagataggtcctgtgatggtccaataactgctttaggagtaaaatgctattttcaaatgaggaaatggaagcttaagaaatttgtccattctaaggaagaatgaagtatccacccttttgtctttgttcttgattttcttgtgttttgcaaattgtatcttgggtattctaggtttctgggctaatatccacttatcagtgactgcatatcaagtgacttcttttgtgattgggttaccgcaccgcactaaggatgatatcctccagatatatccatttgcccaagaatttcataaattcattctttttcatagctgagtagtactccattgtgtaaatgtaccacattttctgtatccattcctctgttgagggacatctggattctttccaacttctggctattataaataaggctgctatgaacatagtggagcatgtgtccttataaccagtaggagctaagacgaaaggatggaccatccagagactacccaacccggggattcatcccataatcagccaccaaacccagaccctattgcatatgccagcaagattttgctgaacggaccctgatatagctgtctcttgtgaggctatgccagtgcctggcaaatacagaagtggatgctcacagtcagctattggatggaacacagagcccccaatggagaagctagagaaagtacccaaggagctgaagggatctgcaaacctataggtggaacaacaatataaactaaccagtacccccagagctcatgtctctagctgcatatgtatcaaaagatggcctagtcagccatcactgggaagagaggccccttggtcttgcaaactttatatgccccagtacaggggaatgccagggccaagaagtgggagtgggtgggtaggggagctgggtggggggagggtatagggaattttcgggatagcatttgaaatgtaaataaagaaaatataaaaaaaaagaaataaaaagaaatttgtccaaggttacacagcagtagggtacaaatctaaacctctgtgcactgtttaccttatgcgcatcttctcacctcaagtatatacttaatgaagctatggttatcattagtgaaaccagacccattcacatagcaaacatataagcaatgattagaagatagcagagggccaaatatcaaaatgagtactttttatacaagatttattttattcagatacattatcttataaaaacattagtagttgaatgagaataggtttatgttttccttaaaaactgccaaacagaatgggaaaaataatcaacttttgtttttcgctaaaatgagtcttctagactacatgttctggagtttgggaaaaggcagagagttgttgtatcctttaccatatcttaactcccataagacaactgacatactggtaccctagtattatgctctctgctctagaaacaagttaaaagcagagcataaataacatgacaaaatcagatgtatgtgataatcaaatccaaggggtaatagaaaatccaaggctaattctggatagctatcagtaatgtggaagaaaaattagaaatttattgcaaatcccagaagtttgtggacaaatgtaacctacgggacttctgatagtgctattcagagcaaaatagagaggcttcagatattaaccaaaacttcatacctacatgataagaacagcggtgattaaagtcatttgaaaagtagaaggaaagggaggcttagactttagatatatgaaatgtaatggaaagatggaatatgtattgaaagctagttggttggtttttttatgtaggatatagctaacaaaggccaacctttgatacatctacttgttaattttacagatggccctcctgaatttcttctttcctgatgaaaaggcatattctgaagaggaaagtaggcgtgttcgccgcaataagagaagcaaaagtggtgaaggagcagatggtaagtctactcaagtgatcttttttccatgatatactaataaaaatattcttcattctcatgtattatccaaagatcatggatttctccagcctaacctgataatcaatcttttaacatagaactaacaatagaaggatccttcatcctctaattccagataccttcagtctttttcagtatgtttggaggccatgctagcatttatgtccctcaaggttactctcaacaaggacctcctctctcctggggacataccatatcagctatgtccaccaagataatttgatcctatttttgtaactgatagtgttttcccatgctggcaatttatagtatgtattgtttccaatgataattataacagttttggtatctgttactatgtccaaatctaaaccaaagcatgtaacattactctggaagttccttgaggacaaagatcccttccccttacataaccctataatatggcctagtatttgtctcaccggtagtatcgtaatgtaacttgacagtgtttactgtccctttggctaggcagtgattcaccaaggaaaaccattcccattatgggtgtaatagctttgagttaactagtagtacattcaggggatgacaaaatgttgtgggagctcctgggcagggactttgaatcgctgtatttcagtgttactctgtcagttgacagaatgctacccctttggcacagaggtttataggatacatagctctgggctgttgaaaagccatctggattcaaagacaatgtgtctggctacatctgctgatgatatgtgtctgtaggggcttacaaagcaatatgattttataaagatgaaaatgagatttttaagctgacatttgtcagtgtgagtaagggccaatgatggaagcagttccagaaagtggaaacaattgaagaaatggaactagtactgccttagagttaaggataaagggtgccaggggattgtgaaatcgtctaagatacttaacctttcacctgggaggctatagaagcatttctttagatgtgatgagtgtctcaatgagttaaaaggtagcaaagcaatccaactttccttttggaaagctattcatgttattttgctggctatggacagtgtttgtcaaatgcattctaaaaatatttactgagtaaacagatccaatttatatcacagtaggatagaaaaactagaagaagatctgtatttgtttagttaatgtttatattcttaccatgtagacaaggacatggtacatgacagacttcagtgaatatttctggttccccatggggacttcatttctagtgcagagataaacagaaaacaaaggttgtggtggtaagggctgtaaagaaagatacagcaaagaaacagtgaaaggggtaatggagtatactgaacagtgatggggtgggggtctttgtgaaaagggggtggctgaggacagccctgagtgaaatgaagggaaagcaaacggaagaaagcaaccaaaagttttttttttttaaaaaaccctctgaaacagagaatgcatgatatgtttcaggaaaatcagtgtgactgggatcataggaagagaaagaaaggagatgagggcagacagtaaaactcattctacagccttgtaagccaaaggaaaggtcctagtgtcttattctgcatggactggggaactatattagatgagtttgagtagatgaatgacagtatttgacttacattttaacagactccttctgacttctctaatgaaaaaacagggagactcaaagggggtaatatccaggcaagagatgataatagcttagaatagggtggaagcagtatagttagtaggaagtgctatgactctagaaagattttgaaggaatggctgataagacttagggatctataaaaggatatgaagatgacagacaagagccaagagtgacctcgagagtttgggatataaagaactaaatggcttgaattgctatttctgagatggagaaggaaagggagacgtgtagagatgtgtgaggaaagagttatgaatttagaaatcagatttgtgaaaggaggatatagatagaagagggggtatcagtgatgaatagagttcaagtttatgacatatttgaatttgtctttctgaagctaatgactatgtacaatgactatatattagtattttaattaaaaataccaaaacataaaagaatttaactagacctgttaaatttgagatgcccatttagatagccaaagagatataattcaacatcactatctcaagataatgagcgagttctgttttatacaaataatgaagttcctaataaagagtaagcctattagtaattaattttaagtctatcgttatttgatattataatgcaagtttagattatctatctcaagtttgcctcacaagtgtcaaagaaaaagcgatttggtgttcgaacctgcctcctggcagaagttgtgatccactcacagaggacatggtactaccagaagatcctgcaatacctctcctgggcatatatccagaagatgttccaactagtaagaaagaaacatgctccactattttcatagcagccttatttataataaccagaagctggaaagaacccagatgcccctcaacagaggaacagatacaaaaaaaagtggtacatttacacaatggaatactactcagctattaaaaagactgaatttatgaaattcctcggcaaatagttggacctggagggcattatgctgagtgaggtaacccaatcacaaaagaactcaaatgatatgtactcactgataagtggatattagcccagaaacttagaatacccaagatataagttacaatttgcaaaacacatgaaactcaagaagaacgaagaccaaagtgtggacactttgccccttcttagaattgggaaaaaaacacccatggaaggagttacagagacaaagtttggagctgagacaaaaggatggaccatctagagactgccatatccagggatccatcccataatcagcctccaaatgctgacaccattgcatacactagcacgattttgctgaaaggtccctgatatagctatctcttgtgagactacgctggggcctagcaaacacataagtggatgctcacagtcagctgttggatggatcacagggcccccaatggaggagctagagaaagtatccaaggagctaaagggatctgcaaccctataggtggaacaacattatgaactaaccagtaccccagagctcttgactccagctgcatatttatcaaaagatggcctagtcggccatcactggaaagagaggccccattggacttgcaaactttatatgccccagtacaggggaacgccagggccaaaaagtgggagtggatgggtaggggagtgggggggagggtatgggggacttttgggatagtattggaaatgtaaatgaggaaaatacctaattaaaaatttaaaaaagaaaaaagaaaagaaaagactgctaaaaaaaagaaaagaaaaagtgatttgccttaaatagttaaaaatttatttttaaaaaacaaaacatttttcaaagatcaaaaacaggactaagggccagcatgatggctcaacaagtaaaggtcttactgcaagactgacaacctgagttcaactcctcaaatccacatggcagaaggcaagcacctgctcttgcaagctgttctctgacctctacttgcatcatagcaggcacatgcatacagcacacacacacagacatgaacacaggaatgcatgcatagatgtacagacactaaaaaaacagaaactcatttaaaacatagcagaaaaacagttctaaatttctattagttttgtaatctattgatatcctcagattggatttcaattcccaaactattttactgtttgttatttagtgagccttctacatacaattgaaaggagtaaaccatgaaccaggcctcagagaagtttacagagaagctctggtaaaggggctggtagatttataggcaagaggtgagggtgaagcacatatatagtaatgtggtagattcctagagtatcatataatatgttgataacatttctcctcaaaagagagaatctcagctaggaaaatatttccataaccttgacctgtatgcaagtctctggggtactattgctgatgtgggagggcccagttcactgtgggcagtgccatgcctgggctggtgttcctgattgttgagcaagccattctttcatggcctctgctccagttcctaccttcaggttcctgtactgaattcctgacctgacttcactcagttaatggactgtgacctgaagtaaaccctttcttacccaagttgtttttagtcatttatgttttattacagcaatagaaaccataactaagggactgactttcctgttccattggtcttttatactagatgattagaattataacataagcaatccctgttttatcttcaaaacaaaagcagggccatcaagatagctgaaagggtaaaggcacttgtcaacaagtctgatgacctgagttcaatgttctgaggcaacatttggtagaagagaactgactcctgatatttgttggctgcccttcacacatggtacacatgtatacacacatgcacacatgcatacccatgcacatacacacacacacacacaaataaattctgggcttggagagctggctcaacaattaagagcatttgctgctcttacatgagtacctagattcaattccaagtacccacaatgagcaactcacaaccatgtataattcatatttcagacaatctgataccttcttctggcctctgagggcatttccatccatgcagtccattacatatacacaggtacacatagatatacataaaattaaataattagcataataaatgttagctttttctttaaaaagatagtagctatctccaagatgtatcagttttttctaacctgcaatttaagaatgactacattctccactttctcagttctgagtgctctgtaagtgggggattgactcgtaaatagtagttacaaacacaacgttactttccccaatataaatcttataatgttattgttataacaactcttaaaatgaatttctttttgtttttatattttacatgtatagatgcttttcctgcatgtctgtctgtgtaccatttgtgtacagtacacatggaaaccagaagtggagtcaggtcccctgaaattggcattacacatggttattatatgccatgtaggtgctaggaattaaacccacatcatcatgagtagcaagtgctgagccagcttccaagaccatagattaatttttttctgttctacatagctatatatctgcattaaatttatgtgttttgatggccagaaattttttagtagtttctgaattcatttctgctaattaacgaggcttttgggttactatcattgtttcatttcatagtgtttgctgaggcacaatacataagcaatctgtgtcaaaatttcctgataaagtttgtactctgaagtcataattgctccaggggccatctcttataggctacaacatggactgtggaatggattcaggagctcatgagggaaaaagtgcagtgtggtataaaagaaaaggtacttgagcaagttacagtctaaggattacaaatcctaatatccccatatattagctgtcatgtgatcttggagaagtcacatccctctgagctttccttttcttgttggtataatagagacggtgagcctggcttaagacatgaagttactgtattgatccaaagtgccagtagatttttaaaaaggaaaaaaattgtaaattactaaatgttattactcagttctctcaaacattgtcattatcttatagacaaacattataactcagcagtgatgttatatttcagcaaaattctttcttctcattggtactgttcagtagggtagcacatagcagccatagggagaaaactctagacctcatattctgacctacttcatcacaacaaagattgatcacaactgcatattttgtccatgacagttccttgctctatctgcttggctttgtctatctacctatttgtttatcatacccatatatgataaagacatagagatagaaatatgtgtgtatgtgtgtgtatcttgggatttttcttctttgataattacttttgaacagataaaagaagttagtatccttttctactattataaatgtgtaaaaatgatgataaattaagattaaaatgtatcttttgtttttaatttcttaaaaataagaatgatttaggatatagccaccattccgttgatacaactgatcataaaaggctatggcatcaaagaaaacagatgttttgtttgtaaatggttagctagaattaaaatcgcctttatgctggtattgctactatatttattgcttttcagtgccccatcactgagctagtgtcaaatgagaaagactagaatcatttcaataactgataggatttcagaggcttattcacaagatgaaatttaagcttttgaaagcttaccatgtgtgcacttgaagaagattcttgatttcagttgtagaatccccaaggttgcctgctgtttgtggctgccaacagcttaagggcccgcagtataacactctagaaagtggctttatatcaaataaaacattaaacaagccaaaatatcttagcttgttcatactccaacatagcctttaaagctatattttctttgatagaactagccccacagtaaatgatctcaataggccatcaacattgacacttggttaacaagcatttttcgaataacaactattttagactatccagtaagacatatttctaggctctgtagttggtatagctacaaaactcctattcttattatatataaactaaattgaattgaatataagaggttaaagtttgtctcataagacaaatatatatatatatttgttttctgtttgtttatagttcttaacttttatattgatgcatgaaatcacgtacatacatgggaaagtaaaaataaatgttgaagaatgtaaagagggctaacagtagcggagagaaggaagagaaagaggagtaggagagcatggtgggcagaacttgctcaacatatagtggatattcatccacaacccttgaaagtaaatttataaaagtagaagctgtttaaaaatatttattgggttaattctaggctatgtggagaactgaacccaggtcttgcatgtgctagacaaatattccacgactgagctacatctgtattccatgttcatagagttttcacggttataaaaatagtacacgttcgttgtagaaaacaaaacattacatgtaagtaaccaagagccaggctttggtgaggcatgcctgtagtgccagctgttttggaggctataattcaagtcaggagtttggaaccggcctgaacaatagagctaaactctatctcaggtaaacaaataaatattaataagtggtttaagcaatacagaatcaggtaaagtaagctgaatatgacataccagccacagaagtactataaagataattgtttactatttgcctgaagaagacaacatacccagatattctgagattctctaaaggtccttccagtcttgctttcactataactgtttgtttctcaatattagggagccttgtgatcactaagccaagaaacttggattctaacccccatgccattaattgtttactagtaactcttatttcactcatctcagtttattatggatcatctcagtgtaggaactagtagttcctacactgagatgtcaagagtttcaaaaccatgtaaggagtttttcttctaagtacatgcaattctagaaattctagtcactgtacaccatgctgagaaaactctagtggggtaggtactgttcctgatgaaaatttgtcatatccctcaaatatatagtgttacaaaaaagatgctgaattactacaatagaaagtctaattatctccttccaattctaatacaatttctaatacaacttctaactatttctgatttctataatattgtaataacatccaggctagttttaaccaattagatggtatctgaatgattaaatactcaggatttctatttggatggtcaatgagccttttcattagtatccatgaagaggctcactaaggcatgagagcatgcaaatggctttaagaagtgaaggataagaatgttaatgtgtcagctaagtggtgaagtgttcctgtatggctcctcaaaatgtcataaacagatggagatgtgtagttagaaagtatctgttggctcaccctgccttactttagacattctacatcttaaccttctgggcctctttggcctgaaaaattacagaacttctacactgtgttgtttttgttgttgatggtgatggtgttgtttttatttgttttttattcatttgatgcatcctttattaagtacaatgtttattaatcattgctctggatactagggacatggtgatggataagattagccccaagatctccttcaccacattcataataaacgattatattgtagtgtactaagtggtacagtgaggtaagcataaggtgttattaagtacactggtgcctgaactaaacctaggaagtcaggaaagttctcctaacgagtgtaacatctgagctacaatctgaaaagtggcagaggtagccaagagaagacttgagggaagagtgaacctaggagaaagaacgtcagtgctaaaaagccttgagtaagcagggaacttgaatcatttaaggaactggaaagatgatgttggctgtggctgtcacatgtagcatctattgtgctgagatatgttccctccaattctaccttctctgggacttttatcatgaagacatgttggattttgtcaaaggctgtttctgcacttactaagatgatcaggtagtttttgtctttaaattcacttacatgatttattatatttattgatgcatattgaaccatccctgaatctctgggataaacaacttggttatgataggtagtctttttgatatgtgcctatgtgcagtttacaagtatgttattgaagatttttagaatgatgttcatcagggatattagccagtagtttttattctttgttgtatcgttccctaatttggatattggacaacctttgtgggagtttgtcactagaagcaaccagttctctctctctctctctctctctctctctctctctctctctctctctctctctctctctctctctctctctctcctcccccccctctctctcagcagtcattggcctattgtagctcctcatctagatgtggaaccatgtgaaatttcctctgttggcatttacatgtcattatgctggtcttgttgggacagccatattgttgagagttcataactgcgttacctagcaacaagtgccctgggctctgcctcttacaatttttccagccatctcttccatgattttccctgagctttaggtttaggggttgcattacagatgtaacagctggggttgggaaacctgcagttacttattctatgaaatttccagtttatatgtctgtagtagtcttcattagttgcaaaaggaaacttctttgataagaggcaagagctatacttatttgtgggtataaggataggcatttagaaaacagtaagaaactatattggtttaggaaactggtaggaataagttctgaatctgtgatttttttccagctatgagtagttggctaagtttatattactaggcatgaactcccttatgatgaacaggtcttaatccccaagataaaagttccactgttttaccattgtgggcagtttgtaagtccagtcatagtgctttataagctgcacagatgggtgggatcattatttgcttttctccattggcagcttgcataacacctcaatactatgaaagctgcttctcaggcaaacggctttaaggtcagtttccgcttgattcctccaagtccaagtttaaagtgtgtcttttctttagtaatttggccttagcttcaaattctgagagtcaagcaagaaaaatggcaataacttatattgtttgggtggacttcttagactagacacatgcacatacaagcaaagctaaatgcactcaacaggatatataaatgtgcatatatacatatatacatacattcatatgtgtacatatgtagtgatagtaaagaagagatcataaatctgaaggggaggagctgaaggggagaagagggaacaggagtgatgtacgtgtaatgcttgtgtataaaattaccaaaaattaaaccagccctatctctttaaaagggaataggaagtttgtgtgagtacagtatagatccaaaggggaagtgatgataaatgagctgtctgatatgactagatcattcaggactctggaatccattttatggagctcagaaactcctaaaggcaatggagaatcacatgatcaatgccaagaatagattatatgacttgtgtctttaaatactaaatgcacataatctgatccagcaggtctaatagatctatttctagatatactcacacatggaagatcatttctcaaaaaagatcgtctttgctgtactatttgtaatatcataggactgaaaatcacctaaatgtccattactgagaagctggtttaaatgtgaaaatctgggacataaagagtttctcatcgacaaaaggacagaccatctagagactgccatatccagggatccagcccataattagcctccaaacgatgacaccattgcatacactagcaagattttgctgaaaggacccagatatagctgtctgttgtgagactatgccggggcctagcaaatacttaagtggatgctcacagtcagctattggatggatcacagggcccccaatggaggagctagagaaagtacccaaggagctaaagggatctgcagccctataagtggaacaacattatgaactaaccagtaccccggagctcatgactctagctgcatatgtatcaaaagatggcctagtcggccatcactggaaatagaggcccattggacttgcaaactttatatgcccccatacaggggaacgccagggccaaaaagtgggagtgggtgggtaggggagtgggtgggagggtatgggggacttttgggatagcattggaaatgtaaatgaggaaaatacctaatttaaaaaaaagaaaaaagagtttcttatcaagaaaatcaagtttttgcaacacatgtcagaggaagctaacttaatgtccattttttgtatcttttcatttttagcttacatttctaacaaatttaaaataaataataaataaaatttcaatttaaaaataaaacatgcatagcatgccacttttctccccagaactaaacagtctggcaacattatcataacataataacatatactaattaagaaatagaaagcatgttttggtagagaaaatataggttgcttcaatcactttgtatattaatcaaattaaatatcagaatacttttggcctagaactcatggttaggtgcatcctacaaaaatgggaatactagtacacaggtcttgaatacaaggatattgaagcaccaaaaggaggaatcattttaacaactaaaataaattagtaaatgattacattatgatatatagccatgctattggctgttggacaattatgaaactatatgtagatctgaaggactgacaatgttctttctactactggactttttaaaagagcaaattccagagtgatgtgtatgtttccatcttcagaaaaaaaagggggggaggatcttttaatccatcaaaatgtttgcacaaaaacagtcatagaaagaagcaacatcaaacaaaatactgataatttcagattgaaagggtttgagtagaaatggaatagactgtgaagttactatttatgtagttctgtgttatttcaattacaatgagcataaatactacaatgctatggaaaattaattaaaaattgataaagaagggagaaaatggactgaaatgggcacaaacaaaacagagaaagctatatcaccaccaaaaggaccgagggtgaataaattagaagagcagagggctggcaagatggctcagtggttaagagcgccgactgctcttccaaagatcctgagttcaaatcccagcaaccacatggtggctcacaaccatccgtaatgaaatctgatgcccaaaaaaaaaaaaaaagagagcagaaatggagactagcaggcagattacttagtaattggaaacattaaagattggttgtgtgattgaaagaagacaatgatgtcaaggaagccaggtttctggcaagctgttgtagtgttcagtgagatagtgatcaagggaagaatatgtgtggttttagacaggttggagctacaggcacctttgggaaattaaagagacaactataagcagtctgagatatgcatcttaagctcaggaaatatatgcaggctgaaagcatagatatagagatccttagtattaggactccattagttccaagtgagtgttggtctaaactggtgtgtatgtgtgtgtgtgtgtgtgtgtgtgtgtgtgtgtgtgtgtgtgtatacatatatatatatgaaataaaggagggtttattgaagacctcaatgcagatagctttgaacattacttaaccttggggcataggtgatgtcattaggactttttcttctatgcctcctttagacatgttttatctctggaatagcaaaaatagctgttagcagctctgactttatcttaacaatttaggaaacccagtggaaagtgtatgcttcatccagctgaattcaatgagaaagatgttgacaacattggtgacaatggttttaatagagaagttggaacataaaggttcaggatgaaaccagatgatgaagaaaatactatggttacatagtgcttttcacatagtaggtatttaataaatttcaggttattattttgttctttcttttccatgtatttctagcaaatgaagtaccaagttcaaaggctaaggattccctgtgtttgcttcttttggactcttaggggcttgaaataaacaccaatgaaaaatataactactgaacagagaagaaaaacaagagccccaaacaaccaagggtgcttttaaatacccattataatttgtttaaaaaaatggtgttttaatcccaaattaccttggtattgtctttacctcactattcctttcctctattctccatacacttgatatgtaaacactagcaaggtgaagcaaaaatttccatgttactaaatagaagatttgagctgtgtacaatggttattgttggcaacagtgttcacctttgatcttctacgtgccaacctacagaaaagggaaatacgattagagctattctataatttagaagcaacagttaatcctacttcatttgttgttcaggactctcaacttagaagagatagatcttatataatttacatgttcacaaacatagtcagagcttttgaaatggcaaagtactaaggaagctttgctatagctttctgaatcttgtctgcattctaccacttctttagtgacctagtgctgtaatttattagggcagttgtttatgggtccaaccacacggaattctctacatattaagccaggggtctaaccagcctgtgctttgtcaagtggtattctagaagaaagtggcttcatacatacctgttctccttgtagcaaaacaaatcatgggcctggcctggtgccagaaagtgcatagtgcatagtgtcatctttacagatgaaattctgcacattgttatcttatattttgctagaagagcaggaagaaaactgacttggtaatttgctacattctgatcctaatctgcttagaaatatgacttctttaaaaggaaatgggaacagaatatgtttctcatgataacctcatagtatctcctgaaaggatgttcagttattgtaaatacagaaatttgattctctctttgaatttcagatatatttcatcttttaaaaataagctacattgtcaacacacagacattgcaatcacaaagtcacagcagttgcagatacctatacagggtctgcataagaatggacccatcaatagactgacatggatggaaaggagactatgggtggccctagccctcactgatgaactagatgctacaaataaattcaaggagaggaggaatcagtgacttcaactgtgttccatctcatgattccaatccaatggtcacacaaagatatggttaaactaaaggattcccagaacaaaacaaatggtatcattgtaggaaaactgacaggataggaacaagttaaatcaggatagagggagaagataatcggtaatcagaatatgctttacatgtatatgtaaagggctttgttggagcacctgggggagccaccttggctaccggatccctctgagactagtctatgcaggtgagagtgtgaactacagaagctaacatcttctgggataggcagaagccacacagattctgaggcagaccccattttgggctccagacattcgggcagcttccctgccagaggagaggtgtccaccatgcccaggaggtctttgctggagcacctgggggagccaccttggctcccagatccctctgagactagtctgcgcaggtgagagtgtagactacagaagctaacagcttctgggacaggccctgttttgggccttcatcttctgccaggaggcaggtctgaacgccagatatctgtgcaccttccctgcaagaggagagcttgactgcagagagtgctctaaccactgaaactcaggagagatctagctacacaggtctgctaatagaggctaacataatcacaggaggaacaagctctaacgagagacaactataacaactaactccagagattaccagatggtgaaaggcaaacataagaatcttactaacagaaacaaagaccactcaccatcatcagaacacagcactcccacctcgcccagtcctgggcaccccaacacatccaaaaacctaggccgggatttaaaagcatatctcatgatgatggtagaggacatcaagaaggactttaataactcacttaaaaaaatacaggagaacacagctaaagagttacaagtccttaaagaaaaacaggaaaacacaaccaaacaggtagaagtccttaaagaaaaacaggaaaacatatccaaataggtgatggaaatgaacaaaaccatactagacctaaaaagggaagtagacacaataaagaaaacccaaagtgaggcaacactagagatagaaatcctaggaaagaaatctggaaccatatatacgagcatcagcaacagaatacaagagatggaagagagaatctcaggtgcagaatattccatagagaacatcagcacaacaaagaaaatgcaaaatgcaaaaagatcctaactcaaaacatccaggaaatccaggacacaatgagaagaccaaacctacggataataggagtagatgagaatgaagactttcaactcaaagggccagcaaacatcttcaacaaaattatagaagaaaacttcccaaacctaaagaaagagatgcccatgaacatacaagaagcctacagaactccaaatagactgggccagaaaagaaattcctcctgacacataataatcagaacaacaaatgcaataaataaagatagaatattaaacacagtaagggagaagggtcaaataacatataaaggcaggtctatcagaattacaccagacttttcaccagagactatgaaagccagaagagcctggacagatgttatacagacactaagagaacacaaatgctacccaggctactatacccaaccaaactttcaattaccatagatggagaaaccaaagtattccacaacaaaaccaaattcacacattatctttccatgaatccagcccttcaaaggataataacagaaaaaaaaaacaatacaaggatggaagccatgccctagaaaaagcaagaaggtaatccttcaacaaacctaaaagaagacagccacaaaaacagaatgccaactctaacaacaaaaaataacaggaagcaataattacttttccttaatatctcttaatattaatggactcaattccccaataaaaagacatacactaacagactggctacacaaagaggacccaacattttgctgcttacaggaaacccatctcagagaaaaagacaaatattgcctcagaatgaaaggctggaaaacaattttccaagcaaatggtctgaagaaacaagctgaagtagccattctaatatataataaaattgacttccaaaccaaagttatcaaaaaagacaaggaggggcacttcatactcatcaaaggtaaaatctttcaagaggaactctcaattctgaatatctatgccccaaatgcaagggcagccacattcattaaagaaactttagtaaagctcaaaccacacattgcacctcacacaataatagtgggagacttcaaaacaccactttcatcaatagacagatcatggaaacagaaactaaacagagacagagtgaaactaacagaagttatgaaacaaatggatttaacaaatatctatagaaccttttatcctaaaacaaaaggatataccttcttctcagcacttcatggtaccttcttcaaaattgaccatataattggtcacaaaacaggcctcaacagatacaaaaatattgaaattgtcccatgcatcctatcagatcaccatggactaaggctgatcttcaataacaaaataaataatagaaagccaacattcacgtggaaactgaacaacactcttctcaatgataccttgatcaaggaaggaataaagaaagaaattaaagactttttagagtttaatgaaaatgaagccacaacatacacaatgaaaagatttctaagagggaaactcatagctctgagtgcctccaaaaagaaactagagagagcacacactagcagtttgacaacacatctaaaagctctagaaaaaaaggaagaaaattcacccaagaggagtagactgcaggaaataatcaaacttaggggcgaaatcaaccaagtggaaacaagaataactattcaaagaatcaaccaaatgaggagctggttctttgagaaagtcaacaagatagataaacccttagccagactcactagagggcacagggacagcatcctaattaacaaaataagaaatgaaaagggacacataacaacagatcctgaagaaatccaaaatatgatcagatccttttacaaaaggctatactcaacaaaactggaaaacctggatgaaatggacaagtttctagacagacaccaggtaccaaagttatggggcatgatggggaaggaggtgtgggatgtgaagcagttagagggtggatggggaggagcagggaaaggaatatggagtgtaaaaaatgaattacaaataaaattagatttaaaaaaaagaaagtggggaagagccttgagcacatgggcacagaggaaaattttcctgaacagcacatgaatagcttatgctctaagatcaagagttgacaaatgggacctcataaaattgcaaagcttctgtaaggcaaaggacactgtcaataggtcaaaacagcaaccaacagattgggaaaagatctttaccaaccctatgtctattgaatagagggctaatatccaatatatacaaagaactcaagaagttaaactccagagaaccaaataaccctattagaaaatggggtacagaggtaagcaaggaattctcaactgaggaataccaaatggctgagaagcacctaaagaattagtcatcagggaaatgcaaatcaaaacaaccctgagattccacctcacaccagtcagaatggctaagatcaaaaattcgggtgatagcagatgttggcgaggatgtggagaaagaggaacactcctccattgctggtgggatttgcaagctggtacagccactctgtaaatcagtttggcagttcatcagaaaattggatataatactaccagaggatccagcaataccactcctggacatatacccagaagatgctccaacatgtaataaggacacatgcaccactatgttcataacagccttatttataatagccagaagctggaaagaacccagttcttttatcatactacaataataatgttgttaacaaatggcataaccaaaggacaacactgtacaatattcacaatattcctttttcacttttaaacataaatgaagaaatatattacagtgtatactattatgccatatttactctctccactaactcccttgtttgtattgcttctctgaggtataggatgggacaactgaccttttattggcataataaacatcttgaataacattcccatacttctgggggttttagtacatttttctagtcattgcccataactagacatactttttattcctgttccataaaacctatcagaatgccattatagaaataatattatatgtgtttcaattttaaagtaaatcattaacctttaacacatttttagtaagaaagtacaacacattttaatactggagttgtaagtcattggagcagtaaactggactttggtttctcatttgagaattagcattcacattgcaggtttgcagcccaattcccatgaaatcttaaacatgtttattaatctcttggcttcacttgccataaaatgccaataatgttgatacttcgctggctaactgtggtaatgaaataaaatggtttttgaagactgattttcaaaaacctgtaaaaatctcagttcggattccccatatgaacctgcctggtctctccttggcttcagccttgaactgcttttatttccttctgatcctatacgaactcttcagaatcatttccttagaggtgatccacctaataggccctaattcacaatgttttttttccattagaacttgctatgtgaagccctagttcttaaggtatttattattgcctccatactcttccactttaatgcactctgaaatagaaaaaaatagaattttctatctttttatgctccaaagtcaaactcttcttttctcctcccagtacctccacatataatcaagtagagaaagatggcttagtaggccaccaagaacaaagagttttaaggatatgaaaactgtcgctgggccacccctggacagcacagatgggcatatgggactgggctgacctgaaagacctgagggtctgactggcctgcactatgctggtacgaggctaacctgctgattctgcagagctgagaactgctatggagagcaggtgctacggctgtgctgtccagtttaccctcttcaaggagtatggctgtaagaattgtggccaagccttctgtaaggactctcttagcttcagtgttctgctaccccagactggcaacacataacagaaagtctgcaagcagtgccacacagtcctgaccagaggatcctccaagtgatcgccacctcagtataagaagtgtgtggcagccttggaagacaagaagaagcccagcacttcctagagccaaggcctgacccacaaagacaaagacattgctgagtgcctagcaggaatttggccggaaaacaagcccaagtcagtaccctcacaagcagagatagaggcacagctagccacgctgaaggatgaagtccagggccccattcctaccacacaggagatggaggatcagcttgcagcattgcagggcacagtcctgcttcttcacactttgaggctggcacaccaggcaccagatatcaggacccaaggccagcagatgcagaatctgctaacacagttgacagctgaggtggatattgatgaaagctggcaaccaagagcctcagccccctccccctccataatgaccttaacaagggagctacaagaaatcagcacacaaattcccaggggcaggccacccggtctctggaggaagagaagaacaagctgctagctgaggcagcagttgagctacaggaggagaacaaccaggcaggaatagatcctggctcttgccaaaagattggttatgtacaacagagtgaccctccaggacgatcaacacccaaacagtgatgaggatgaagagacagccatccagagagtcatacagcagctcactgaagaagctgccctggatgggacaagtggctttaacattcctgaggaaccagctccaggatcccaggcccaaccctgcaaggcagagactgagggtccccaggctgaggaagaactcccctggtgctgtatctgtaatgaggatgctactctgcacggtgctggctgtgatggagacctctactgtgctcagggcttctggaagggccaagataactttgatcttaaagaacatcagacttctccctaccacccccaaccaccttgccaagaacactgaggataacctaatgatctcctgaggtggcagtgccacagcaaccagcagcctgggaagaaacctggggccaagtctcagagcatccagggggacagcaaaccctgctctactgatggcaaacacacccctttgtgagctacccagtccctggaaggaagaaagataataacgctgagagggggctggtgaaaggaagagtcagggtgctcttctaagaggctggcctcaaacagagacagatggagaagagaccagactgaagccaagaataatacctgaaatctgcttcccaggcacaaccctggcctatagtggagctaataaaatgtgttgaaaaaaaggagatgaaaactaaatataaaacgttgagacaagattccagcttttgttttaaatgattggttcccaagggtttattgcattttttaaactaactactacatataagccagtgtgaattaagatctttaaatataaaatatatcccatgcttaaacccccccaaagcaatgtaaactatctaattaatatatctacattgattccatagttaaatgaatgtattttaaatatatgctgctcagtaaaaagaaagtatgaaaacttcaactgtgtgtgtatatattgtatttatgtatagtgcatacatacatgtgtattcaggtttacatgcccaagtagggacaagaaaaggattttgaatgttttgttctgtgacattcctccaccttattcctttcagacaagatctccactgaaccagagctatgcaagcagctagaaaatccccagaaatcttcttgtctccagctttctcacatagagtgttggggttgcaagcgcactcagccacacacagcttttttatatgggatctgaacttgggtcatcagtcacctcaaatctgatttttatttactaacaaaattatttaaggtattatataaaattactgctagatactgtgaataaagcttatgtgaaatataattgaatattatatttagacttctgtccattcccaactttattatatatatgaagatgttccacaatctgaaggaaaagaggatccaaaatgtgaagccattctagtccctacatattttggataaagaatatcaaatctttataacaattctgtaacactgctctttgtatgtatacactgatatttttggctaaaatctatttagtttatatttgaggacttagtaactctaatgtactttatctggggccttctgaagccttgattgaaacttttaatgactacaatagcaatatgtgcttcttctaaaacagaattcagcattagaaaagcgtgtattataacacaaggaaatcatcaacccagtctcagctcctacacactgtcaatattaacaattaaatgagttttctagatatattcactctaaggtcttagaattggagtgttaacatttttgctattccttctcactttatctgatactatacatgcaatggaaagctgtaagtctatgtgtgatcaatcatagagataaagcagtggtttgtaccactagaatagaatactctattgttcgtttggatttattttcctgaccgtatcttctctcccctcagcaaaagacatgccatttggcttgtatttatgctaaaagtacagtgaatccaaatcaatgttgcaagattttcttaataccctttgggggaaaaaaatcagagacctagaggcatactataaaaccagaactaaaaatcactgttttagtgtattgatctccaacaaagtacctgatcatttctcccagtgggtatgaaacaggcttctgaggggagcataatgatttggaaacatcacatgtatccatttcaccttcagtcataggcttctctctattcttaggaatctgcttaacaggggtagtttagaagggagagaaaagaatctaaatgtgagtttgggactatgtgctgcatcttgacatttttctttccaaaattcccagagctctatacaaaaaacattaacagaaaaacagctcagtaccacaggcattacagaagctattttctttgtgcatgctactgactgacaaattaaaggatttttgcatactttttctttactagataccaaatagttatatttcccttttctttccaattaagccaagtcatctattcaacatcatattctcagaaatcacaaaaatggattttacaattttaaacctatttttatgtatatgggtatttcggactgcatctatggctatgtactatgtttacacggtgctcatggaagccaagaaggcatcggatcctgccttgaatccctggaactggatccaattcaagcctcttaaccactgagccatctctccagcccctaaaatgggtttttaatcatatgctatatgatcccagtcccagcaatagttgagacctaaaagaaaaataaatttaaaaaaatttcttattgctattctaatgagtttctcttccctttccctttagaaaaaaatggcacacttaaagtagaaatttgtaccatggcttttctctaacctaaccctatttactcagcacttccagtttatttttgttatatatatgtgtgtgtgtgtgtgtgtgtgtgtgtgtgtgtgtgtgtgtgtgtgtaagtactataatatacaggctaagaaaggactccttagaatttctatccataaactgttttacaaatccttcctggaatcatggttattcactgttatatgtgatcccatgtaagaatgctaggcttgttccaaaacaacaaaaagataagttggaattagataccaaaaatcactttcaataattttagatatagtagtaattatgtatttctatgatttcagtttatttttgctatataaaattactggatttatgaagcaccatgtgatcatgtctattaaacagaatgattgttacacagaacagttaggtaaaaatatatctagaatgcatatctaatttagccattaattggccgtgatgcttagatcaacccaggttaatgttgaaagcacaggaaggaaatggcctaactctagtctaacaaccataaagatattatcaagattaatacatcaggaatatattggattatagagtacttgcttagcatatggggaaccctttgttcaatcccttttcctatagaaaatgggaaaagtataaagagttgccagaaaatgctttgaatattaaacattatgtacacatacggctcttcagatatgattacattttcagcttcaacattcaaaagaatattcatttcctgttcacttcccttgtactgtgaagatatgaccacaaggtcctctgagcttgtcagtatagttagaaatgccagcctttgtacaaagatatattttatttgagaaaaagaatattgtatcacattatctcttataaaaattaaaatagaacattttgttaaaacgactagacaaatagaaatgctatattatatgtggcaaaatttctaggtacctgaataatactttgcttactgaaatataatgaggattatgatagttgtttccttttttgtctttttaaattaattaatacatgctctcacccagcatggcatgatgttttggtctagatgtgtattatacagagatttcattgagataattaaacatatcccaccaacttaagattttgatggtgaaaatgttaaatgtccattttaacaactttaaaatatatattacattattatccattgtggttactatataatataataaccaaaatgtatttccccactataatcaagacttttttaattaggtattttcttcatttacatttccaatgctatcccaaaagtcccccataccctcccccacccactcccctacccactcacttccacttcttggccctggcattcccctgtactggggcatataaagtttgcaagaccaaggggcctctctttccagtgatggccgactaggccatcttttgatatatatgcagctagagacacagctctggggggtactggttagttgatgctcacagtcagctattggatggatcacaggacccccaatggaggagcaagagaaagtacccaaggagctaaagggatctgcaaccctataggtggaacaacaatataatcaagactttttaaaactaagtttctgattcattttttgatttgtgtgcgcgtgtgtttgtgtgtgtgtatgtgcacacatgcacacatgtacaaacaccactgtacaggtatggatttcagaggattacttgcagggagttgattctcttctcctatcaggcgggtactacagatcaaactcaggtcctgaagcttggcagaaagtgtctttgcctgagtcaccttactaaccctaaactgaaaagtttatagcctttgttcactatctttcctttttcatatctccctcttgggtgaagaaggtacccatctacctcttgcaaccccttttcctctatgtttttatgaattccactgtttatactcagattgtacagtgttcacctctctgtacctggtctatgtcatgtcacttagcataatgacctagggaaaatacctatatataacttttgaaaaaaaactttgtttacatatgtgtgtgtgtgtgtgtgtgtgtgtgtgtgtgtgtgtgttaaccctcattatatatggtcactacatgcatgcctggtgctcacagaagttagagggcatcagatccccctagcactggagtaatgaatggctgtaagccaacaagtgggtgctgggaaaacaacccaggccttctgcagaaacaatatgttttcttaactgagccatctctcaaacccccagaatttcttttctaaagctgtatagtttgagtttatctctgtctgtctgtctgtctgtctgtctgtctgtctgtctctctctctctctctctctctctctgtgtctctgtggggggaggtcacacagggacattagaggtcaggtggggtgggagctggaggcatccacatggagacagggtggggtggggaggaagtgtgagatgtggagcagtgggagggtggatggtgcaggaaatggaatatggagcataaaaaataaattaaaaataacatagcaattcctttgaatatgtaaccagaagtagaattcttaggccatacagtaaattctatttgtagggtttttttttttaagcttccatactatttcccaaaatgtccataccagtttataatcttacgaaaaacatgtaagggttcttttattctcattttctcttgtttgccagcatttatcatgtattattatgtttataaaagcaaccctgcagtagtttgtgattgcagtttttattttcactgtcttcatagagacactgaatattgttcatgtacttgtccacttgtagctttctattaaggaatgtttattcaaattctggccttactttgaattgggttgttttgttgttgttgagtccttctagactttaccctcttcctagctatgtggtaggttgtccctgctctctattgtttcctttgctgagagaagttctctatgtcctcacaaatacttgttcccatccttttttattctagccatcctggtgatgtgaagtgtgtctcactgtagctttgttgttattttgttgggtgtattgtgatgctgaggatggaagcagtcttgttggatgtagggaagcaccctaccaactggatacatccatagcctcattgtagctctgatttacattctgtaataattatgccaatcaccattggccaattgtatctttggagaaatataaagacaaggcacaattaatagtaaactaattacaaataaatatacatcagaacctcaactcattttcaaatgagttattactgtttctgtggtgacataagaaagtctacggtatgtttctcactgtatgatttgatgttcagtagtaactcagatggttctctgattttgtgatgaatttatagctctgttgcttcttgacaaatgtgagcctcactttgccatcttcctttctatttcgtttgcctccctgtggaactagatagtatgaacttgaaacaagaagtcattatttcatcgccatgacacttctatgaggaccatttctttctgtcttacacttaacaaagatgaaacaatattgtagtcatagaggtatatctgtgccttaacagttaaccaacatatatatggcctctttaataatttattgaatttcaagtttaggagtgtaactcagtggttgaaatgttcacaaggccttgggatccatctccagtactgctaaacaattgatggaattttgcctgtagagtctattctatgatgttagctggtaggccctagcaacctgtgctttctctgaacagcttagttatcgaatgccttggcaaaaggatctgctgattgctttaatataccaaatctctgccaagacaaaactgttacacatttaaatcaaaaaccttatctctcaaccatgaacttatatcacttttaagtaatgttaaaattaatttattaaaaaaaacctacttgacaacccattgcgtcggataaggcaggtgctggtgactgcgttgtgtgcgggccatggggccgcggcctggttagggcccagagatgtccagctacacacggcagcagcggcggggtgtgcccccactatcacagacatggagccgcgtggttcctgacaactttggctatggaaaggggaaatgtactaaacaaggtccgtcgggagcccatgagacgcactttggaggtgacaaacttgaagaccttgaaaaagccaatccattctccttcaaagagtatttgaaaaccaagaacctcagcctgtcaaacgaagacattaccaccagccgaatttacctgaaggaagcctcaaggcacccactgggactaaagcacagctcccctgcctccaagcccatgggatatggcctagattatcagcagccattttgtgaagacccaacaagagccaggaacctagaagaggatgaagaaaatggatggaatagaacctacctgccacctgctctggggcagactcattcctctagagccacacagaactcgtcaccccgtggcacctacctttcctttttctccaacacatcagagctggcaggtcctgagtctttgcctccatggaagctgagcaacaccgactccaggatctctccagtatttccagctgggattcctaatgcagactttgcagctcatgaagactccctaggggacagacacctgcggacgctgcaaatgagttatgaagcactgaaagatgaaaactctaagctcagaagaaagctaaatgaggttcagagcttctctgaaactcaaagagaaatggtgcggacgctcgaatggaagttggaggcgaagatgatcaaggaggagagtgacttccatgacctcgagtcagcagtccagcaagtcaaacagaacctcgaactgatgaccaaacggactgtaaaagcagaaaatcatgtcttgaggctgaagcaggaaataaatttgcttcaggcacagctctcaaacttgaggcgagaaaatgaagccctgcaatcagaccaggatgccagccttactgtagtgaagcagagcatggatgtggccttgcagaacctcagtgttgtcatgcacagtgcacaggcatccataaagcagctgttatctggaggagagacactgaaccttgttgctgaactccttaagtctatcgacaaaattactgaagttaaagctgaggcagactcttaagaagttctacctgccaccgggtcccatcacctctgcaccgaaggcaccacacatcttccaaatgtgttcctatctatgccgtcctcaccaaagcattccacagcctaagcgtgtgactggtcatctgcagtacggggctcctttctaccagttgcacctaacagtttatatgaaatcccactgttcaatagactcactgatttactggaagacatttttataagacccagaaacttttagaaaccaataaagctgaaacaacagttgtgcaaaaagcttctttcactgtcctctcaaatttagctctaggatgaggtcgggctcagcctcagttttatcgaggggaacactaagtgagccagtgtgtaagtgagcagcctgtacagagacgcgtgcctcactgaggcagcaccacttggtaggtgctgctgtcctctcaccaggaccataggaccaaggtcacacactgtgcacattgcaaagcttcatacaccctctactgtgtgctgtcagctttggaaagccatttggggctgtcggtttgatgcaggttaatgtgtctgtgtgccttttgcatagtgcagttcagactggaattaaagcacacacccacctgggggctcagcaccagctctttgggctggctggctggtttttgaaggataaacaagatagaagcagcaccctgtgctctgctgaggggtcaaggtttagggcacactttcctatagttttttttaattttccttttcccctcctgttgagattgacagctttcttatctaaataaatcctgaagatcatttaaaaaaacattacttgacatacctaactcatttattctttaatcacttatctaagatgaggattatgagtgacaatatgaatctctctcctgaaaccactgacaccatatctcttggccaaagaatgccagtaagtaaaagtcaccagtgtacgactgagatagagcttagtagcacaatgcttgcctggcatccatggatccatgggttttattctgagcactgcaaataaaaaacataatcactagtgcagagagaagacacacacgggggtgggggtggggcattcttgccattgttttttgagacttagagctctgctattgcaagctccaaaaggaccctgctctcaccaacgttaacttctactctacagtaattgtgaatgtcaaaacttgctttagacacaaggagctaaagtttcctgacacttatttcttttattagggaaaaacaaagagctttacaaacctacaaagaagtattgtgtagaaaagaaagttggctcagaccaaaaatgatcagtttaacattcaaaaaatttctagtgcatgcctttctagtctagaaaaaaaaatctccatctctgaatttccttagaaattcttttgctatcatttatcccttcaactattgctactgtcacagataaccttaaaagttcctgaaaatgcattctgagggtgtttggttctctgctgaattataaataaataaaaagaataaaaatgctctgctctaaattaatcgggcttctgcatcatagcccctctttctgaagctcaggaatctttatggaagagagggctgagaagactgtaagaactggaagccatggaagacgataagaaagtattttgtggccatgacagggcagctgcacacatgaactcatggccactatgattgccttcacaagatcaagcagccaaattctagcacatacactggaggggagcatgaagtcctgccctaggtaaagaggtattagcagttggtagctgctagggaaggacatgttggttttcttcaggaatgcgacccttggcaggtcatgctgcagtggatgacctgcgtccctatgcatacactggcactgagaggactaatgagttttcaaaaagaaagcaatcaaagatggtaaagcaagatggtaggaaaatggggaacattttggaggggaagaaattaggggtggaattgacaaaacacatacatgtatggacttctcaaacagtaaaagcaactaaaaacaaatacaatagtccagctatatcacaaaagcaaggctgaatgttggaaagaggaagcagattgctgttttgttttgttttgttttttagcagttccatgtgaggtttattgagaaagaaacgggcaaggtggtggcagaaagaggaagggtagtggggagagattttgaacttgagaaacactgtgatgttaggctccatgggtttcctgttgccgccaagataactcagtaggtctgtacaggatcctcccatccaaccaccaataggcacagaagaaaaactgcttagaaaagcccatcttttatatccaaaggaaagcagatatgggtaagattacaacaagaacattttttgccaatacctgtcctacctggtcaaaaaccaatgagaaaaaaatctaattttcctactgctctgcagtttctttttcttttttttttctttttaagcttacttaaaacatggaatttttaattttttctttttttcttcattttcatttcaaatgctatcccaaaagtcccctatacaccacacccccccccgcaccctgctccccaacctacccactcctgcttcctagcaatggcatcccctgtactgggataatctttgcaagacaagggcctctcctcccaatggtggccaactaggccatcttctgatacatatgcagctagacacatgagctctgggggtactggttagttcatattgttgttcctcctatagggttgcagaccctttcagctccttgggtactttctctagctcctccattgggggccctgtgctctatccaataggtgactgtgagcatccacttctgtatttgccaggcactggcatagcctcacgcgagacagctatatcagggtcctttcagcaatctcttgctggcatatgcaatagtgtctgggtttggtggctgattatgggatggatccccaggtggggaagtctctggatggtcctttcttctgtctcagctctgaactttgtaactccttctatgggtgttttgttccccattctgaaaaggagcgaagtatctacactttggtcttcgtttttcttgagtttcatgtgttttgcaaattgtatcttgtatcttgcggtattctaagtttctgggctaatatccacttatcagtgagtgcatatcatgtgagttcctttgtaattgggttacctcactcagaatgatatcctccagatccatccatttgcctaataatttcatgaattcattgtttttaattgctgagtggtactccattgtgtaaatgtaccacattttctgtatctattcctctgttgagggacatctgggttctttccagcttctgactattataaataagactgctatgaacatagtggagcatgtgtccttattactagttggaacatcttctggatatatgcctaggagagggattgctggatcttttggtagtactatgtccaattttctgaggaactgccagactgatttccagagtggttgtacaagcttgcaatcccaccaacaatggaggagtgttcctctttctccacatcctcgccagcatctgctgtcacctgaatttttgatcttagccattctgactggtatgaggtggaatctcagggttgttttgatgtgcatttccctgatgattaaggatgttgaacatttttttcaggtgcttctcagccattcgatattcctcagttgagaattctttgtttagctctgtaccccatttttaatggggtcatttgattttctggagtccagcttcttgagttctttgtatatactggatattacatccctatcagatttaggataggtaaagatcctttcccaatctgttggtggtctttttgtcttatccagaaattaatcttctacatggctctcagaagcttgttgctagcatgtgtgagcagatagctggtcttttcccactactgaccaaaacaaaacagatggcaccccattctgctgctgtactgtgttaaattgggctagtggtgagctaagttgccattcacactgagcagcaaggcaaggttagttgctactaaacttcacaacactatctttatttcagtcagtactgatagaggcaggtgctgggctttcacccatcccctctagcaggaagagtatggtaagttccctgatttcctctacacctagtgtcagaaaagcccagtgaagagttgaagctccgtactcacgggcagcaaagaaactaagaggcagcatgaagtaggactacccagcactcctagccccaacctctgaggtcaaaagctaaaaagacccactggggaatctgagcttctaattcagtaaggcttaaggtggtacaaggtagaactacttagcattcttcattctgcatatcctggttgtcaccaaagcatagctgggagctgagcttgcgccctgccttccgaagctgcagacgctttgggggttattctgctatcacttgccttactgtcagcacagtcaggagtggctgaactcatgcttaacccatttgggacaacaaagcaaaatttagttgcagacggccacaagagtctgagcatactgcatgtacagactacctgatttttaaagatttaaatatgatccagaatttcatgatacagtatctaaaatgtcaaggtaacagttttaaaactcactctccaatcagattatatctgacagggagatataataatatcaacgacaaaataacgcactaacaataaaaaattctcttgaaacagatacacaaaatctcatcaaataaatagaaattataaaactatgaaggttgggaatttaaaaacctcagttgatagactgcatcagctagagacaacagaagatggaatcagtgatcttaaagacagatctgtaactttaattctttcaaatcctatttttaatgatggttcttaaatgctttaacctcccttctagcccaccacccaccagaggtagtagaaaagaaaggatacagggggagaggggcgtggatctgtttagaaaggttctttggagaaactcccatctgtgttgtctggaaatccgaagttcagttcacaggtcagcatcagcagctggatccactcacatacactttacagatacaccagcagtccggttctgtagagtaaggatagcaaatacgaatcagtagtgatggcactacctaccaaagacagccgggcttcactcagccttggctcaagacagcaggaggaacaccgggagaagttttttctcagccaagcaaagatcagtgaagactggaaacccacaagcattgcacagctaactctataagcaagcctaactctaatataaataaataaataaataaataaataaataaataagcaagcctaacttagcccccatgattgtccattgaattctatttatacgccctccaaacatcacatgccctccgtgtgtcttgcttcagcacctggtgtctgtctcagctgacatcactctgcctatcagcctgagcctgctgaagtggcacaccaccagaagtaggtttttggcatgtttctctctatagtatccctacaaatgcagctcaactatgaaatgtaaattggaccaatatacgtgtgttgttagcaaagaatctttcatcatgtgtcttttcacatgcttgctttagcagaacatcttctcacctgtgtctgcttcagccaaatgttcctccttgagtctgccttagcctttcacctgtgtccactttgagaaaacactcctttcatgtgtttgccccagtagaacaccctcgaacacaactgactttccaaagaacccttaagtttccacttcacagatcacccaataggcttatatacttgaatgcttagtcaccatggagtggcactacttgaagtatttggaggtgtggccttgttagaggaagtatgtccctgggggtaagctctgaggcttcaaaagtgcatgacaggcgcatatataatcagtgtccaaaggataagagaaagaggtgtatagtaaggacttgtaagttaatggatgttttggaaagggaattctggcacatacaatgtcaataaaccttcaagacattgtgcaaagtgaattgaggcagtgaaaatagacaaataccatacacttctatttatatgacattctgagaatagtcaaattgataaagagagatcatggtggaggggatgactcagtggctaagggcaattgtcaccaagcctaaagagcaaaaattaatgcccaggacccatgtggtggaaggagaaaactgactcccagaagttaccctctgaccttcacatttgggctgtggcacactcccccaacacacaaaaaggtaaagaaaaagaaaacttttaaagagaaaagagaatgatgattgtaaggaggttggggttagggggtattgcaagatgaaaagagtttaaaaataccaatataaatatactaaacacttctgatctatacccataaaattgttacaatggtaaatgatatgtattttatcacaattaaattgattgcttaaaaataaattttggctgaaaacgccacaaacttggcaaaataaacagttacaaatttaaagagctgagtgatatcaaagtatgataaatctaaataactcaatgctaaggtatgtcataattaagctctttgattttggggggcttagtttatttattgatttatctatatgtctgtctatttattagacgatctggcaagctgtctgtgaactccctaggtagcccagactgacactaaacttgcaaatctcttggcacagcttcctaaatgctaggattattatattgtgccaccatgtccagctctcataattaaacatctgaaggctaaaggtaatgaaaactattgaaataatccaggggaaaagatgcattagttatagaggaataccaatttaacaatgaacatattcttgtgtggcatacaagtattgaagccagaagaaaatgtcatatttctcaagtgttaaaagaaaacagctgttaattgcagattctatatccatagaatcccttcagaagtgaggataaaataaatgaatttctgtgcaaagaaccttcagagtatttgtttctggcaaatatattcttaaagattaaaacaagttttagaaacaagtgataatagaagagacctcagaacttcaaaaagaacaatgctgaaagagtagatataatagaatatcctagttctaataattttcataaattattttgatggttgaaacaaaaaatgtgccactatctgatgaaatgttgaacatatagaggaaatacctactcataatacctagagtcctaagtccataaatacacagaaaattaaaaccattattcaaataaatacttgtgcataattattcctagcactattacttatactatttccaaagtagaaactacccaaatatctatccactaataaatgaatgaataaaatgtggtatatgcatgcactagaacactattcttcagaataccaatatgtgctgtaatgtccttgaacctgaaagtattgtgctaagtgaaagacacctgtaacatattgtatgattccatctgtttatgaaatactcaggatagacaaattcatagagacagaaagtagattagtgcttcctttggggtgagtatagaggttggaagaaaattaggagtttgataaaatatagaatacaaggtttcttctcaggataatgataacggtcgaaactctattatggcagtgtttgaccgcactaaagtcattaaattttacatggggcttctttccttctttctctcttttttctttcttttcttttttttgtttttgtttgtttggatggcccaggaaatgtcagtagagaactctaacaaatattagaattaacacaaactttgtccaatctcttctagaaaatagggaaggaatgaacattgtatcatttactttatgagtttaatgtcaccataataccaaaatgagataaaacatgacaaaatgtagaaaaaataaggaccaaagtccttatcaaatttgatataaaaattatcaacaagatattaatactacaattacaaaacagttgtacttcatgataaagtggaatttgccccaggctttatgcaagactagtttggtctttggaagtaagcaaatttagccccacatattgaaaggaccagtgaaacagctcagtgagtaagggcgcttgacttcagtccctggaacctccaatgggaaaaggagaaaatggactctgcaaagttgtcctatgccttcacacatgagctgtctcacagacacacaggtctagtccagagagacagcacagcagttaaaagcacttgctgctcttccagagggcccaggttttattcccagcacccacattaggcagcgtacaatcatctgtaactccagctctgggagatccaatacctctggcctttgcaagcagctgcactcagatatagctaaaaaaaaaaaaattaaaaagtacaactagcatcataccttatgaagaaaaaaatagtgacagcttccttcctaagactgaaagaaacaaagcacttgtaatttcttattgttattgacacagtactagaaaatactagccacttcactaaaacagggtgtagggaaagactactggttcagttcaggtttaggttgatgagagcttataggtgtcgcttctgacattcctaggagacaaatctcatagcaaactccctgatcctctggctgtatgatctgtccactcccaacttccacgatcatccctgcacactcaatggttatccaatactaaatggtcagctctaaaaacatacatgcaagtaacatgatacgactaagcaggttgtatttatgtatttaggaatatttgtttatttatatattatatatgtacattatatatatatatatatatatatatatatatatatatatataccacaaagattactgaaaagcgggccatggatttgaaaaaaaaacaggggagtatatggggggttttggagggaagaaaggaaagggggaagtgattatattataatctcaaaaatgaaattaacttttaaaggtataactggtggttttttttttttaaggaatggagatttttgctggatggtggtggctcatgcctctaatcctagcatttgggaggcaaaggcagacagatctttgtgaatttgatgccagcttggtctacagagcaagttccaggatagctagggctccacagagaaatcctgtctcaaaacaaaatgaaactaaatgaaacaaaacaaaacaaatagagatttttgtgtggctaaagcttgagcagattctgtgtctactctcaccactgctgtgagttcttacctgcttctctgctgtcttgaaaccagtttcctataggcctctactacctctggcttctacagtctttctgacacctcttctgaagtgatccctgactcattggaggaaagagtgttctacagatgtcccactgagggctgatcagtccatggtctcttattttctgcatcttgatcagttgcagatctctgtgttaattaccatctaccctgaaaagaagtttctctgaggagggtttcaaagatcaactgatctgtagttaaattgtttaaccattaatagtcagcttaattaatactgttgtctatcttgaaaagtaatggtagtatgtaccccaccttaggttcttggccccaataattatgccaggtatgaatttcaacttgcagatcagacctcaaatcaaattagagagtggttgtttagtcccatgctattattgccattactgcaccagtcagacatgtcttggaggtaagcacttaagtgctactccttactaaggaactattgagtttggtagctgttgtaagatgattaaaaatgtggcccctggtaacatcaaccatgctccagtagaagagcacacatccacacatcgcaaaacaacttttatttaatgagatttttatgaagtgaagcaatgtggaacaagctctcactgtgtagttgtagctttcctggaaacttgctgtgtaaaccaggctggcctgtaactcataaagatataccagcctctacctcgcaagtgctgggacttaaggtgtatgccacatgcttgatggggttttcttaataattaaaaaaaaaaggccacaaagttagttgtatagggaaagaggggttgatctaggagagttggggagaggcatgactatgactaaaatacattttatgaaatcctcaatgaactaatataaaaatgagaaaaaggaatagagttgatatgcttctcattagaaaagaaagtaaaactgctatttttgattatgtgtttgtctatataggaaacttcaagaaatctattttttattttttattttgttattacatattttcttcatttacatttccaaagccccctataccctccccctgccctgttccccaacccacccactcccacttcttggccctggtgttcccctgtactggggcatataatctttgcaataccaagggcctctcctcccattgatggccgactaggccatcctctgctacatatgcagctagagacacaagctctgggggtactggttagttcataatgttgttccacctatagggttgtggacccctttagttccttgggtactttctctagctccttcattaggggccctgtgttccatccaatagatgactgtgagcatccacttctgtatctgccaggcactggcatagcctcacacgagacagctatgtcaggaagaaatctatttaaaaaaaaaaaaaccctaagaattaatattatctcagcaaatttgcagaatacaaaataaaagcacaaaatcacttcaacttctacatgcatttgtcacttataaagttttttttgttttttgttttttttaattaggtattttcctcgtttacattttcaatgctatcccaaaggtcccccatacccacccacccccaatcccctacccacccactccccctttttggccctggcgttcctctgtactggggcatataaagtttgcaagtccaatgggcctctctttgcagtgatggcccatcttttgatacatatgcagctaaagacaagaaggtatataaagtttttacttaaaaaaaaaaaaacgtggttaagttataggtctttgtttgccttgagtttcgatttttgagacatgggtttgctatgtagtccaatctggcctcacactcactaagtagcaaaaatggatcttgaacttatagtcttcctgcttcaacctctcatgtgctgctgctgcaatctagcactgatgtgtggcatggaggttagtatctctatattagaggcttcaatccaccaaatgttacattttgtcatttggaattttatttatctccattttgctgttttatgtgttacaataccatttcagtgctgcatcatgggtgtatttctctgtctagttttgtggtggtggtgtgtagatagatagatagatagatagatagatagatagatagatagatagatagtattatataatgcctatgaatttattatataatacatgtgaaacatgcctttgttaaagtcatcattttacttccttatgcaaaggtagaaatcttaccactcttaagtcccttcatttatacaatacattctaattaccttaatatccttagcatatgtcaggagctacatgacacaatattgcagctttgatttatttatttagttctttgctatacttcagaaaacaagaggaataacatgtattggactttatctataatcttcctttttctgtaggttcctatgtggttatgcaagattccttctttctcacttattttcttttttagaccattcttcggggtaggccaactggtagcacactctctttgttttcctctgtctgataagtttttggtatatctttaattcccactttgactaggcagagctaagactggagtttaacaggtcttttgacagttgaaaaagtatgcagtgcttgcccgtggccttcctagtttctgatgttgtatacaattagcatttaggttgcttttttactacacataagacttcattctcctctgtacattcaaggttttaaacttatggttactttccagaaatttagagattatatgtctgctcttgactccatcaactaagtttttttctgttttttttttcttaaactctttttttttttcattttcatttctgttatttcaatttggttcttatttgtagctccaatttctttactaagactatttgtgagatgactctttcagttgtatcaactgtgttcataattattcactgaagcattcctttgatggctactttacaaatatgtgtcatatggtcctataatatctgtcatctcacaagtgccttctggttttaatttttttttttagcttaagttagactttgtggtataatgtgtgagttaattgaaacttcaatggttcatattttattcaatgttctagactttgtttaaaatcttttgccttaattgtctttacaagacaccattccagtaggagaagagaagttttatacctcattattcccaagtataggtagaaacacaggtcccattcttggtcctctttgacacttaagggagaaggggctttttattactcattggtaaaaatggaagttctagctaccagtaacttgactggagtctacttacctgctgagcatgaaagtgagtctacacatatatatgtatgattgtacacatatatatgtatgattgtcacattattacttacagcccatttctttgttttctaatttttaatttctttcaagggaatttataattgatcagtagaggagtgattttatgatggtgctttgaagcttagatagtcccaccaatctgatttatggcagtattacatcaagtgacttttctcatttatgttgttatatgcctggtctttactatagatattaatgtatcctgtacagtgtgcctatagatggctcctgacttacaatactttgccttatttttttctagcttacagggattcaaaagatatacactcaataaaactatatttcagattttgaatgttggtcttgccctaagctagcaatacgtggtattctcttgatggttttcaggaacagagaaacaaggctctcagttagttatggaatcacagtaggaagcaaccagtgttctacattctcagtgtggttatgctggatagcgtttctcctcatgatattttcaatttgcagtgagtttatcattaaaacaccactggaagtcaaacaggacctgtgctatactaggagactcttaacaaaaattatgttttcccctgaaacatttttgggtgtagcatatcaatcctggtctatttttttagaacaatttagtagagatggagaatattccatctctgctggtggctataaaaagaaaaaaaaaacatacctaattgtgctatcttttgctgctagggaaagagtcaatagacaaagactttgagtctttctactaggttaaggttcgggagtcactgaaagtgatttcccttctggggctcattaaatgatcaggagacatcaggccttggttgctttgaacattgagtagaaatttggcagataccttgcctatattatctgattctgcttagtggtgggtaagggcccattaggtctgggcagacagttataaagcacatggacatatggcactctccaatgcaaggctacctgcttctgactggcccagagcaaagaccagattccttgagttccatgagttctactttgttatgaacagatgatgactttgccactgggtaaaagtttctctcatgagttcctattcatcttccccattcctttccctctgacagagcagatatcctacgttccccctctatttttgtctgtgcttgctgctagtaactacttgtagacccatccagtgggtacccaggctggagcataagtgtcaaagaaagaaaacccaaggacttcacccttacatagttccttctgtatgaaatccacgactcatcttcaactttcacagtcttcttatgattgtctgctttcctaaggtacctacctagccgtaattacaggagaggaaccattattccaaaaccagaagtctaacttatatttgttttaaattatgataagtgatagtgtctttatatttttgcatttaattctttatataatatcaccattttgaaatccatttcatcttggtaaacatagatatatatagtgcattcattttaaatactgtagaatttgctgttgtgtgaatatgcagcaagttgtttatttgttctcctgctggtgggcagtgaagccgccattgctttataaacaaagccaggataaatgttcccatacatgtctccttggatactgactgtatttgtggaaagtttatctgagcctgcatctcaagtggaactgctaagccataggagacatagagcattgtcatcttcatcagatattaccaaactgctcaacaactgtgcatgagatactttgttttgtcactgaaacctgtgttaaaatagtcaatttgattctcctttaacttatggattgggttttgacttgtttaaaaaaaaatcattccataaactaaggtcataaaaatatcttcagtatttgcttctacatttactccaaattaggtctttagtctttatctgtaatttacttttgtgtataatctaataaaggaatattattctactttttccaatgtcgatagctaatttttcaacgcaattaattatttatttagaattccacttcaaccatatatcacactcccattttacttatgttgatcctgaagtttacaaataaccccaaatgatattagctaaaatattgaatttaaatacatgtattacaataaaataaaataaaaccttattcttaatcccactttctattattactggaacaaaaagattagtactgattaagtccctactaacatcaattaattactgattatctattaggtactgctaggcaaattaatgctaggataattttaatttattccttgtaacaacattgaggagccatgatgtcatttttctattacagataaaaaatacaaaaatgttgaaagtcctgttgcaagttgcatgttgtagtagtatgattgctcatcatatacagggacttgaggtcaaaccccaattttacaaacatacatacatacatacatacatacatacatacatagcttgtcttggttcacacagtgaaattgacagagttcaaattcagctccaggtgattgtaagtagtgctttgtcttgctgctttactgcactattatattagttacttttctcattgctgttacaaaatacctgacaagaagcagtttacagaagcaagagttcatttcagcttacaacttgaaggcatatcatggtggggaagtcatggtgccaagagcttgaggtggctggcccatccacagtatatccacagtcaggaaacaaggagatcatgattttcatgttcagctagcattctttctatccaatccagaacctcagcccctagaatgttgctacccacagttaggatgtgtctccccacctcagttaacctaatccaggtaactcttcttaggtataccaggaagcttgtctcctaagtatttcttagagtctatcaagttgaccacactagccatcacaactatctttaagagaaatgtgacatccctccactgagaaagatacagatttgtacattataagtaaagtatatttggcaagtagtattgtgccttgaatgaccaagttcaaagaatgactgtcttgcactttatatacttgatcattaggaaacatctgcctaggatgaattcttggttactcttccatcacctcatttctctatctctctatcccttacttcttgaagttggaatatataatttcattgtcaatgcacctcctgctaagatgaagctttgaggaggaaaagggcaaaaaaacgtatgatggttgaatcacttatccttgttgtaatttttatacaagaatggattctatccattaaaggcaccaaatgtagtgctgatatgataacagcctttgcatgattttatcatattatgataattgatttcttattgagctatcattttccctcatttaaaatcaatgccctaatctaagactgttaagaagttataataagtagcaaaaataagggatttggtgtcagccttaaatgagccttttactgaaagatcctagagctcttcatgtgtggagcaagtggaaccctgtcaccagacaaaaactaagaaggctgagctgattcaaaacgccagtaattctcatatctgagaatactaggcgtttcatctactcctgacccggtttctgtcctggagcatgtgaccacaacaccccatatgaggatcgatcatgacaactagttgagtagcagagcacagcattctccatgctaatgaggtgtctagatgggccctgaggttttagcaaataagggaacttccaggacattccttcctgcaaaaggtatttagtctctggtctaccctgtgtaagtagtatgcatccactgcaaataaacagtttagtaaatcaaggactgtctctctcatcaagagaaggctgtgggcaaagccttcgtcatgcagagccatgttgcctaagtctctgcgctccagatactcacccttaagctaatctggattcctcttcccccagagcttatggttggcccacgggccccttaattctcaactccttgtggtttccagctgggtgcccaggagaatgggaaccccaaccttgtcctcagcctgtgatgcttctcacccaggctgggatcttgggcagtgttctgcctgaccattcctcaagcccagcccaagatggaatgtagcctagcacctcccccattttgtctgccagagcagcgttcacacaccccagcggcaaggcggaaccacattcatagaggtttaattttttatctgtagactggacagtaatcgaaaggcgatgctagaattaaatcaaatggcacttgaaaatgtactttataagatactgcatgctgatgttttcatgtatctactgttttctaacttactttttatatatgtctaccactagtaccctgctacatggccctaatgctgccagtttcatagtaatcactgactcctgacccttgtcttcagattttatttagtagatctgagatgagtctcagaaatcttttttttttcattctctccaaataatcccttaaacacaaaccagatatgaggcagacacacttgttctggaacacttagcaccatatatacaagaaacaatttactgcccctgactgggattcccagctaaaagcaggttacaataagaagttgcaaaccagctttccttaacgctccaaattcctacccctcctaggttataggaaacccagcctcatgatctcttaacacccccctcccacttctgtgactccagctgcatcctgagtacttcgaagcaaagactggtaaattgagccagcaattattgccttttaaaatgattttgagggttttctttgaaaagtcttagtcaataggaacagaagactatgaataacaccaaaatatttagctgtctattgaaacttctttacagtatcatgtaaaatgggaacagatgcaactagaccaaagcttggttagtaggtaacagatttatggacttgctcattttaaaaattaaggttataaacaacatatgtcaaaatcctataaaactgctctggaaagcgtcttcctagaaagcccaaatccctgttaatgttctgaatttgctttcagaactgaaagatgacattgtatacatatgcttaaaacaatgcttccttgaaacaaaacggactctgtgtgggtgtgcattcagtagccacactaaagtttcaagcacctagtctcttcccagaatggaatctatccaatcccttgagagaagaaagctttttctatttacaaatacaggtggtgttgccatgagttacagttttctggaagcctttgcacatagctcatgcttttaagacaaaggaagtcatatgagagtgaaatcaccaggtctttggtctatcctgaagcctagagacttgagaagaatctcaattggctccttttccttttactgtcacatctgcaagtctcctgttgaagctctctagtccactgttccctctaatgaagtcatgttctgtgctcagggcagtaatatcctcagaagcagatgtctcccataaagcatgacctcattccttggaatgggaaaagcccgcagtcgactgttggggtaatattgggaaggactttgtttaaaaatagtttctgtaaataatgtgttcaactttttatatatttctattaaaaggcaaatctagtttgttgctgtttttttttgttaaccttgctcgtctcttccagaagtagcagtcactgagctagaagtaacagtcctcacagagctcagacaattccacccagttgttggggcagatgggcaaaacttaggatgtctagatgttaaatctatgctctgtatgagaccccactgagtcacaacctacatttcataatatccctggagcttaggaaaaacaagccaaagtgtccaaggaaagttactgatccagatgttcccaggaaatgaggcaagtgagagggtcactagacaaggaaagaactgaggaaaagaacaacaattggaagcatgcagcttaaagctaatacaaacttgtttagaaacatagatatatggtagttcctagacactggcctctcaaatcacttcagaaaactagaatatagaaatagaatatagaaaactaggatatagacatagaatatagaaaactcggacgcccatagccttttagttacaacctgcaaatgccggtgtgctcctcacttctctttgtgtctgtgaataaggtaaatgcaaaagaggaataaaaggtctaaatattgaatttactaaatatggaaggattttacaggatcataaggcaataaaatacatatcagttaagcgtgatacctgctacttgtaaattaattactatattcccataagatgtctgtttcaggaacatctatgcattaaaaatgaagaatgctaataattctatgaatattaattgatgagaataaatattgaaaatacatttcctttcccaattcccatattagtcaccttggctagcaaccagtccctttccaatgatctattaaagctgcatcctcaccatagtgcttttccatggcaaacctcccaagaatccatttctccttgaaacttttctccacactctcacctttcatccctcctatttctaatgtcgctggagataacattggcccttgataagaaagtcttagagaacatttaaaaagaaaccatgacaggtttttttgttgttgttgttgttgggttttttttttttgctgctggtggtgatgatatttataagtgtgtgtgtgtttgactagcacggttgagagaactgttaaaaatgtaaactagactaaaactgtataccatttatccctcagaaaagtgcaacaaactaggaaaaacagaattgtttttattttttgtgatattagagattgaacacaaagccttttgcatgctacacaagcactatactgttgacatgtatacccagccctgtttgcatgtgtgtgtgttttgtgtatatgttcttgtgtatgtgcacacatgtgtagatgtggagatcagaggtcaacgttgggtgccttccttaactactttccaacatatgtttttgagagaaggccttcactaaatcttgagatggacaattccgatagacccaggaagtattctgcccttgcctccacaattctgggattataagcacatactgtcatacccagctcctgcatgactgatggaaaatggagctcagatcctcaaaattgtacagcaaacactttattaactgagccatctcagttaatattattaaatggatattattgggttttttttttcctaccagggtcatgcactacccaatgacatcctagaaaacaggagttatacccaaatcaatcaagttgttataaaaccaaacactcccaaatactataaactgttacaacacataaataaagaatggacgcttcctggctcattttgtgaaatggatatgaccttgataacttgtttccaagaaggaaacttaagatttctcacatttacaaaaggtcttaaataaccagtctggcaagacatagctactgatacactattgacatgaatatcatgggagtaaccatcttcattaggggtttctattgctgtgataaaacatgatgaaaagaaacttggggaacaatgggtttatttcatcttactgcttatagtccaagcaaatccgaacaggaactaaaggcaggggaactgatgcagaggccatagaggagaggtgattcttgtttattctccaaggcttatagagcttatatagcacaggaccacctacctgcccagaagtggcaccctccacactaggctaggccttcccataccaaacactaattaaggacatgtaccacaggtagaaggcatttgctcaattgagaatccctcttcccaaatgactctagcttgtatcaagttgatataaaactagccaccacagtaaccaactactttctgattagatttaaggttcactccacagaaggaatccataccgggtaccattatcaggagcaaaaagcccatggctatatagatcatcaacctagggaagagcccaatgctattattactatgctcaatgaacatagtatgaaatcaactcctagtgaattttaattatacctatgaattagtgtatctctcacatgttatcagaggtgttgctttttacaatagattatgattaaaatctgagacccacaactggtcaaggtctagaaaataggagactataaaatgcttagcccttaattggatcacacctcctcctccacccaagacttggggatcattgcagaagaaggagcagaaaggttgtaagaggcagtagatgactacgaggaaatagtgtttgacagagcaaggcagttgcccaaatgagctcactgcggttgtaacaacatgcccaagacctacatatgctcaagtcaaacaaaagtccagcatggagagggtaggtgggcataaattcccacccctagctaaagagctattggtaactggtaagttctaggagaggaaaagtcagttttcttttaggatgttgacccttggttagtcaacaaagatccattggaagaccacacacccaggagtttataggcagcacatattttatttgatgggttttctcttattatttaaaaaaccaacgtggacccagaggaagttggacaaagggtgaatataatcacaaatactgtattaaatactcaaaagaactaagtttttatatgtgaaaaagaggttgatagacattatagaaaaatttctagagattttaaggttattttctttgtcttccaataaaggaataatttataaaagccatcagaaaaatctgaaactagcaaatcaatcctgaaaaaaatattcactgtattatatgtcatgaccattttgtgctaggaatgtaaagacgattcaatgatatgaaaaagtttaatagtgcattacatcaactcaaagaatataagtcaatgatcatctcagataaaaggcacttgataaaaatttagcatccttttatgatacttcttagtaattgcagcatatcttggtctaataagcgtggtgcttagaggccatattactaaagttgggatgctcaacattattcttgaattctttttttaagatttatgttattttgtgtatgtgagtgttttacctgcatgtatgtatggacaccacattgacatctgatgccattgggggccagaagagggcatcagatgccttagaacggcagttacaggtggttgtgagccagcataaggtgctagaaactggacccaggtcctctggaagagtggcccatgctttttaactgctgagccaccttgaatttcttattaatacaatgaaagaagtagaaatatcagagagttacataaacactcctcacttactaatcaaattctgtagctagtaaacacaagaaatgtaactgaaaagatactgtaagtagaaagctccaaggtggctaggccagaagtgtccatttcttataggacgaggacagtatcagcaaaccttctgttcagaaaacatttgtaagttgaatatagttgaaaaactcagctggaaaattttttataggcagttagatcctttaaggccatttcagcatcatgtatgccttgagatcatgaccctgaacagcaattggtattagataaaaaggcctggttagttgagctttctgcttacttaggtttaaactgattgatgtttgtactagatttttccccatagtgatgagtttatagttatttaatgtccagaaactattttatccactttttgttatcttgtataatccttaaaacacctctgtcaagtaaatgtcattatcccagttgtacaaatgtggctgcactaactcagagttgcaaccatttcctcattgtcacacagcacttggtagagaggagcttcagcttggatgtaattctgtgacttcagagaccatgccttttccaacaccagttcccatccgtgcgcacagtcttccctccaagtatttcctggaacgtaattggaaaatgtggcaagatcagtaatgaaaacagagaaggcaagaagagaccttgttgaagagtaactagttacctctactctagggcagtcactaaatgactagagtacgctcacactggacagcagaactcccctgttgatccactgtaagaagaatccagtaagtctcagaataagcctcatctctggttaaagtgaaacagcatgcacagcggcagaagaactagccatcttgaactgttctgggacccaatctagagccatattgtagaaatgtggttctcagtgtaaccagtttgtggtttggctgcccagcagttgcggctgtattcctcaaaggcgaggcttacaaaattacttctgggaacagcacatgttacctaccatctgggatccttcaacccatggataggtttaacctgtccacaggaagatggtgtagctttgattaattacatcatgttccaacagtagattctctctgattcctgtgctttgttgggcaggaatatttggatgatggattgctattataacctttaacatatttaatgaattaacacatctcaactactaaagcaatccatttgattcatatgcatgcagctcaaaataattccttgaatctgcttaacacttcacactttcccaaattgtttttatttctattgtctcatcgatccacagaactgaaagcttaatacctcagattttgaacccagataaaggagaatagtgcaattagtactcagcatttgacctaggtcacggttgtcaactccagccaggcagtagagtctccagaagagcttttacattgttttcatgcccacccagcaggctgacagcatcagaatcctcaggacgggagtctgtgcagtgaaaggtgttgactctcttcaggtaattcaaaagtgtagccaaatttgaggcaatgagtttaaatctaagtcctgggtgacaagaacacattcaaatttcagtgtcaccatggtagtcagaggctgggatttagaaagtagcattttctataagggttgaatcttagaacagactgtactcatgagaaagtatggagaaaggagaaaaacaggagcctgaagactaacctttaatattcatagtggttaagaattttacgtctgttaacctagctttttggggaaaaaaaaagccgcatgatttcataataagaaaaacacacacgactaatcagaggcctttgtggagagaactgtgcatgtgtctaaggggatcaatgggaataatttatttagactttcaaaatgcctctaagtggcgtttgctagcaaaggttattatgctttacgttgtgtcgccatgcactacgaaatcagaggggccatccagggaagaggccttgaaaggcaggaataacgggcaggatgaatgcatatcttactagagtgagacacataaacagtagagtttgtaatctgcttctggttttagttaacatttttaaatactgattgcataaaagactgcagtaaaatctttaacaaactcctcagggctctgccacttattgctgtgtgacccctggcaagtctcttaacctctcttgttctatttcctcttcacctgtaaagtagtggctctggatctaaaagtctcctagaaattctatagatgagcttatcttagctcctctctctgcatctgaaatgaaagcaacacatgatcaagttctgtcattgattagagcaatggtaggaagtgactagcacagggtcaaggaccagaggaaccatttgttatacagaattatgcacgatatgaagttcattgtaaccagattggcaaagcactctttctgccagccatctgctggaacataaaaatagctttttatataggactgttctttataattggatttaacgtttaccaccgatttctttaacaatcaataaatttataaatctcttagagcattttatagttgaagcttgtgagacattagaggaaaaagttatctagtgcatatgtacatttaagagaattgtaaatagatgaagtgatccacctaaggtcagagaacaaaaataacactacagagatgtatctctggacaacttgtttagctctcttcaccttcttcctatacttgattccaaagcaataaatatatggctttagaaaaagttgagtccacaggacagacttatcttttggccatcctttttagctaggtatgtggtttggtaatggtggtaatgacatatgaatatgaagattatagttatctatgagtgcttagatattcttatatgctatacattttctcacttatcatttcttttgagatagatactatttttgagaattctacaggcaaatatatcacatcatttccatccctcttgctcccactcccactcctttgccccctccactctctctaaaattcatgacttcttattctttaactattgagctatatatgcatacatatttgtgtataatctgcttattgcatttagtattgtgcatatgtatatatatttaaggctgaccacttgatatttgataacctctggagggaagggcctggagaaaaccgattctccctttctcggtagacattgattgtatctcttcctctagagttggagtctggtgacattctgcccgtccatatttgcatgtcgactgtcactctcatcattcaggtctttttcaggcaatcatattgttaagatttcatgtgttcagcttcactatcatatatagaagacactatctccaagccctcatattggtactctgctgtctttctgtcctctcatccacaatgttccctgaagggttgtgttgtagatgtttcatttgggattaaacatcctgtgatctgttgctttctacatttgacaagtgtggattcctgtagtagtcttcatatgcttcaaagataaggttcttcagtgaagaataaaaatgacagggtataagtaattagaatgggtattagtaattagagaatgcaattacaaattacactagtgaaagtagcagtagtagattctcccttaggatccatgacctcaacagccacaggtagttagctaagtttacattaccaggcatgaacttctacctattgagtggaccttaattgcaattagacagctgttagctaccaccaagatataagtgccactatccacccttgagaatatcttgttaggctgaaggctattgtagtacatgggctttatacaggtattactattattaatttttaagtataactgattcagagagctaaagtaacttgcccaacatcatgtaggtattgaatgttagcactagaaatcaaagctggttcagaaaggataacaaggttaatgatctttctacaatccaattttcccaaagagtataagccagagtattaactcaacaaaaaaaaatagataactcttggaaaagattcttgaccaaacaagtttgcctttttgtctccatttcctactgctgaatttattgaaaatttttgagaagccttcagctgaaaaaatatgtatttttctttaatgctatgtttcttaaactctttttaaacaggtatttattttttcaagaacatctgctaatatcacatctctttcatattccctataatggaggactacaaaatgtataaaacttgggagataaaaacaggaggatcaaggtttcaagaccaacctcaactacatgaaaccctatctcaagatgccaaaaactagggatacaaaagtgacttagtaatgtactccttgcacaagcatgagggcctgagtttggacccctagcacctatataaaatctggacatggtagtacattattgtaatctcagcactagagaggtggagacaacgagatccctggaactcactggccaactagcctaacacaatcagatagcatcaagcaccagtgagagaccctttatcaaaaaccaaaatggggccagcaagatgattcagcaagtaaacacacttatcaccaagcctgacaacctgagttccaactctgcagttcatatagtataaagggaggacaggtaactacagattaccctctaacctccacacaaatgctatggcacacgtgtccctgtgcttatacaagcagtctctcacagagaaactccagcaataaataaatgtaataaaaagaagagaaaagaaaagaaaagcatggtggacagccctcggtaatgaccctgacattggcctgtggcctctacgtgcacctgcacatatgcccagacacgtgcacatatgagtgtacacacatacactcaagcatgcacacacacaactatttaaaactgtactacttctcaattcatcttcatagattgcatcctaggcctagcttttttcatcttaaccacttgtgaccaaagactcaatgttgcagaatgtttctttagcaagagcacatgcttgtcactttgagtatgtctttgataacgagaacaaacctatcccttatggaactttaaggcactattaaacttctgaactgtcagcagttagtggggctggtttactgttgccctaaccacagtaatatttttgagtctttcccaaaccaagacagaagtgagccagaaaatttcatagctgctaataagttaagtcatgtttgtagagcttgagacccagatatggacctctgctctaaagcatataaaggaaattattggatgaaagattcagaccctctcacatcagaaataattgagattagagtgggatggagtaggggtgggatcaacttgcacggtcctacctcttctggccctttccctcatgctcagagcagatgttggaatcataatctgggttctgagcatggacattccatgtggtttacattcagaattctcactcttctttgaagctaatggcttccatcttctacaaatgtattgggcttgccacgcttatctgtgcattctctgtttataattcttatggtataaagaaaaatattaaagaaactcttaagatttcaagatttgaagacataaactatgtaactacttgttgtttgttttgtggttttggttccttgggcttgtgggactaggaattgaccctaggctatcacttgaccgctgaactatacatgaagccccctgctttgaaataagaaatatctcgttgtatacttactcatctgctatccatcccttttctttttttttttaatctctttactgactggtattggggaacatttggtcatgcctagtccctggtgttattctctacataaagaaaagaagactacctgtgcaaccaacaaacaataaaatgtacatttatttgagtacttgcttcacatagatcactttcagtaatttaaactggaaaaaaaatgcaattgtgccagttgtacagatggtcaattttggaaactatttgtctatatacttggtactatggttaattcaatgtaatggaaggtgaagtaagttggagtctgaagaatcttgattcacatctccaattatcacctccttcagccattcatttcttcatcaaacaatcagtttttaactcctattataaaaagaaatgctttaggaactaaagacacagaggtgaacaattcatagctcttaccctcaaggagttaacaatattgtaagcaaaacaaacacataataaaagattataatctgagggctggataaatggcttagaagttaagagaactagctgctctttcagaggaccagggttcaaatgttcataactccagttccaggggatccaacaccctcacatgtacataaaggcaaaacagcaatgcccataaaatacaaaataaaaatattacaatgtgataaatgtatcagtacattatggaatacagaagaactggtatctagaaggcatcttacagggtgagcaggcactggaagagagtggagctgaagaagggcatttcaggcacatacaatggacagaggcaaaaggtgttgcatgttgggggtgtgcagctaaaatccatgctgaattacatatagtatggttttactttaaaccagtattaattttattaacatccttttatgattatactctatttttagaaagccacgatccacagaaaattaaacagaaacaatgttctaaaatatattctctctctctctctctctctctctctctctctctctctctctctctcttctcctccttggcaagtattcattgtttaccatttctccaatgtcacgtggtagtacatagacttttcagcctagtttttttcacttagcaatatgcatttaaattttctctgaatccttctgtaacttgaaagctcatttttcttattgatgagcaatatatcactgtataggtatatagcaacttctttatccgtcatttgttaaataattgttgacagtttgagtcaattatgaataatgttgataaaagccacctgtatgcaagttgtgtgatcacacatttctagctcttttgagtaatatttaacactgtgatttctgtgccaatttctacagaattaccaaaccattttcccaaatgtgccactttacattcacccaccagtgtgacggcaggacctgttgcttcgtattctgtcacaaattagttatcagtgttttacattttgccatttgtggactgctctctcctcatattaaattgcagtttcatcatggcaaataatatctttttccccatcttaattatctcctttggttaagtgtctgttcatatcttttgcccatttctttttgttcattcattcatccatccatccatccatccattcactttacaaccagattgtagtcacagtcccccctcccaggcccacccttacaaatccttctccccattaccctgtcctcttctacttagatgaagggaagccctccttgggtaccattccaccctgggacatccagtcaccttgtgcctatgtgcatcctctctcactaaggcccaactaggtggtccagttaggggaagtggttccagtggcaggtaactaagtcagagacagcatcactccaattgttaggagactcacatgacgaccaagctgcacatctgctacatctgtgcagggagagctaggtccagcccctgcatgctctttttttggtagttcagtctctgtgagtccctatgggcccaggttggttgaatttgtaggtctttttgaggtgtccttgatccctccagcttgctcacttctatcccccactcttccttaatactccccaagctctacctgatgtatggctatgtgtcccttcatctgcctctctcccttgctggataaagcatctcaggagacagttatgctatgttcttgtctgcaagcatagtatcactaatagggtcaggagttggttttcttatatggggtgtgtttcaagttgggccacttattgactggccattttctcaatctctgctccatctttatccctgctcatcttgtaggcaggacatatttggagttgaaggttttgtggataggttaatgtccccctccctccactggaagtcctgcctggctacaggaggaggccacttcagtctccatattcccagctgctagaagtctcagctagggtcaccgccatagactcctcagagtctcccccatcccaggactccagttactcccagagatgcctcccattgatttctgttctcttccccagtcctctaacacccacctctccccacacccaatcctcatccttgtccccctcctcaccctatctcccaccaagattcttccctttctgagtgacattcacccatcatcccttgggctctcctttttacccagtttctttgggtctgtggagtgtatgctgtactttatggctattatcaacttataagtgagtatataccatgcatgtccttttgggactgggttacctcactcaggatgatattttctagttccatccatttgcctaagaatttcataactcattatttttaatagcttagtagtacttcattgtgtaaatgtaccacattttctgtatccattcctcttttgaaggagatctgggtcctttccagcttatggctattatgaataaacctgctatgaacatagttcagcaagtgtgcttgaggtatagtgggtgtagcccatttcttaatttgattctttcttaattattaggttttctgtttagatgtttgccggttttgttttgttttttttcccttgggtttcaaagctttaatttcaaatatcttttggatagaagtagttatatgacatgttccatgtgtttttgcaaatgtttctcatggttcttgtttgtttgggagttttgttttttgagacagtgtttctctgtgtaaccctgcctgtcctgaaactcattatatacaccaggcccgcctcactcgagagatcttcatgcctctgcttccatggtgctgagattaaaggtgtgcatacattgccatgcttagtagccacagctttttttttcttttttttttttttttttttttttggttttttcaagacaaggtttctctgtagtcctggctgtcctggaactcactttgtagaccaggctggcctcgaactcagaaatccgcctgtctctgcctcccaagtgctaggatcaaaggcgtgcgccaccaccgcccggcttagtagccacagctttttaaaagttcacttaaggataccattttctgaacaaattttaattttaaggaaagccaagttaacttttttctcagttgtacttctaattttctacctaaaaactcgttacaatggggaaagttgactagaggtttattatgttgtgtcatgagatttttatggtttttgtatttaaggtttgaccccttttgagttaattttgttaaaggcataaaagtctgtgtctctattcacttgtgtgcatgtagatgcccaggtgttccaccaccatgtatgaaaataactctcattttttctgttgagttgccttttgtcctttgtcaaagatcagttgactctattataagtctgtttctatgctctgtgttccgtttcacctgtgtgtgctatttcaccagtaccacactggtttgattgctataactttctagtaaattttgaatcaaagaatggcagttctccaactttgtttttatttcacaatattatatttgacagtctgtatctgttacctttgtgtataactgtttgatttagtttgttaatatctacaaagtaacttcctaagattgcattttatctgtatgttatgtttggaggaagtgacatttctgcaatattaagttcttttccatggacatgggctatctttccatttagatgcttatttcttaaatcaaaaatttttcccatatggatactcatattttgttaaatctatacctaaatgctaccctcctctctcattttaaggtaaatagtgctgtaatcttttatatcgaatttcagctgttcattgctgatatttggaaagaatttgactccagtatattagagtttaaccgtgaaacattatgttaattgatatttagttccagaagccttttgtgagattttctaccagaaagttatggtatttgtaagtagacaggattaattcttccttttactttatttcttttcttaacttgtcacatgagctaagatttacagaatgattgctgaattatagtgttgcgaatggacatcccctactcgttcttggatctaaagggataacttctggttttctcatcactatgctatacaggatttcttatagctttcttgattaaattgaggaatgcccttgactcctattgggtggaatttttcatcataaagggatgtggaattttatttaagatattctctacatctagcgatatgactatttgtttttcttctttagcttattgatataaggtagattcaatagattaattttatgctattccagtcttacatatgagaaataaatccttcctggttgtggtctcagtacattttctgctattttaatgaaatacctacagctagaaattttattttaaaaacttatagaaattcatttgttttgttttgagttagtatcggcatgtatataatggtggttagcttttgttatcctgacacaaactggagtcacctagagggagataatcccacaagccagtaagcaatcctgccccttctccctcttgaattcctgccttgacttctcttccgactgtgactgagatgtgtaaatcaaataaatctttcccttctcaagcagattttggtcagtgtcttatcatagctacagagaaacaaactagactagaaatcaatgccagagagagtaggtccttgctgggaaggatctgaccatgtgacttttatgccttggaatgtgttgtgggagaaatgtggagaattttggagctttaggcaaggaaaaccattgagtgattaagcttaatgaactgtatcgggaatttagaagatactgctaagagaaatacaggtggtggaggtctggcttgcgaagtttcgaagggaagcaaagacctttaacaaggctgttcatatgatagtttggattaagaatttctggaagtaaaacctttgtttaacggaaaatgatatctatatttctcaccctgcataaaaaataaagtccaaatggatctgggatctcaatgtaatacctgaaaatttgaaattgctagaacatgtagggtgtatgccacaaaacatagtcatatgtacaggatttctgaataaggcactgtttgatcagaaaaaaaaaagactaacaattgacaagtgggactctattaagttaaaagagtggtcagcatctgtagccaccaggcaaatgcaaatcaaaccccaccttgagagtccatctcaccccagttctagtggtatgtaggagaaaaataagcaacaaccaatgctgagggtgagggtgtcggggaggagactgttgacagggatggaaacttatacaactgctgtggaatccagcattgtgttcctcaaaaaggctagaaattgcatctaccacatgacctgatgactagaccgttcctgggtgtatgtccaagggactctctattctccgacagaactacctgcccaactatgtccattggtgattccttcacaacagctaggaaaacaaatcagccttaacagtgtgctggcttatttttttaaacttgacacaagcaggagctacttgggaagaggaaacatcatcaacaaaaatgcctctaagcagactggcctgtgggagaattttctagaacaatgatgatgggagtggacccattctatggcagggcaatgccaccagcgagcatgttgtcctgagttatataagaaagcaggctgagcaacccatgagcaataagccagtgaacaacattctctatggcctctgctgcagttcctgcctccgggttcttgccttgagccttgatttccctgagagttgtaagctgaaataaatcgtttcctcctgagttgcttttgattatagtgttttattatagcaatgggaaccctaaataaggcatatgtcaatgataaagtgataatgaaaatttgtgatacagttgcaaaacagaattctctataaagcactaaaacatgtaattatgaattttttaggaaagttggtgaaactggaaaaattatgcagggggaaaggcctagaaagataagcactgcatgttcctgctcatttcaaaattttagatttttgtatttaacttggaatatccagagagcaagaggttttataatggccatgggttgggcaaagaggcttgaatggggcaaacagtgagaactcatgttaattaaagtacagagggaagactactatggtggtaaggtttaaatgggaaggggttgtaaaggacaaaggtcaggaggaggtagagacagggagttaaccaaaactaaggttataagaagacatgtagacatctccctatgtggccacctaacaatataggctgttaccattattcttggttgcccaccagaactagacaataatactctatacctgaagacatcacatacctccatttcatgacacagacaaatcaatttggaacttaagtagaagctccctccctattggctaatatagattgtgtcaaaaatgcaaaataggctgcccggggaggaaactcatcaatacaaaactcatcaatacaaaactcatcaatattttcagccatatgtggaccttgtgccctacaatgccacctgcctaccaacacatgcccactggtgcaaatgaatgttgtgagcacagcttcagactctgtgataaatttgagacctgctcctcagaaggaaatccatgcctggtactataaacctggttttaaaaaacaaaactcatggagtttgctaaatgaatatggcatcaaaccactttctaaatatttatacttagatttatacagatacacacatgggattctcagctttgagtagagaaactttttataatgaatagcagcgagtgaaaactcagggctgagagtaattgactgttgagtactcaggcctaagcaataccacctcttctgtctcagggaacatcatgacccaagggtaaaaagaatataagaaccagatgatagggagaagggctgtgaaatgctaccttctaggcatgacacagtctttgcagttgtgaactcagcagctgcaagttgcctatactggatctgcacaagactgagcctgtcagcagtcagtcaggaggcagagaagtacatgagcccacccccaaccccccccccccccgttccctgggaagctattggctttttacagaggctcagggaggggagctgtctcccattgtgtagctgctgatgagcctactgtgctccagtggatccaatgtccatggtcacatggcagccctggctatcatttcttccacagatccttaagctataaataaggaatatatatttgctattattattttgaacaaaagtattatctactaagttgagattaaataaagtgtttaaggcatatttcttcctgaagcttattatttttagcttttaaaaataaaatttaagtacaccattttctccctgccctttcctccctccagcccctccctgggcctccttaccttgcttcctttcaaagtcatgggccttgtcagagcaacctacttagtccattgagtgcaacttagtgttgcatgtgtgcacatgatttcaggtcttggataatcaactaagagactcatcgctggcagggactagttctcatcctctcagcggtcatttctttgtctggatgatgcctgtggactttccccttcatctggtatgtctgttggtgttacacgtcttcagatctcctttctttagcttcccttatctggtcttcttctttagatccaaacttctgccctgtgtcatactcgttctctgttaacatttctttaaatctactgtcaataaatttcctcaatttttatgtgttaaagagtccatttctcccgtttttaaaaagataatttcatgtgatacatgattcaagcttgttagtttttttttttcattgatcctaattctcaaataaagataaagtgtgtggtgttccctaatggagcagacaaagaatgaggtagaaactcacttgccttagggttattttgtttttagctgtttgttagccccacgtctatcataaggcatccttttcctaatgtctgcatatgttagcaaagcctgtctcatctccactttacttttaccaaagcagtctgaactactttacagctggctgtcccactctgatatgtctgtggagttttgcatgtagaaaatatggtgtataacctccccagcctgaaacctgtttgctcaggtttcagtgttagagagcattgtcgttctgccactcccactgcctctgcctgtccctagctgttccagagccaaacacgtggtcacctgcaactttactccagggtgatttggcgggaatcgggccccttcccctgcttcataaccgagtgtcagaagagtaaaatcgagctttgatcagaacctagtttgtcttagcttcgttctttctctcgtctgcctaggcccctcttctcttccagattccaagatgccattccagactagaacccagacttgtgagctgctggccagccgcaacaatcgtggttacaaatagagggaatgggaggatatagaaatgttggttcttatcatgaaagcaacacatgatgatggtagtactatggattagggaagaataaggttctgaagcatattaagaagacggatcattttatcttaaaagttatggaattgaaaagaaatggtctctgttacttagataccgctagtatgggaacagctctagctcaccagcatttcctctctagaaacaggaaacctacagtgacctcaaagagaaagggatacatgtgacaattaaagggaggaattttgaaactcataaaaaatgatttgctggccatagtaatcaatgttagaacaaagaggaatccttatattgttgagaggatatactcattggtgcttgtaggaaatatgatatattgtaataatattatgtgccccccccacacacacacacaagggatatgacatttgcttactaagcagaagttctatgggagtccttctgtgaccagaagtgaagtagaggccaggatttggagcatcagttctatatgtgacctttatgttatagccatttagagaaaaagaaaaatttggctggttctttacctcctcacatagtacaatataattcctgccacattaatcacaatttagaaaaacataaaaaagctagaaaaatatccaaaaatgatacccatgtattactttagggaaagcctactaagcatgaaaactgagggcagtaaccatatatacttaactacataaaaggaaagcttttatagtctttgagccaacactgctatttataatgacacattctttaaatattttgataagtgaatgaaatgatacacacatgaaaacattataatttttaagcattgtttataattacaatttataatcatgataaaaacaaagatcattaattaaatgcctccatattaaaaacaacaatgtagtttgaaagagtagcagggagacaaaacagggtaatggaagtagtgaatggatccgaatatgttatgtacatgtatgaaaacagcataatggaaccattatgcataatgtatatttgctaataaaacttttaaaaaagaaatcagttgaaagtatatttgaaaaatggatattccaatgaaacacatatatctgaatattcaaaactaatatccattgggtggactgtagtagcacacacctaccactcaggaggcaaaaccaggaggagctctgtgagttgaagactggccaggtctacatagcaagttctagacctcccaaagttacatagagagaccctgtttcaaaaaaaaaaacaaaaacaaaaacaaaaacaagggctggagagatagctcagtggttaagagtactgactgctcttccagaggtcctgagtttaattcccagcaaccacatggtataactcaaaaccatctgtaatgagatctgacgccctcttctggcatgcaggtgtacatacaaacagaacaatgtattcataattaataaatctttttaaaacaataacaacagcaaccaacatccacaaacgacagaggaaaatacaagacagttgcctttctgagtctgagttacctcacccagaagtttgtttgcctgcaagtgtcatggttttgtttttaacagttgaatggtactttgttgtgtagatgtgctacagtttcattatccattcaccagttgatggacatctaggttgtttccatttcttggttgacccactgagtgtaatttgtgcttgccaaaatactgtgtggagcactggaacaaggtagacctaccaggaccacacccttaaaactgactcccccatgacacctccatgctgcattgttgactggcttggtcttctacagatgctgcatagctgcaatgaatttgtgagtacaactgtcctgtcacattcaacaaaacacctcgtgttcttacagtcttttcacagtcctcttctatgatggaccctgggtgttatggggaaggggaaatatgttaaatagttgtcttagttagggttactattgttgtgatgaaacaccatgatggagaggaaagggtttattcagcttatacttccacatcacagttcaccattaaaggaagtcagggcaggaattcaaacagggcaggtacctggacacaggagctgatgctgaggccatggaggactgctgcttacaggcttgcccctcctggaggaccaccagcccagggatggcactacccaggatgggatgggcccttcctccatcaatcactaattgagaagatgccctacaggcttgcctacagcccagtctcctggaggcattttctcagctgggactccatcctttcagatgactgtagcttgtgtcaaattgacataaaactagccagcacaatagtttgtggctgagctctccactaacacttattccctgcactttgaccacttgtaagtttctgcaataaccatccactgcacaaaaacatttctctgatgggctctgaaagcagcgccagtctatggttaaggagatagcaatttagagagcagtgtgatattatatctatttaagaaagcaaatagtaggtagatttaccctggagtctatgagctccccaaccatagatgctcggcaagatttttttaaatatttttattaggtattttcctcatttacatttccagtgctatcccaaaagtctcccataccctccccccccactcccctacccacccactcccactttttggccctggtgttcccctgtactggggcatataaattttgcgtgtccaatgggcctctctttccagtgatggccgactagaccatcttttgatacatatgcagctagagtcaagagctccggggtactggttagttcataatgttgttccacctatagggctgcaaatccctttagctccttgggtactttctctagttcctccattggggaccctgtgatccatccaatagctgactgtgagcatccacttatgtgtttgctaggcccgctcggcaagatttatagtagaaatctttttttttttttttaaattctctttcctaagtcagatgcagtgtggcacatgactgcaaatcccaacacttgggcagggagaggagtgtgaagcaagaggattgctctaaattccgagttcaagaccactatgggatacaagtgaattccaggctagacagggttgcatagcaagaccttctgtccaaaaccaaacaaatgaaacgtgtcctctttccctcttatcacccgtgtgtttaaggtgaacctgtttttaagtttttttattcctcaactaacaagcatgactcccgggtcccccttgaatgaaaaatactaaaagaaaagaaaaagaaagaggaaaggaaatattactgttcctagttgtggtgtaggagaaagtttactgtatataaaaggtagaggcagggacttctgggagagtggacatgaccctgagctgggctacgtggggagagggaggagaaagggagagagtggggagagtctagccagatgcagcacccaggaagcccaaaggtacaaaaagagcaggtaaccaaaatgtctagattgtatagggaagagcagcccagccccctggactagagttcagagtagggagtggggaggggtatgccagccaggagagccctgtaacaggtagggactaagggatacctggagaacctgatggccaggttctatttgatatgttaaataggcacttcagccatttgtcccaggtttgaaacctaacactcctatccaacttgtaagttctatgatgatggtgttctggcactatttactgtgctaccaccttccatagggatactcagaaaagaccagctgactggtgatgtcctggattgcctcagaatctggtgcaacagctctatcctttagctagcagaaatgaccaaaaagtagagcagggatatgccaccttggctgtaagggcagggcagctgcagtagccaccaccttgcttatgaggctggagtaactaactggccagttggtagctagctggtggggatgtgccctttctgtgtaaatccttccttaaacagctatcttattcaagaacaaagcgcttctctggttatgttgttgtttctcactcagtcatagccatccagaatgcttaatgctgttttgaaaaacaacatacaggagccaggtatgcctcatgcctgtgccccagctctcaggagactgaggcaggtggattacagttcaatgccaacctagactacacatttaaacaatatctcaaaaactcagagcacaaataaagatgacaacagagggagaaaaggtgtgaggagacagaggatataaaaagaggaaaatcatgatcttcaattgctccactgaacctgaaacatcttctgcacactgcacacaattcctactgctgcacggttctttttgagagaaatctaaacagacattgaggttttgaagggacatatttgctctggggccacactgaagatcttccaggttagagactctattagcttcctatgaaacctgatttcataggtggaaatctttctatacttttacaagaatcaagttagataatacacagaagcatgaaacaaactgtagactacagaactgctcctaaggacattggctgtggtttagagctaggctatattggcttcatggcagtttggaaaagaatttaagtgcctgtgtctaggggaagttatattcatccaaagaaagaaaaagcctgagtccccatgaataaaaatgagctctgttgattaaaatggctttctttagaaacaatacatgagaagacacttccgactctactacaaaagaagctgttgacatttcctttagagcacccattaagttatggcaaattgtgggagtgcatgtggccccacatgaatgtattacagctgcatgcttctaataactaacaagttaaatcacaataaggaagtgactgagaaggaactactattgttctgcttcttctataagaacactgccttttctcttctagtgtcccaatctgaaactttgcatcactactttgcctgaatgcatgactctacaaccttaggacttgcagaattaaaggaatgccgtcctgaggttgttgagctgtgcgtttctgggcctttcatctctacagaagaatacccttctccctcctgactaaagtgggaagaattgttatttttcaagggaagcatccttcgtgtattttgttctagtctctataatcagcaaacaaggattttgatagatggatggtagctaccttggctaaaatctggaccatgactatgggctcctaaatttgcagtgcctcttactggatttttagagaataaccatttttaaaatgatctactaacttaatcttccatcttttatttctaataggtcctgttaaaaacaagaaaaagggtaagttgagttttgtgattttattaaattgtcatgtcatttttaattagaaaaaaggaatgagacaggattttgcatgaatttctttcaacatagattgcccattgcttcattcaatcattcacatgagttttgcactttataaagaacaagaattagttcttcaacaacaagccatggaaggtagaattgactctagcaatacatacaagttgtccttgtagaatcatttatttatttatttatttatttatttatttatttatttgtctgtttatttgtttgtatatttatttgctctgtgtatcttcttcctcttgcactggggatacaatccaggacttctgccctaagaatattaggcagaagctttaccactgcattctactccaagcccgcattgtggttcttctttcttattccttttacatctgtttccagttcatatttatttccttctcttgctctgtccactgccttctgttttcttctttccttcctttatcagatcagttgtcaggcattaatgaagacctaagactgtttatagagaaaagaaacactacctatggaaaggtaccatcaatgatttggtccttcaccttaaagctgtcaaagatgatacctcttgctctgagaatttagcatcatttgctcagtgatagaaataagaatctatgccactgtgttactctgctcctgtcctgtttttaaagtagatgctagttggaactattcactgtgctgtccttagtttcttaagtccactttgtacttaacaagggacttgctaagggcacatgaagtacttgcttgcttgcttgcttgcttgcttgcttgcttgcttgcttgcctaaagaagataatccaacgagaaagcaggttgtattgtaaagactaggcaaataaaattcaccctttgcactagaaaaaaaatcaactgtaaaatcagtttatgtacctgtctgtttctgggttctgacattaaaggaagacagagataatatgaaactaatgagtttccctttagaaatacttcctttttgcctttgtctatatgatactgggaatttaacccagggctttacatgtactagtcagatactctattattggactacatcactcaccctcttattactttctttgaatgagacatgatctcacttcattgtccaggctggccttgaatggactctgtagctcgaactgaccttgaatttagtgatctgccctcataagcctcacaagtagcttagattatggaccttacagttctttaccaggggtacagacataactccactgttaagagcactcattgctcttataatggacttgggtgtggtttccagcatctccttgatggctcacaaccatctgtatctccaattccagggaatgcagtgctgctttctgtcctcctcagacaacaggcatgtgtgtaatgcacatacacgcatacctgcagggaaaacacttagatacctaaaataaaataagtaagcataagaaaggtctttaagtgatttttgtctgtttatatttatggagcattccaaactgcacaaaatggctaactacagaggtagcttggcgatcctctgagcagtagggtactcttatcacttcaggtacccttagctacgtgtcaaactcatgttcctactgaaaaagaaaagctggaaaaatgcccagccttctgacgacctgaattgagcaaagttagtaaacagcagagagccagagtgagtgcagaatccttctgctgtttcctgggtgctcactcccaggatgcttcatcttttaaagaagtaaatttgagtttagagtattgggttcttgagtcttgttgcatcccttcaagatagaaattatagctcgtgccattgcttagcattgccaccttctgtatggaacattattgagaagaaaatgtgtacaagccttaaccatctactttatttaaaagtgatttagaagccagttaatatgggtttccttggacacagtgaataggcacatgcttgaagagggaaattgaactgttcacttaattttcaccctttaatggaattttcctactcacataactctctccctctcttttcacgttacccccaccaccaccaccaccacctccctttactcagttgctttccattgttctttcaacatttagaacttagctgaagaggttagggaaatgcccctttgatgaaatttggctctgaaatgatattattattttatctaagactgcacagcttactttctcagtataaacatctctaggcttttgtatcatgaagtattctgtcaaagttaggaaatctaaagacagaattcaatctcttggtccagaggtcattttctgcatacccttctctgtccctaactttctttttctttttaatttttttattagatattttcttcatttacatttcaaatgctatcccaaaagtcccctataccttacacccgccctactcccctacccacttgctcccacttcttggccctggctttcccctgtactgaggcatataaagtttgctagaccaaggggcctctcttcccaatgatggccgactaggctatcttctgctacatatgcagctagagacatgagctctgggggtactggttagttcatattgttgttccacctatagggttgcagaccccttcagctccttgggtgctttctctagatcctccattgggggccctgaggggcttccttgtccaagtgttgagaatcgaagagggccagctgcagaaacagacttcagcacaggctttttctcagatgccttctaacattttcataagggatcactctctgtttacactgcaaccattattctcttggactagaggaggctctggatgtagttcttctaaaatgacattaaacaattataggggacacacattcttggagctgaagtttgtgatacccacagcacccttagctggaaaatctctgtggagcctgaaaatgctgcaacccagcacatccaacttctgtgtctactccatctatgtttttgtgtcaatttctttgtctcttccaactggaaaataaggagggaggcagacactttacatccaggctttggaagttttcccagctgacattagttcagtctttcttgtggaacctcagtctcaagaagagacataaagcaccaaggccaagctccttgttcttgggttccgagtgcctgtgtggaaggactggagtttacatccttatctccagagtccagatcctgtgttatttccactatactaactagaattgaaatttgggtgccgaataagcctgaattggaagctacacaaattcaaaaggagatgattttcctattcagcatcttaaaattggctagatctagaaactgggcagatcccatcttaaccactaagctcagggcctctaagtctttaaggccctatacgccctcttgacgaaatgctctcagaactactctttcttctctgaagaggaagtctgtgatagtttatatattcttggaccagagagtggcaccatttggaggtatggccttgttggaataggtgtgacctggttggagtagttgtgtcattgtgggtgtgggcataagatcctcaccctagttgcctagaagtcagtcttccactagcagcctttggatgaagacatagaactctagctcctcctgcaccatgcctgcctggatgctgccatgctcccaccttgatgataatggactgaacctctgaacctgtaagacagccccaattaaatgttgtttttataagacttgccttggtcatggtgtctgttcacagcagcaaaaccctaactaagacagaagttggtaccagggcctggggtattgctgtgataggcctgaccatgcttttatttgaaagaatgtggattttgggactttggatttggaaagcagtggaatgcttaaagcatttaaaatggggcttaatgggtcatcttagtaggaatagggaagactttgttgctgggagtaatttgaactgtgttgacctggcccaagagatttcaaaggagaacaatttcagaatgtggcataaagattgtttttgtggtattttggtgaagaatgtggctactttttgcccttgtctgaaaagtctgtctgagactaaggtgaagagactcagattatttgcattgtcaaaggaagttttaaaaaagcccagcagagactttgttctctggttaagtcttatgaagagaagtttgaacaagcatagcaagcttagaaaggaaaaatataaattatatggttcgagtattaaaggcataccaggaagtgaaatggagcaaaatcttgtgttctaggagataacagattaagggagtgggaccttggggcaagatcctacccagctaaatttagatccaggcatggtggtacacacctttaatcccaggagacaggcatgctgatctctgcattcaaggtcaatctgcagagcaagatccaggatagccaagcttaggcagtgaagggtttggaaaacataaagccagtgatagtgtaatagtacaagggtgtcatgttctagttcctgcaagcagcagaactcggcagcttcagccatgtggctctagctctagagttaagagtgaaaagaactactgggacaattgaagctggttagctggagctaagaaattaagaagagaccaacatcactaaggtgaaatcttctgggaattgttttctgggagcacaaagaagttgtgttccagagatagccaaggttgtacctcatgctgcagctggatttggtaatgtgtaagagtcgcccaggtggtacttgttttgaaggcatgaagttgccatgaagaacagctgaggtttggcactgtgagaggtcatggaaggccattggagaaggtgtagcctcggctcggctgtagtttgatggcccaggacgaaggggtcatgcaaaggatttgaggcttggcaccatgaagagagcctatgagaggatattggtgaagcctagttggagtggaataccccagtgtattgaagatgtcagtaccatggaatgatcaccaagaacagcagccatagtggagtggatcaacctgagcatagagtgctacagagggcagagatggagaagtgatgccagcccttaggaggagtccaaaagatcaagtggaatcccagatactgaaacaagaagctgtaacattgagattgccttggagactcaaagatgttaaatatgccagagccatgggatacatgctgaggaaagctgctaacaggaagtggaaccagcccaggagaaagcagtttgttgcaatcaacaaaagtgaaaagggagtggagatctgaagactgctttgacatcagccatggagatgcagagtttggagtttgcccagctggtttcctattgttctttgaggattacagttaagtgattggatgaatctcagaagagaccttgaactttgtatttttaacattgttgagactactatagactatgaggactttaaaagttggactaaatgcactttgcattatgctatgtttaagtatgccccccctagactcatgtttttgaacaagtctatgagggtcaaggagtggaatgtgacagtttgtgtattcttgggccagggagtggcaccatttggaggtgtgacctggttggagtaggtgtgcctctatgggtgtgggtttaagatcctcaccctagttgcctaggagtcagtcttccactagcagcctttggatgaagacatagaagtctcaggtctgcctgtgccatgcctgcctggatactgccatgctatcaccttgatgataatggactgaacctctgagcctgtaagccagccccaattaaatgttgtttttttgtaagacttgccttggtcacggtgtctgttcacagcagtaaaaccctaactaagataaggtcccattctgacccactgtttcattccaaatgagcatgtggttagatgtggatagctggcctctttgtgggcctttcttggattcatggtgggttttttagatatatggaattattctgttttctactttttaacttttattgattcgttgtgaatttcacatcattcaccctaatcccacccatcttctgcccctccgtatccaccttctgcccttgcaacctccccccaaaagaaaccaagcaagcaaacatctctccattgtgtcacgtagtctgcccttttacccagctttgcttgcaaaagatcattgcagtgcgtcattggtctgctttgaggcctctgggtgagagttattattcttaaagggggggttgataaatcagggcagaattcactaaactaaaatatctaaggaatgagttgtttaaagggaagctgatgtggttgccattgtgttactgttgctgttgtttgattcggggatttcatttgtttgtcaacgtgatacaaatcaaagttatttgagaagcagaaccacaattgagaaaaaaaaaatgcctccatcggattttcagtaggcaactctgtggggcattttcttgaccagcgataggtttgtgtaggcccattcatggtggatagtgacaccccctgggcaggtggttgtataagaaagcaggctgaacaagccatggggagcaagccagtgagaagtcttcctctgtattctcggcttcggttcctacgtccaggttcctgccttgcgctgctactttgtcttccctcaaaggactgtgactcagtgtatataagcaaaaaggaaacaaaacaaacaagaccgcaccttctttcctacgttgtttttggtcatgatgtttactgtagaaactcttaagacaaaaggtaaagaaatttatatttgaaattgagaaactgtctcaggagagaacattgtaaaagatttccaatcctgggactcccattaaaattctaagacaggagaacttagagaaagaagcctacccatgaccacctatagtcctttggttagtctgctcaaaagagaacaagtctataggaggaacagttatgatccacttaccatgactacagcctagaggaactgttagaaggactagaatatgaaatgggagggctgagattgttctggaaagacagtgagagagaaaggaggaaaggttggtagacaggataaatagtagtgcatttgaaaatacagcctctaaagaaaatctcggggaaggtggattgtttggcctgcaatgatagaaattgataggtaacctaatatctttgagcatatgaagttttatgtacatggtgctaactagtcttctctagctactcaaaaaatagaataaaatttcaaacggccacagttaaatataccaaagaacttcctaaccgtgagcagtgaggggtgatcaactctggaacatgtaaccaagagagtttgcaaaatttctgttctcagtgatctttaaaaatagagtttagagaggtcagctgagaaagcagagcctgccgcctctgtcaggtgtctctctctgcctgtgattccttcttttctgttgtttcttgatatcttcagtctctcaccctatctctccacctccatttccaaaactccttcccactcctcttttcagccagtgctgcccctatccatccccatgtcctgcacatctgactcctgacaaatcttcctggagctgatggtgttcctgagatcagacttccactatcctttggttaatagtagcaagtctgtgcaattgaacagctaaatgaagtcctgccaatgatgccaatgatagtattaccaatgataatcaaattctaaaaagaatcatgaagtgacccctaagtctgagtttctaatagtcctttggactcagatcagaacctcctttttgaagtcttgcctgacctgtttcagcatttggtctgcctcattaatgtggcactcttaatatcttagaacattttccctactatgctgggctccttgagaactgtttatttctgtgtcctctaatctatttggaaatatggtgcagaaaagggattataagcatgtccagctcttcagcaaaaactagatggctgacttggtgtcattgaagtctctagaactccctgaaattatactcctgactatacagtcttgacagtaactaactccaaatataacactgaatcctgtgttttaggaaagaaggcagggccacctgggcccaacggccccccaggacctccaggacctccgggaccccagggacctccagggattccaggaattcctgggattccaggaacaactgttatgggaccacctggcccacctggccctcctggtcctcaaggaccccctggcctccaaggaccttctggtgagttcttctgtctcccaccccttagaaaacttttcattgcttttgtagagtagaaacagataatcttcagagaattttcaaacagtggcaatgtgcagtaagaaatccctagtctagtgtagaggtggaaagtgaacaagctctgatagtgtctggcctgctctaagtcttgttgagttcaagctgcgccagacaggccatctgttcttgccccatgccaatccttccatcccattccatctttggctctagtccttcatatagtgagccaataagctcatatgagccaaaaacagaggtatgagaaagaggtcccagccattcactggagttcctgtagatatagatttggcttactctgatttccagcatagagtaccacatgacatttgcatggaaatagtttgtgggaggaatgttggggactggacaaaatgacaaccctattataatgtctttccatgtactttgagactccttgcctagtggtgtagaaatagccccttctagtcgagtggttagaaatgtatgaatcactcaagctgtgtctaacaaaaccagacaccaagaccaccctgtccctaagccaaatgtgtctcacactagacccttaaataaccatgctgctcgtttaaatgccattccatccctttgcctttttctcctagcgcccagtggggcatgcaacaggtatagctgcagatccaatcctacctaattagagttgacaggaggaagacggcctgaactcatgctacttgttacatttttctcctgctcccctcctctatcttgaggttttcttaaacttaatttccccaggtctaagaattcagcagcaggattcagattctttcacttgtaattcaaacaggctcagcagtgttaccatggccacaagagataaaagtttttttttaaacccaatcattccacaaatattaattgaacaatttctgtgtacaaagagatacattgctaagtggtccctgttctcatagagtttatttcctagagtcaaagagacacacttaaagaaacaagatctttataaatgacagtggctcttgtgaaatcagtaagaagagaacaaagagctagaaaagcaagtgccattgttttaaggacatacaatgacacacatagcctctctttcctctctgtgggtgctcaatggggcttgccttgagccaatattggccagaggccaacttccctgctgggatctagaccctctgaagaagatggtcggtagggacaggaatgggaaggaggggatactctctcccatcaacagccccatgttgtactatgactccctccagctgtaaggcctggagaaggaaattcctacagggctggctgtggaatccaggctctggagccctggctgctgaaatgggaaagggaagtagaaaagagcacagcactctgactgccccatcctattttgcaggtgctgctgataaaactggaactcgggaaaatcaggttggctggggattactgtcttcctggggaggagggatggcctcaggcttggggtcaccttgaagtcctttgcctatgagattcccagaggctttatttgatgtcgtactggagggtctgaggttttcacgggcagccgttgccgatacctatgaattggaaaggttcgccctaaggatgtgcttttagctaaaggaacacaagtcttgcctggaccattttactcatttcgtgagtgacagagggtcatggcagccagatccaatagtccatagaaataacctgcctgtcaggcatatgtgtgtgtgtgtgtgtgtgtgtgtgtgtgtgtgtgtgtgtgtgtgtgtgcatgtgtatatatacctaggcctctgacttccaagccacctcagatgcctgaagctgcctagaatctgaagctgagagtttgtgtgtccatgaaaagcagccaactagctgtaggctgaggccagcctgggcttcccccttaatggccttataggttccttcctagtccttgagttttccaatctgtgtcttttggcaggttctactgcctagcctccttaccttgctcctcccagcaactagcctcactacagttatttggtcacaatgataaatctacagagttgcacaggccttacgtttttgtaggcaattttatattcactgccttattagatctcacactgtgagagtgaccagcagagagtcctatagttcccgctttacagttgggggaggtaaagctcagcagcctcccacttggctgaggtcggagtgaagacgtagagctcttactatgttttaggagaaatagagctagggatagctcaagacagagggagggggccagaaatgggctacaaagtctagaagccagaggtaaaaacacaggactgcatgacacggcaagcagtcattatagtgactctcttcttctcatcttctcagccagctgtggtgcatctgcagggccaagggtcagcaattcaagtcaaaaatggtaagaatcaaagtagaatgtctccctcctaggagtttctcccttccctcattcccagcctccaaataatcagccagcctaactcctccctagtccctgaatatccttggcatagaagggcatttcctactccgtcgtgccctctactggttgtccgaagtaactgcttgcaccaagaccagatgctacacccaaattgcgtttaattttgctttttgcagtataagagggcaaacccggggcctcgtgaatgctaaccaaacatactacctttgaactacatcctcagcccctaaattacattttgaatccactaatgcgggatctgaaaaggacttgggaaaccatctacctagactgctttgatgtttatatcagccaccatggaaatatgtgtaatttgataagcactttcacagtggaaactaaggaagttagaactatattaaataaattatcttgtctgattgctctatacagaaaatggctggagagagtgcttctcccagagaggggacatgttagtgtctaggaagtaagagacactaatgtctatcaaaagcaaaagcatgttaacggggcttagaaatgctgattttatgttataccctcatttatgagatggggggacagagttccaaagagactagaaataccaaagaaaaccatactgtagccttgtgtttgcgtggtgctttagaattcccaaatggtttctctttttatttaaccttcacaaccactctatgaggtaggtgttgcaatgctcctttgttttgttttgttttgttttttttaacagcaacagaaactaaagctcagagaacttaatttaagtagcccaagattttgtagtgaagttaggagctgagattcaaaaccatatcttcctagctctcagcgctgtgctatgctgctccagtgatgtgtgtgtacactccactgaatgatttggttcattttcttcccccaaagagacatgaacattcattaaagaacagcgcttttaaataatgtccagtctccagggtgcccaaagcctaaaatgcatgaacccccaggagtcttggaaagcagcaagccagctaacatagcagctacttacagagcttggagtggaagggaggggctgtgagcagacactgtaaaggaaggttacaaaacctctacttggggacagcttctaagagcacagtcagtcctgaagtgcctgtgctgagttcctctcaccattgggcttagctactcccttgactgtcacttgaatacccagcctaatagcctcgcaagtacaagtcggagtagaggaagaggaaaacactagcagccctgtgggaggccaagcactgtaggacccagggtcttaggtgggcgatcgtcaccatccttcctggaggaatgtggtcagacagaaaatagatttgtttgggtatctaagtggtggccttagaggtcattctatagcagaagctgttcaaattgcccccactaccataaaagagcaagataatttccagtccctgcaggcaaattcccagtagtagtatctgctgacaggcagacaagaggagcaaggccacagtgagaggacactaggcagagcagtccactgaagtactggagccaggacttagatggctttcttttctccatgcatcagagaggcagaccttctgagactgaccaagaatggatgcttacaacataatgtttttgtgtgaagaacaaatggctgagagaaaatgcctctgtgaacttagtttgcctcttcttattgtaggaaggagcaactttctatctgcaggatgagaggagaaatatacctccatcctctcatgcttctgtccccagcgtccccagctgaattaaggatataaaacaaaggctttgccaaggctgcctcaactcctaggcaattcagtctcctgaaacctggcaggctctcccccagcattgtaaagctcaccctctctggggcctggttaccggaggtcactatccccagctgccatggggtctgagtgccaggggagcctgatactgaattatcaccaactagttctctagacagatggattgtttgattaagtggtttcctggggccctcggaggcttcccagaaaggagtgggtgtggaggagccataaagaagaatctattaagaagagacaaaagcacaggaacctctgagacaagagaggaattcgggtgatattgctagcaaagtgaaattgaatacaaagacttagcctgccactcagtgtctggactttgtctgtgcagtcaccataacaacaaagaaaatatggttctgtgcctactctcctctttcaccatcgccacctcagattccaactagaaggtaaagagctttattgatggaacggtcaagaatgcaaggacaaagactgatacgtaggtccataggtccccaggccagcctagaagccactttacaaacagtacacctttcctgcttccaaatgttcttttaaaatcttggcccttgaaacttttgtggtcattggtattagatagggttgatggggaggggggtggttactgttggtatttatttctgttgcccgaattattttgacatgtactgagtgactgcccttctctcatactgagatctttcaggtggagtgctcaatgactggtctcgcatcactatgaaccctaaggtgtttaaactacatccccgcagcggggagctggaggtactggtggacggcacctacttcatctatagtcaggtagaagtgagtacggtcttaggcctaactcttcttatatccagggtgcagatatggtgcaggccacctaggggcactgtggagcaagccaaaaccatccaatggctaacttctcgcagtgctggggaaaggcgtggccgatttcacactgggagggagttgaagggagggaagaccaataaacccatttcatttttcccctagaaaactatcactgaaaaactgtaaagaggcctctccaacaccctgctgtctgatcccctcttgcaggacccaaggccctcatttcccctctgagttgtttggttccacagacgaacctgaccttgctctaagtttttaagactaagttccagagctgcagagacccctccccacaatactgctagcttgggcatgataatgaacagtgctcctgtgaaccttctctctacctcaagaagatttctgactgtctttccttcctctttctcccatttgtttctgtctgtttctgttgttgtcacctccttcttactgtcattctcccagaccttgctcccctccacttttgtccttctcctgtcctgggcccattccccacaggtctgccagtggccattcatttccatccctcattgcgtgcctccatcggggctctcctcagagctacaagtacataggccttgaggtcagggttaccaggaggtaggcagcaaaaggagatgaacagaaggactatgcaactgtcaaacagctctcaagaaaaaaaaaatgaatagagaagttgggttaaccagcactaatctggcacacagagtatccgttcattgcttggtcctgacccaggagatgatgtgccatttaaatatgttacttccaatcaaagagcctgtggagtcacttttatgaagtgatttaaggtatcaaatgaaggacagtccccattcctatggggcactgtgggcataaccccaatatcctgtagactaaattccatttagtagtggtgaaaaattggagctgagggtgggatgtgctggcgaaaggtaatgaaggatgaagattaaatgtctggactcaggagaggattaggagtgaagtccatgtgagctaagaaagtctctatgaggccaggccataggctatacttcctcctggccacagaatgaagttaggtgcctaggatttgcatccagtgtctcactatataggccagctccccatctctcaggatctgcttcttcagtcagcaagagaaagggccgagctgtgctgagtctgggagaggactgcaggacagaagagtacactgtgagcttaggaagctcctgttcacagcctagagaagtgagaagtcaggacttcgacctccctggggcaccggggatctctaagtgtattcctaaattgtctttagtgtgggaactggaagttggtgtgtcccgagcattgattaagcacccaaggagtgtgaagcactgcttcgcgccagggttatggagtggagccagtgaaatggctcataaggcagctctcggcctcagggagtccgtaagaaaggtttgctcagccctctgaacccatggagtaggggaagggcagtgtgatcctgtcaccctgctgttccctgccgaccaacaggcacagtttcgggtggcactgcccctgcacagggtatactggcagctcatctgaggaggttctatctgctcaccaggggagggccctaccctcttttttcctctctcccccaatcccttcttgttgcctctcacccaggtctactacatcaacttcactgactttgccagctacgaggtggtggtggatgagaagcccttcctgcagtgcacccgcagcattgagacagggaagaccaactacaacacttgctatactgcaggcgtgtgcctcctcaaggccaggcagaaaatcgccgtgaagatggtgcacgctgacatctctatcaatatgagcaagcacaccaccttcttcggggccatcaggctgggcgaagcccctgcatcctagattctcccattccatcctggcccatgcccctgccccaggtttgggagccaggactcccagaacctctaagtgctgctgtgtgtggaatgaggtatactggcgttgcagccacaaagagaaatgccccatgctatttattccccagtgactccaggatgacaaggcctatgtgacttcccagaaagaccttgagttgccaggacagttgacggagccccagggttgtcaagaagcagaaccttcttaggctccctgctgactggcttatggtgactcctcaacccttaggtccctcatcagatgtatcatttgttgcactaaaatgaggatccaagacagtaggccacaaaaagaaaaggtgcactccagattctaggggtgatggggggcttcttctctcctggctgggggtgccattaggttgcaacttaaggagagggtcaggtcagaagaaggcaagtccttgtggcaaagacctgggcaataacctaccaagtcaatatccttgacagaagaggcattcttgctgcattgcactataacctactagaggctcaaagaaaacttcccactcaggctgagaggtatactgtggcagcttgctggactccagagctgggaactttgctttggcttggaatcatgcaggaatgaccacatgcatgcctatgtaagaagctatatttggggtcatgcatgtctcattgtgtttacagctatgttccactctcagaaaactacctggagtcttcccacctgtcaccacccaccccagtctgactagaaattctatcttctttctcctcggtgcctacctctgctttagacaggtgcttcacagtgtactctttaaattacttgggcacaaagaattttccatttattaggcatacaattcttctaattctaatcaaactgtgtctgggaacagatggttaaactggataacctccaaaagccccttagagtttgaagatcggtggcactcagcagttacctgccacagtaaattttggaattcccaaaccctacactcccttgggcatcagcacagtatagcttttctacctttcccagggagggggagaaagtggggatagaacaggaaatgttgtccacttttgttgagacccaagctcttatctgaaagagcagcaggccatggcccactagcccagtctttctgcggtgctttcctagagcatctgtctgctattgagcagggctctcacacctacttcagatccaaaggcacctccaccagttttcctgcattgtcttatgctaggttcatgagacttctttccaattgcctagcttcagggtaccaggcacagcctaaagctggaaggatcaacctggtccagccggttcctcttgctcctgaaatgtatttctttttgaggagatgggaaatgcatccctgaaatgcatcaagaatatcaggtactgagttctcagctgtacctccatttcccagtagccacattgcttggtccttcacgggtcaggacaagaggtggtaggccaggactcttttatacagtgctaatgacagccttacaaccagaaatgaggtcgattttagacatgcatctgcccttggaggccttgaacaatcagcagtggtagcaagaactaacagaccctctccttagtgtttgaaggttgcttcctcttaatttcctttgaagaagacggggcagagaattatcacagttaccattgtataggtacggctgggagagaaagcactttcattaagaactcacccataagtcacagaccttagcttttagtgaggtctgactcccgagctagtgtcttaccacacacttaccacacactgtgtggaatttgggttccgaaagaaaaattaaaagtgatcacatggaactgatatcatggcagagtcctagggagaaacctagcaatgctatggtactgcctagtctcttggctgccacaggctctgtggaagaagtcttggatgttttctaatcctgagttgagctctgggacccacagaacttggagccttcatgacctttcacccatctgataaaagcagcaaccatcacacaacgagctgctatgtggggcaaggtcttctgtcttccattcctgaccctagctactagttctgggagccagtctgcttcctggggttaggtgtgactcctcctctcctcctgccatattacaaaggccttaatgttgccagaacatcttcctctgttgatgttgagaggttgccctcccgagaatggagggaaaacctaagagcaccattccaaagccacatggctatggagaaatagaggaagtttcctaactgtgcccctgcaggacatgccaaccccatcatatgctctgtgcttggagatcataggggaagtgggcttctcactaccctgtcttcatcctgaatcctcacaaggagccccagatgcagaaggctgggggaggaaataagaaagaatggggggcctgctgtgctgtactcattggcaaagtaatgaagcatttactgataggaaaatagggatatagatttacagtttggaattgtcatgatgtgaagttatcccaaggttagcatagagaatgggatggggacatgtttgtgtaagcagatgacatgttagaagaaaaattgcaccgcaggagcctctaccagctgcttgagcttcaaaagccaagctggcacaaaattgtacctgctagatgttatgtggctactggttccctggaagatgtatcattttgccttagttgcccctggacccatcctgagcctaatctctgcagcttagtaagaaaaggctaaggaccctagagatgagggctttggtcctcatgtgagtgattgcattttatgcgtcttctagtggatgcaaacagatgtagagaaatctttgacctagaaaggcttttagagggaatgcagcccaacctacatcccatcctgttactcatatgcaattgatgtccagacagggaaactggcccacctaggacagtgtgcaggcaggcccccacctccagactcagcaggagaaggaggcaaagcaacctgtcccatggggcctcctctttcatacacccacagaatcaaagctagaagtgtttatctcccttcaggagcctggtgaggcagggagtgggtctacaatctccatcacaacttgcctccccacacatagtcccccaagatatttgtgcacctcctgcctctgggctggaagctttaggctggctctgagccagacagattttaggcttctcttgtgttgcctgaggtcccacccttgcctgggctttccctgggccatgcctactacagaacctgatttgttttcttaattcatttcagggctctctccaggagagcgtgaggtgtgtcatttctttcttcaaaaagcttccagctgatgaggataaggggagaatggcctggagcaggcccaatgctgctttggggaatcagcatcctgtgtgagatactgtgtatagaaactatatatataatgtatataaacagggatgtaagtttgtgtaaattaatggtttattctttgcaaataaagtgctcccctcaccatc

SEQ ID NO: 574 - DNA, 425198 bp, mus musculus
ctctcgcccgcccctcctcctccctttcccacccctcggagtggagctgcacatgcggctgctccctgttctgtcccgcccagccaccgtcgctcaggaacgggtccctgcagcccccagccgatggcaggacagtagtcgcctgtcaggggtcgtgaaggactgaggcagaggcagaggctcccgggcctcagatagtggttgtctctggaggccatgggctacccagaggtagagcgcagggaacccctgcctgcggcagcgccaagggagcggggcagccagggctgcggctgtcgcggggcccctgctcgggcgggcgaagggaacagctgccggctcttcctgggtttctttggcctctcgctggccctccacctgctgacgctgtgctgctacctagagttgcggtccgaattgcggcgggaacggggaaccgagtcccgcctcggtggcccgggtgctcctggcacctctggcaccctaagcagccctgggagcctcgacccggtgggtcccatcacccgccacctggggcagccgtcctttcaacagcagcctttggaaccgggagaagatccactcccccctgactcccaggaccggcaccaggtgagtcacctaggaggggcggcggccttggaggccccctcccctgctcggttgggcgggggcctgggcctcagggctcaggggactctgccactcagagccaagttccagggcaggagctgggagtgggccggagtgctggggagaggttgtccaggtcaggttgttctcggttcctgccttggctcatccagaccctctccggtcccgtggagttggaaagcccagcctgcacgcgccgcccccggggaggtgtgggctgcttagcgaaaagttggcctgccttgcacccatccgggcgcggaggtgcctgcgccgcccccgtggccgtctaacggcgagcagcttggcccctcgtgccccctggtgagtttctctgcccgtggtgcttgtttcttcgtgtcccgagctgatgccagcactagcaggctcctctttggagttggagctgtaaacagctgtactaactgttccacgcccgttgaaacaacttttaaccatactttcagcgctggattcttgtgcgctgaccaggacctgagcttttttcacacttacctgcaacttgagacggattctcttctgcgttctagttaggatcagcgcccctgaggaattctggtagaaatatgccgtcttgctagacaacttctgaacagcaatttaaaaaatctatggaaataaaactcaccctttgcatgccggttctgacactcttgtagatggagttgggtgcagtgggtgtgaagagttttcattattgctgcctttggaacaggaagttggatttttgttttgttttgataatctttagagggtttgtatctcttttagcaaaccattatcgtagttgtttttcttactcgttattccagcaaatttagtgtacttgatattaagtcttcctgtggtttccatagctgtctcacacttgaatcttaggcagaacatccaagaatctttttgaggtggttaaagattaatggtgaatttgtaacttctggagaaaacgacactttgtgtaagtaagctacttgaggtgagacatggaagccttctgtacttggtgctatacccatagttattgtcacaactctttaaacattatttgtgttgctttgactttccaagttgtacactttagaggtgtcacattcataataatactctagtgtcagaacacacactttctcttcttttcctttctctctctgtgtctctcttccttcctttctttcttaacaatgtgctttgtaaaattgcttcagacctaaaatgtctttcaaagacactcaaatttatataactgcgtatcaaagaagagaatcagtagacgggcttctcatacttgaaattttaaacaccggggctaaatgacaatgaattaggactctgggtcttttatttactacccccctccaggatcctagtagaggtacttagcagctgcaccttgatattctctctctctctctctctctctctctctctctctctctgtatgtacacacacacacacacacacacacacacacacacactcactcaaaagaaatcaggaaattactcaaatggtggtcaaggatttttggcaatcaggatggacagagcgctggttagagattgtgggacagcagtatactagagcttctgtgatggcatgggactctcacagctttgcaatggcctttagttgcttacatcagatgtagcaaaaatacttatgtgtttcagcacagcttcttatctgctatcctttagtctattttagtctatggggcagtcaaagcaatgataccagttctttacattcattagcattaattggaatttatgttttccagatttgtaaggtacctcctgaatctattttattgattcctttggagaacatacaggcctcaagggagaagtaagtggcccaagatatcctagcttgagtcaaaactaggatgaaggtgctctgccatcctccagtttagtacacagtcctccataatatagtgtctactgagaaactttgtttttgaggggggcgatgaagggacaacaggttgaaactccatagtaggctttttacaaaatgagaggctcagatctgtgtcactttgttctgctctaactaattttgaccagactaagtttaatcacatattccttattcatcttgaatttcactttcaggagaattttagcccactgaagacattttatcccagattcaactaatttgttttggtgatattagccttagcatatacacaaacaaacaaacaaatatataaatgaatgagtaaataaataaaggaaaagttgattggctaattgatttacattgctgtgctatatcttgggtaacatttctagtgccctgctgcaccctctgctggtttttcggtgacatttaatcgtaggtagtatctgctgacagtcaaaattctaagttgtgctgacagattctgattcataaataaggaagtgaataaccttgtgggacttggccatgtaggtcttattttatattttagtttttcaacataagcagatgttgttacagcaaaccttgtatgcagaggactagaaacaaagccagcatcttccagtgggtactatacttgggtttcctaccaacatatttagaaagagtaaagggaaactgatgcaactaaactgtggtgagcccaacaatcagtggcttttcattatgagtggtcagacatgtatttaggcaaggaaaaaggtattcatacttatgagatggttggactgtgggctcttaatcatgactcaaggaaagactccagaagtcattgaaggtttgtctgtaccatactggaattaaacaaacaaacaaacaaacaaacaaacaaagcaggatatggaaagaattcaggacacaaagtaggaatataagcaattctctgcaagggagattttggaaaggtagggacatggtttcataaaaactgagaggttgacattagcgtttctggaatcaggggctgtctccctcagctgaaggagtagctgcatatggatacttagtgaagataagtttgatggctagagatgcaccagtagtgtctgattttgacaacaaataattcaaaacattgaaaatcactggataacactgtagagaagaaggtctggtcatgattatgtctctcaaatgtcaaaaacatggcggaaaaatctcagcaacgtgtcaacaacaaaacaaaccttttttttccatgaagaagatcagatgtgattttttccctacaatcagaaagaaaattctgatgactgttactaaaaaaaaaaaaaaaatcttatagccaattgataagtctccagaaacccaattgaattgatcaaaagtggggattttctagttgtcatttttccaatctggagaactagagagaagtgggggagggagggggggaggatcaaagatcagagtcttccaaatcaggagagagatgagtaacattgttggtataatttaataatctaagctcaataaataaaaatttctctgtggcagatacagtgttaagtatcagatgctggagagatggctcagaggttaagatcactggttgctcttccagaggacctgggttcaattcccagcacccacatggcagctcagaacttcctacaactccagttccaggggatctaacaacatcacacagacaagtattagatgtcttttaatgttggtaaaagttctgttgagagagatagaggtggtatctcatcaactaaactacaagcagatcaataggaatttattcaggactgtttgagatatttgagatattttcttaattatttgaggtgatatcatagaagacagctttaatgatcaacataaatctttgggtataactagctctgttattagaataccaagttttgatactcctaataactaagaatcattctgggtgattcatggcgaacataagcgatcccacaaattgtgtatatggaatctagataaaaataggctttcatgagtttaaatgcagactttacagtgtcttatttaagtcttctgaagaatggctatcataatatcactctcatttttattcccactaattttactcctggaagtcgccaaccatattctctttgggaattattctgtcgttgttactgaggttcatcttaataatctcctttctttaccttaaagctcctcagaaatctactttcttcatgattcccaacatatcactagttatagctaggtagaaatatagttgttgaattaaattattttgggacttaggtaacgtttatataaaacaaagccattttatagaacaggtctgcttctctctggtcctgctaagtctgtgaactgtcagttatgcttaggtaagtaaatagttggtatgtttcgctggttttgaaaataattgggaagtgaggtggaaatgaggaagcctaactgtgtgatctatctccgagtttcatgcctttcctctaagatggtactaaattgtttttgtaatatattgtttgaagtttcatatgctgttaggtctcatccttctctcttagatcttgtgaagaaaaaacaaaaacaaaaaaaagaactgcaatctatccgtaactatgttatagagaagatctctttataccagagaatttctgaagcaaatttaattcctaagagcggtaccaaaccttgtgcctctgactgcagctgttgtagcgaaccatctttgtctgattcctctgtaaatacccagtgcttagtctctcatttccattctttttctttacattttattgacataaaacacacatacagaaacacatgcacttcatgattgtgccatttggtgaaatattacaaagtaaggacacttatgttgcttgcacctaggtgaaaaaataaaatattttaccattctgcaaatccttaattgtgtccatctttatcgctaaatgatcctcactctccaaagataataactgtcttcacttctattatcagaaataattttgttcatttgaactgtacataaatggaatcagatagatgtatttttttgagtcttgtggttttttgttagcactatatttgtgataaccatactgttgcaaggagaattttaaaaatttatatctttgtgtgttctgttgttgaaatacatcataatttataaattccttatcatgataataactatgtatgatatttccagttcgaagttattatgaataatgtttcagatatttttatacaagtccacttattagaatttccattgactatttatctaggattagtttctgtgtaatggagaatacatattttgaagttattgatgattttctaagttatcgacaatttgtttctcaccagcaatgaatgagaagtactgtcattctggtgagtgggtttgtagtgaaattttctgtttgtatgtgatattgggaatcaaacccaagccttcaggttctctaggcaagtagtctacccgtgacttacatccttaattttatctcaaaggattttaaaggattcttcactgaagactgatgaggttgtactccttatcatgtgctattatcaatttaggcatcttcatgaagtacttatccatctatttatatctgtatctatatctaaatctaatctatgcctgtatgtagatgtttatataatatatatttgcctattttcctgtccacttacactgtttttacaaatttcttatataattaaaaatccgttatttttatttttaattatgtgtatgtgtgcttgtgtctatgtgggagtatgtgagtgcagagaatagaattcccaggagctggagttgtgagccccctgacatgggtgcttccaagtcctcttccgaagcaacaagctctctcaactattgagccatttctctagccctaaaagtctttatatacattggaaattacttcttatgctttgaaaaacagtttcaaatttgtggcctacttttataatatcttttgatgaacagaaggctttaattttaatgtgtcaactttttctttcatggatagtgtttttgtaatccgtttaagaagtatttttccagggctgaagagatgtctcagtgagtttggttccatgcacccactattagacagcccataaccacctaacttcctctctgatgaagctctcttttacacacacacaaacacacacacacacacacacacacacacacacacacacacacaccccacaaacacaaaacaagcctttttttaaaaaaagtattttctcactttgaaatcattagacatgctcttccattatcatttcgaagttttgtatttgtgccatttgcagttagaattgctagccacctgggattgattttgtgtatggtagagatatagaggtcaggccctatatttttccatgtaagtatccaactgatcttgtcctatttattatatggatttttttatacttttctacattcttactttttcatccatccattgtttatatacactcaaaattgttcctgagttgtttattctattctgttgatctgtttctcatcagtctattttctgttgctagaacaaaataattgaggcttggtacttgaaagtgaaagagattacttaggtcattttggagattcaaaaacatccattcagcttgagtgagagtacccttggctagatagcaaaatggtggagaaagacaaagagactacatgcagaaaagggaaaatttgtatgggttggcctcatttcagagcaacttacccctttgagaactaatgtactctgtaagaaaaggatgtgtaccttctgaaggcagtaccctcagtgatgaaattaccttgcatttagccttacctcttaaaagttctaccatatcaacagtgccacacagggttaagcatccctcacatgaatccttggtatacaaaaccacagtagggccatagcataccagtactaacagtgttagttactgaaccctgtaataagctcttgatatctgggaaagcaagtccttccaacttggccttttaaaaccaccttggatactcttagcattaacattttcacatgtattttaggattggctttttatgtacctcaagaaaagggaaacctcttagaattcttattgtgattacattgaatttaaaaattgtattagttaagatttcttttctattgctgagataaaacattatgaccaagagtttaactgagcttccagttccagagggtgtttatgacaaaaggatgaaagcctgaaggggtggctgtagacagagctagaacagcaccaagagctcacatttggatgttacagaacacaataggaatggggaagtcttttgaaacctcaagccctccctacagtgacacaccacctccaagaagtccatagctccaagtccttccccaagagttccagcaactggtgaacagacatgagcccatgggggaacatgctcattcaaataaaaaaaatcaacttaggaaaaaaaatcacagcatccaattcaggaacatcatatattcttccatgtctttaattcttgctcattttcctactgatattttttaatgtttatatagagtttttccaaggtgttttttatgccattgtatatgatagctatgatggaggttgtgtttcaccatgtagattccactttagaaaggcaggatttatgccctccccccacccccccaccccccccccccccgagtaccaagagtaccatcaaaagacagagttcacctgagaattgtcttctgaggcaaacttttcaccaaggaaagacctccttccttgactgcctgcatctaatgactaatcactgtagagctataaatcacttcccctttcttctaaattaggaaaacattgaagagtcatatataagccatactagttcaagagctcaatataaatttagttagggcaatttggggattgactttttccttgtcttgcacatatgtggatccccaaagcactatctataaaaagtcctgcatgttaatataagcctttcagttgacttggtaggaattccaatgtaagtctatataattaaaaaaaattttgtgattataacattattacatcatttccccttcaaaccatccatccaaattctctcatgtagcttcccttgttcattttcttcttttttttgtttaatgttttttttctttttttttaattaggtattttcctcgtttacattttcaatgctatcccaaaagtcccccatacccacccccccaatcccctacccacccactccccctttttggccctggggttcccctgtactggggcatataaagtttgcaagtccaatgggcctctctttgcagtgatggccgactaggccatcttttgatacatatgcagctagagacaagagctctggggtactggttagttcatattgttgttccacctatagagttccctttagctccttgggtaatttctctagctcctccattgggggccctgtgatccatccaatagctgactgtgagcatccacttatgtgtttgctaggccccagcatagtctcacaagagacagctatatctggatcctttcagcaaaatcttgctagtgtatgcaatggtgtcagcgtttgaaagctgattatgggatggatccctgcatatggcaatcactagatggtccatcctttcgtcacagctccaaattttgtctctgtaactccttccatgggtgttttgttcccatttctaagaaggggaaagtgtccacactttggtcttcgttcttcttgaatttcatgcgtttggcaaattgtatcttataccttgggtatcctacgtttctgggctaatatccacttatcagtgagtacatattgtgtgagttcctttgtgattgtgttacctcactcaggatgatgccctccaggtccatccatttggctaggaatttcataaattcattttttaatagctgagtagtactccattgtgtaaatgtaccacattttctgtatccattcctctgttgaggggcatctgggttctttccagcttctggctattaccaataaggctactatgaacatagtggagcatgtgtccttcttaccggttgggacatcttctggatatatgcccaggagaggtattgctggatcctctggtagtactatgtccaattttctgaggaaccgccagactgatttccagagtggttgtacaagcttgcaatcccaccaacaatggaggagtgttcctctttctccacatcctcgccagcatctgctgtcacctgaatttttgatgttagccattctgactggagtgaggtggaatctcagggttgttttgatttgcatttccctgatgattaaggatgttgaacattttttcaggtgcttctcagccattcggtattcctcaggtgagaattctttgttcagctctgagccccatttttaatggggttatttgattttctggagtccaccttcttgagttctttatatatattggatattagtcccctatccgatttgggatagataaagatcctttcccaatctgttggtggcctttttgtcttattgacggtgtcttttgctttgcagaagctttgcaattttatgaggtcccatttatcgattcttgatcttacagcaaaagccattactgttctattcaggaatttttcccctgtacctatatcttcgaggcttttccctactttctcctctataagtttcagtgtctctggttttatgtggagttccttaatccacttagatttgaccttagtatgacctctatttaaaaattgctttaagtttaactttaattgctttttgctaggaggagctagagaaattacccaaggagctaaagggaactgcaaccctataggtggaacaacaatatgaactaaccagtacccgggagctcttgtctttagctgcatatgtatcaaaagatggcctagttggccatcactgcaaagagaggcccattggacttgcaaactttatatgccccagtacaggggaaccccagggccaaaaagggggagtgggtgggtaggggattgggggggtgggtatgggggacctttggaatagcattgaaaatgtaaacgaggaaaatacctaataaaaaaaataaaacaaacaaacaaaaaaacaaatgtagtttaattttgcatatgaagtttgtatccaaagatttgataaactcacttatttatcctaataatttatttgcatgttcttttggatttttcacatgtctactaaagtgttcatggaaaatgttttaaaaatgttatttttttcctttttaatctagatagcttaaaagttttcctctgacctaagagcatgcaccacagcctggacctaggtcttctcacacatatgtagcagatgtacagcttggtcttcatgtgggtccagaacaactggagtgggggctatcccaaaagctgttaccaaaaagctgttatcccaaaagttgagctgccttgtctggcctcggtgggagaggatgcacctagccttatggagacttgaagtgtcagggtgggaggataccctggagggccccacccactcagaggagaaggggaggggggaatggagggaagaattgtgggagggagtgactaggagggggcagtgagcataaggtaaactgaataagaaaaataattaaattaaattttaaaaagttttctttgtgttggtcaattattcctgggtatggggcctgccctggagtgtagttgatatacccaatgactgtccatgggagaaacctgactttccctctgcccccagctttcagttgcaaatagattcttggttggttgaggttgggatccagagttcaccttactctctcattatggggatcctgtctagcttgaacctgttcaggtcttgtgaatgctttcacattcttggagttcattcctgttactgtaccattcctgttttgtctgcaagagacattttttttcttggagtcatctatctatctatcctctctggctcttactatgtttccttttgtttatttgacttgattttctctttttgttgttttcttagttttacacatatggatacacagctcacgagagagagagagagagagagagagagagagagagagagagagagagagagagagagagagaacatgaagtttggggggaaaggtgtggagaatctgggagaagttgggagagggagaaagaatatgatcaaaatatattatataaaaaactttaaaagtaaaaaagtttcctttattataatgtctagaaatttccagataatattgagtggaagtaagtaataggcatcgttgttcactactgatcagagcaaaaattttatttttactgtttgtcataggttatattattattgttagtttaaaagatatcagttttaaacttttagttttcaaaggtttttaaataacatcaggaatgacatcattgtatcacggttttcttttatatgttaaactagtcacaagatttttccctccttattctgttaatgtggtctgaagctaaccgtacacccttaggataaaacctctttagttccagtgtaccattcagttcatatatgtctagaattattttactaacctttcatttaaaatccttgatctttatttatgagcaagatgagcatgtaattttctttcattatcaagtttggatatcaaggttattctatgttgttattataattgtgtttattttatttgttccttacaaccatttatataacattgataatatttttcccttagctgtttggaagaattcatgaagtcattttaccctaggggaggttaaattgtgtttgatatcctaataaacatagggctttcagacaatagctaacaaaataataaaatacttagaaatacatttaatcaagagaatcagagaccagaacattaaaatctataaaacaatgatgaaagaagttgaagactgcagaaataaatgagaataggttccatatatgtgtatcagaagaatcaaaattggtgaaatgtccatactatccaaagaaaactgccaattcaatgaaaaccccaatattccaataacacaagccaggtatgatgtctcataactataattctagctcgtgggaggctaatgcagaagggttgtcagttcaagggtagccttgatggtgagatcttatctcaaaaaacaaaacaaaacaaaataatcagtgacatgttatagaattagcaattgtgaaatttatagggaaccacaagatatctcaatcgatttctattatcaattgtatatcttatttttgtactacatgactgttttgccatatgcttgtttgctttttaatgaatggcataatgtataatgttattaattatgacatatattatataaaatatttgtgctatatgcgtaatataatataatatataatgataatgtgttatttatattgtatttaatattaaaataatattgtataatacatacacacacatatatggcttcagttgcttttatctttattaaaataggatttatgtttctggaaattggcctcagatactaacattcctatgtcatcttaatccaacacgatactgagatcattggaaactggctttctgtccaaatagaagttgatttatcatttatttaaaatattgttatagtttagaacctaaaagttggtaatttttcctgggttctttctagatgggtcataaattacagttttttctttttctccactgactcccaagttcggccttttaatagtatgacatattatgtaaatatcatatgaacttttgtatagttttcttggcaggaaatgtcgttcaaattgctaatttgtccgttactaaaaacataagcaactcatcatatttatagatatttatgcattatcacctttgtaacatgtaccaaggggtacaccaatgtggagatacaactgttgacccagttagagagagttcctgcagtcatggaattctgagtcaggtgaataggctagaacaagtcaacttgatgatgaagcagtagggttaatcttacagcttggagtatctggaacacatggtaatttggaacaaaaaagatgaacacctggctcaaacttttgaaatcaagggacattttcttgatgaagcaccttctgagtttaaaactgaaaaaaaaagtcattagctggataattttatttccagtaataggagctgattatgcaaagtcttggaggtgagagagaacatggcatattcaagggatggaaaatctaatatttataaagccatcgttatgagtccattatggtactggcataaggtagacattatggatcaatggaacagaattgagaacccttatattataaccaactgattttttacaagcataaaagacagttcaccaaagtacaagattccctattgaaattaaggtgctaggaaaatcaggtacccacattttttaaaggggtgaacttaaaaaaataggcttaatgaccttgatagacatttctcaaaaacaaaacaaaacaaatagatgcacaatatctatatgaaagtaactataggaatatcactactaaccatggactgcaaattaaaatcgccatcaaagctacctccccccattacgaatcactaatatcaacaacacagactaaagataagaaatgttggaagatgttgaggagaggggactcatttcacacaccaccaggggactatgtatacatatgccataatatcaaattatgggagtgtttcaaaaattttaaagagttcacatatgattcaggagtcctgcttctgagtatatgttatagtttgaatatgaaatgccccccatagacttatgtgtttgaatacttggtctccagctggtagagctgttttgggaagggttgtggaacctttaagatgtggagacttgctggaagaaaggagtcaccagacaggctttgaggttttacagtccagctctgtccctcacttactctctgcttctgtactgaggattcagtgtgtggagccagcctcctgctgccagcagctgctatgccttccccgccttgttgccttgtgttcccttgaactctaatccgaagtaaacttttccccttctaaacgtgcttcttgtcaggtattttgtcacaccataaagaaaaataccttgtactgcatgtatccaacagaaatgaaatatgtctttggaagaggcatctgggctctggaacattatttgcaggagctaacaaatggaaataacctatgtagtactcggctcaggtgatgatgaacaggtacaaaatgtgttacggccaggtaaggctgtatgagtggtcagagttctcagacacaggaggcagggggatctcaagttcaaggccagcctggagcatagagcaaaaccctacttgaaagcaaacacacaaaacagcccacaaaattaaatagaaaatgaaaaaaaaccccgaaaatcacaaaaatgaaatcctgttatttgtaatagaataaacacagctggaaattattattaaatgaaataaatcaggcagagaacggagatctcactcacatgtagaacaacaagttaattgtatacaaggtaagaataaaaaggtgttactagatggtggggaataggtaggtgagggttgaggaggagtgaggaaaaataattgatcaatgagtattagattacagatatatggaaaaggatgatctgctatgctgttgcagagtagaatgaccatagataaagtatgtttcaaaagctataaaaaaagattttgtgtaggggctcacagacactgaagtggcaattatggagcatgcatggatctgctctaggtcccctgcatatatggtatagttattagcttggtgttttggggggtcctaacagtggaaatggcccttgtctcctgggacctttcattttcctactgggttgacttgtccagctttaatatgacaggaggtgtctagtctttttgtaacttcttatgccatgcttggttcatatccctggaagacttgcttttttctgaagggaaagggacgatgagtggatctgtggaagagggcagataaggggtggggactgggaagagtggagtgaggggagactgcaattgggaagtattgttatgagggagaatcaataaagattttaaagtttttttttcactagaataatccttgcttgattagatagatgtgtttaacctgatttaatcactatgccttagatactctggtttagttttattctcatatatatcttgcctcttagatacagtctacagtgcattcatgtgttaaaacattatacagtgtgctaataatatgtatatgttttatgttttaatctatcaatttaaaaagtttaaaaagccatgagtcaaattaaataaaaaagtgaatgttggtatatgcaacacaccatacccctgaatttacttttaaataaccttagtttaaaatgctagaacaacacttttagaagaaaacagaaaaaaattatgaccttcatattgagcaaatatttcttagacatggaaccaaaaacatagtcaaacaacaacacacagaagtgaattgtatttggaaaaatgtttttctaaagaagcctttgaaaatatgaaaagaaacatgagagtaggggaaaatgtttccaaaataggcctcttgaaatgtgatgaataagaagacaaagtagagaaaagatgcatacatttttatcaaagacgatgcacaaatgtccaaaatacacaaaaatatgctcaacactgttaccatagaaatgcatcattttatacctattagaatggccataatgaaaaaggtaataaacaatggaggtatagagaatgggaacactaatatattgctggtgggcatgttaaatgatatagtagtcttgaaaaatggttttccactcctttaataagttaatatagaattacttattgcataatgacccaattctacttgtatgcttgtgcccaaaagaattgaaaacgtctgttcacacaaaaacctctacaggaatgctcaaagtaagtggtattcataattttcatttcaaaccaaatgtctgatgaataaagaaatgtggcaaaaattctaatagaatgtatttcagccataaagaggaatgaagtttgaatatgttacaacatggtaggatttcaaaaatatggtaagtgaaaagagccagtcacaaaggcccacatcatattgcataattctatttgtatgaaatatccagaataaacaaatatgtggagaaaaactgagattagtgagtatctgtggtgagtagtaggactgaagatccactaactatggacatgagggcacttattgtgggaaagaaaagatttcaaaactgatttttactatgactagggtaggagtagtggtgctttaaagaaaatgaagcaagagatatcatgaaattacacagttcaatacaattcctacaaaaataagtgaattctatggtgcgtgaattatatcttgatgcatttgttattctttaaaaaaatcataaagtaaatgtgtaagagatgttagttgtttcagagtgatatttatcttcatatgaagggaatcttcaagcctgttcattgcaaatgcttaaaactttttccataataggtgacttcaggattctaacccagaattaaactcaaccagaagcatcagggatgtcaggccattcatttttaattggaaggactgtactggccattttgttgtgcacttcagagtaagaatctttaatttgtgggactataaatgagttagtgtagatagatgctagcatgcacaaatagccatctgtggtttgaatatctccctctaagacccacgttgaaatttaattagcattgcaagagtattaagtagtgggacctttaagtggtgattagtcaatgaggccccatgaataaatgctattatagaaatgcatcagcagtcatgggagtagacccccaattaatatccatctgtgttatattctcaatcaatcatctatcttccagtatcatttcagccttcagaattgtgagaaacaaaacaaagttctttcttttctctgtttgtttgtttctttgaaacagggttgcgtgcagcccaggtcggcctcaaacttgtttggtagctgaggagaaagtgttgactactatccaagctatcgcttctattcttacatgctagggttataggcatgtaccaccatgcctggcttaatacatttatttactttatgaattacccaatttctggtattctgttacagcagcacaaaacagactgagataaggcctagctaattacttacactacagtgggcagtaattaattctggctcacaattgttatctcttgtttcctcttctgccctgtccattactcactccctttgcctctatgcctctatgacttttattcttactttttctgatagagataggggaaatattctcagattctgcttagactctttttttttagacttctaggtttaatatatatcattcagatgaatgtgaatgccattttaaccagtgtaaagtgttggagaactttttaaaaacctacctgtgtgtggccacagcttatcccacatcttcagactctttggagtgtatctatggcttcttcgataatactgatgctcatctccatttgggaatcactgctctaaagggagaaaataaaaacgagagtgtgagtgacataagcgttgatcgccttcctagcttcagttcctttattgttggctattacacttttgccacttttgttactagtcctacctttgatgatcactgatgcaagagtttgtgtggtagtgaatgcttaatgagcacaccatttagaaaattagctaatgattgtgtgtcttttgggaagagaggaattagacttcagttgtcatctccgcagccagatgctagggctatgtgcttgcaataactgagggaaagagtagttccctgtcctttgtggcttcctagggattttcctactggtagccgctgaaaccactttaaaataataggccgctgagtaattttccccatgtatatccacttgtcaatgggcctgcacttcagagatgaagagtaatttttattggagtgatagtgtataatatagtttgaaagcagacagccacaaagaaattgattttcaaaaggagattactgctcaattttattttgtggtttacagatctttagtctttcaacctgccacgccattgacctgcaaggacaatcaaagtttaaacagcagtgtgtgcctagaagcattggatggttctagagcacttttaaaaatatttatttataattattgttggggtggtgggctgccataatgccatgcatatgtgtagaccagaagagtatcccataaagtcagttcttttcctgttatcttgctcctggggatcaaactcgggtaatcaggtcttcttgcctagctctttagccagctgagccagctcgctggccctaaagtccttttaatgtataagctaagttattaaggtggtgaaacagagggctttttctggaaggaatgttacatctttattcagactcatggaaaggagagtggcagatttcaggtgggcgtttcctcaatttttcggtgagttactatcaaggataaaaggcaatgcttgtgacagttctagttctcaaaactgatttagctagcagagtcaaccaagaagtataaacttcctttgttcttaatgacatcagacaaccctgttaggtgccattagtttctgcatggatttccagctgccacctcaaatttagttagctaaattgaattcatcttcactcttcccttcccctaccacacacactacattttagaaaattaaactgtggtttcattctttcaataaccgaggcataaaatctcagatgcattttaacctctcctcttccctattctactcagacttagcattccagttgctaaatcaattcatcttttctggtgttgatttacattgtttgtgtcacatgcatctagttgctctgttagaattctgattgtatttggtttagctggtcttcaagttgcctcgtccacatctgtgatccttcctcagcttatttcctgtagtattaattatgaaccagggagttgttttgttctctattgcaacttttcatgtctccccccccccccaactaactacctttgctctctgctctgttgcctatacagaaaacttcagagtcttttttgtaaaccttcctgaactgttctgtcccactggtcattgctcgctatctctgtgagttcagtttcctccagagcaaccccactgtcacacctctctcattcttgcctttattcacctatttccaaaagctgaatgctcaacctcttcgtggagcctcaggctctgagagcttttctcaaatcttatctttctgataaattcatccatctcagcattctaaatccttcatttgccattgtattgaattgtagattatcttgtttccttaattaattgaaaagggttttgaaggcagagactgaaacttttctttataaattacagccggttacactgacttttagcagaaacctctagttacatataaattggttttctccctttgcattcataccttcattgttgcgtcatttctcttgttaaaatttttcttttgatgatagaatactcttatatttaaggtaaaatttaaacatgtaaagccttttctgatcatttagcccttagtaatatttttctttattttgtctcaaattaatttgcatttatgacatgcttgacactctatgtggctttttaagagtttgaagggtaaaattaatccctattattagggacaggctaaaattgggaagggatatttgggtcagaggaagcaacatgatcaaagacttagagacagtagattgtatgcttgggcaaaagcctagaacccatgaattatttatttggtctagaactatgtgccattttacatcagctctgtgatagtgttctattgtataatacaaaatcggggttaatttctcacttgttgactactcagcttctgttttcttttccattttcattgtgggaagaaagttggtgactggggaaatctgggttcctatatttcacaagagaagacaaaactgatgaagacctttggagcagggccacatgaaggtcaaacttgtatgttctctttgaggactagctagacatttactttgctaaattagctcctttaagccactgttgctaaagttcctttccagggggagacataaactacatttacccatcctcccaaggttccaacaagaaagtgaggcaagagtccatcatagtttactctggggaactaatgaatttgttgagcttcagcacagagcccaagtagggggttacttacagggatctagacatgctcccccctacttcccatgcctacaaagtgttaccaagcagggatgaaggctttccatagtcacatagatgattcacctttgccccctccagtcttctttagcctctatatactctagcccttccaccaggccatgtgaaggtgaagaactaccagagtgcttcagtaggatacttaggtgagactctcatgccctattccctccatcctttcccccacctgtgcgtgtgttcgcgtgtgtaaactggccgctagcccatctgggacgatcttttgcattttgcaaaatgatgaaacagccaaagatgggtgtttggcttaaaggacagggcaatcactcaagactccttgttccagtaatcagcaactctccggaccctttatttccaggtccttgtgccttaacaaaacccaggcctaaagtcagctgttctatttgactttctcagttctacaggattggagagaattctagattagtgggactgcaaattcagtgtctagttctttctccctttgtacccccaggtcttcttgtcccctccttatctccctgccccctctccctggcttgctcctttttcacagcagcaattccatgctttcactttggtctatagagcccctgctgtgttatattcactttattttcaactggtaaatttaattcctattacagtaaaaaaaaaaatcaagattggcattaagatcactcacaaatccctttccttccctcactgttaacttctacagatggaacccataccttctgtattcctttctcaatagaggaagtatgttcttcatttcaagaccagacctttcacttgaacttcagattcctttccccccctcatctttccttagtactttttcattgtcagtttcttctgtatctttttggttttcttttgagacaaaatcgtatcatgaatcccaagctgacttccaactttcagtcctcctgcctcagcctctgaaattctgagataatagatatgtgccagaatgctcagcttcccctgtatcttccatctctctcagaagtctttattgtttatacaaccatgcttatgttttatactgtatgtgtgtatgtgtgtgtgtaaactaatttgacccagcatttttcttatttttcaattttgtcatagtctttattttattttaatttagttttatttatgtatcttttcttatctcatttaatcctacaggtcctttgtgtatgtatatagtatggtatccagtttggggctttaatttttattttattttattttttagaagattcctcagtatgagaatgagtgggtctctgtttcttttttaattatgtattttcttcatttacatttccaatgctaccccaaaagtcccccataccctccccccagtcccccacccatcctctcccacttcttggccctagtgttcacctgtactgaggtatataaagtttgcaagaccaatgggcctctctttccactgatggccgactaggccatcttctgatacatatgcagctagagacacgagctctgggggtattggttagttcatgttgttgttctacctatagggttgcagatccctttagatccttgggtaatttctctagctcctccattcggggccctgtgatccatctaatagctgactgtaagcatctacttctgtgtttgctaggccctggcatatcctcacaagagacagctatatcagggtcctttcagcaaaatcttgctagtgtatgcaatggtgtcagcatttggaggctaattatgggatggatccccggatatggcagtttctagatggtccatcctttcgtctcagctccaaactttgtctcagtaactccttccatgggtgttttgttctcaattctaagaaggggcaaagtgtccacactttggtcttcgttcttcttgagtttcatgtgttttgcaaattctatcttatatcttgggtattctaagtttctgggctaatatccacttatcagtgagtacatatcatgtgaggtcttttgtgattgtgttacctcactcaggatgatgccctccaggtccatccatttgtctaggaatttcataaattcattctttttaatagctgagtagtactccattgtgtaaatgtaccacagctaatttgtttccattttcccttaacagttaaactttaggaagtaacaatgtaatcttgctgtcttggcattttaggcactcgttgattcttcatatcctcctagtttgtttctgtgttttctttactactgagtctgtacttactagggtgacttttgagttccatattgtaaaattcagcaggactttttggttttaatttttaaaattattcttattgaaatttttttaatataatatactctggtcatacatttccccttccccaactcctcccagatcctccatacatcctgcaggcatccaattccatatcctttctttctcttcctattttattttaaacaatacactagcaaacaagcaaaataaacaaagcaagccccccaagcccaagaaactctcatatacgcccacaaaaatggaaaccaaaatatacaagcaaatgactaagacaaacaaacaaacaacaacacaaaatgtctataaagataccattgagtttgttttatgttggttatgtactgcctgacatacagcctatcggaagtgtggttaatacactcattgaaactccattgagaaaattaagttttctttttttgcaagtggatgtcagttgcagatagctttttggttttgtttctgtcacaccagataatgtccagtcttttaactttcatttaaaccttcaataacagatgctacaatgtagtggtgataaagttagctcggtgattaatgtttctcagtgaatatttattgaatgtgagagttaaattatattttaaatgttgaaattgagatataattcacacataaaactcatctattataagcatagcatttattgattttagtgtatttacagagctatataactgtcgccactacctgattcaggaacattttcatcaccctcaaaaaaacaaaaaccctgtgtctattaggagtcactacccaattcagccctatcagccacaaatctactttaaccactaatctgcagccttaatgttttgcttattgtggatattttacataaatggaataatatgttctcttttgtgtgtgtgtctcttttcagttttaataattttaaaggttctcccatgttatagcatgcatcaaaatttcattctttttatgcctaaatatttcattattattaatgacaataatatgtatttacaacatttttgtctagctactcatttattgatgggtatttgaatttctttctgatttgggctattgtgagtgaagctgctatggtcagagttgtataactgattaaatactgtttttacttgttttactttatttttcattctttttgagagtttcatgcatgctacgtgattactctgccactgaattatagccccagccctaagtaatgcttaaattctttgaggtatatacctatgagtgaaactctaggtcatattgtaactatatgcttaattctttgaataagcactaaattgttttttcataattgctgaaccatttatattcttaccagtggcatataagggctataacttcctcttttagtttcatttctattattataatgcaaaacagctttaaaggagaaataatttatttgacttacaatttcaagctatagtctatcaaagtgtggaagtcaaagcaagagctaaaagcagctagtcacatcctcagttaagaacagagttaatgcattcacgcctactgctcagcttactttctccactctttttttttctttttttattagatattttcttcatttacatttcaaatgctatccccaaagccccctataccctccccccgccctgctacccaacccccccactcgtgcttcctggccctggcattctcctgtactggggcatctgatcttcacaagacgaagggcctctcctctcaatgatgactgactaggccatcctctgctacatatgcagctagaaacacgagctctggggatactggttagttcatattgttgtttcttctatagggttgcagacccctttagctctttgggtactttctctagccccttcattaggggccctgtgttccatccaatagatgactgtgagcatccacttctgtatttgccaggcactggcatagcctcacaagagacagctatgtcagggtcctgtcagcaaaatctttctggcatatgcaatagtgtctgggtttggtggtactttctccactctttttttttttttttttttttgttttgttttttttttttctaatttccatttctttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgttcttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagacttaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggagtattttacctttgatgagtatgaagtgtccttccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgaatccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttgtctgttattatcctttgaagggctggattcgttgaaagatattgtgtgaacttggttttgtcgtggaatactttggtttctccatctatggtaattgagagtttggccgggtatagtagcctgggctggcatttgtgttcttttagagtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggagtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcccgtgtgggcccttgcgggtgttgggcaagactctgctgtcaaggtagcccggggctcgtgtctcgagtcgagcggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagtggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtcacgagtcgagcggaagggacttgtgccactttctccactcttaacacagttcagggaactctgtccagggaatgatcccactcacagtgggtgagtctttccatcctaattaaagtaatttagattattccccatagaagtacccatgtagacaatattcattaaatctttctttcaggtgattatagattttgtcaagctggcaacttaaactaaccagcatactttcccacatctttgttaacatttgttatgatatatcttttggattacaaccatcctactaggtgtatggtggtatctggctgttttggtttgctttttcctcaagactaatgataccagacatctttacctgtacacagtattatttagaagaacctgttcaaattctttgctcatctctaaattgttacttgtttctatagtgtgaacttttataagttcttaatatattctgtatactaaacacttagatttgcaaatgttcatttaattctctgcacatttcattctttaaatttcttcttcatggtttatttaccaatgagtattatttttttttcctaaatctctggatttttttttctcaagttctcatagaagatccttttcttctaatattgtgaatgtttattatcccacaaccaggttatattgtcttggtatttcatacactgcctgcatgtgtgatctcttaattgaactcatattttaactgttatctctatatgactagctttgaggtcaagatatcttttctgtgccttatgctgactgaactctaggacattttttctttgtctctttttggaattgttcctttgttttgagaatataatataattatgctgtttcctccttcttctgtcttcctcaagtgaccaccccgtataccccttcttgcccctccttcacattcatgaccttttctttcattaatttttgttacatgtacatgtgtgtataaatatatctaagtgtaacctgctcagtgtttagaacgttacttgtatgtatgttttcagggatgaccatttggcatatggttttccattaaaaacatttaagccaggtgcagtggtgcacaccattaatctcagcacttgtagacaaaagaagctggtggatctctgtgcgtttgaagccagtctgatctacatagtgagttccaggtcagcctgtctcaaaacacactaaatttttcatataatatattttggtcatattttcctccttcccaagtcctcctagagcctcctcgcttttctgcacacccaacgttactttttctctttatccctctccatttctctctttcaacccccaaacaccaaaataaaataaaaccacaaaaataaaaatcaggacaaacaaggaaaatgaaaaaaacaaagccaaacaaagccaaaacaaaataaacaagatagaaagaaaaaaacaaaaacaaaaaacctagaacattccgtggagtatgttctgtgttgggcaactactcttggacacagggcctaccttgctgtgtggttgaataatggtgtccttatcttttcagtgtcacgaggccctattcattgttgattttagtgcctgtgctgttggtagagaacaattttatgtgatgcatttttcagggctgggaactgaaaaacagggctttgcacctgctaagcaagcactctgtcacccactaaatattcagtcctcagttcaatttttattggaaatgctctcagaatctaataggaaacttaaaatcaatttatcataaattacattcatgtatcccccaccttaatgctacttctattctgttcatttgagtgagtagcaccccagctacctacttctccaagccagcaatgtgctaattgctttggattatttcttcttgcacttccttacctgcagtataatgtctattagaatagattctacctttttaatgttccctcaatatattatcctattttagtgcccttcacttcagatattaccatgtcagtttgctttttcacctcaagtttcaatctacataatgaaaaaaatccttgactcttcttagccaggtctgaaactgtaatgatttcaatgataacggctcccataggtatatttgaatacttggtccccagttggtagatgtgtttgagaaatattaggagttgtggctgtattggcagaggtatgtcattgggggtatgatttgagatatcaaaataacataccaagcctacttagcttgttctgtttcctgtttatggatttggcttagaagctctcagccactgcttcagaaacatgtctacctgcctgactccatgctccaccatggtggtcatggacttaccctcagaaactgtaagcaccaatgaacccttttctataatttgctttgttatggtgtctcttcacagtgaaaagtaagtaagacataaataggtgcttttgatgtgctcctattgaatccaatgcttaataatggtgttaaattataatacatgctagtctataactgttatttagcttacctgccttctccataaaataaagtatttctgtagtagtccttgttttatatgactttacagttatagtgtctgtggcaaattataaacacagtagttactcaaacttgactatcacttatttctgatattatcttttttgaaagataggagagtaaaataatttattattcatctttggccatactaaaactcaagaaaaatatttttattgctaatataactttgggttatcatagatgtttattgagagaattctgttcttagcaggaccttgacctctgtggacaaatgaagatgaattatatatactcctctggatatgcagtctttcctccttatgctccggtggtgtgttgcaagattttggccttgtaattagtgggacaagaattgaaaaggcaggacagtagacttttaaaatagcaatattttaagcattgtctcaggaagctacataaaagttgagctgaaagagtgtcaagaggtcatcttgtcaagctactttacctttaagcgggcaaattctaaaggattcatggcaaatggtcaggcaggagctcctaattactcattgcaaagaatactcattgtgaaagggaagaaagggcataaagaaatgaaataaaagtttaaggtaatgaatatgctaattcccctgagttgatcattattcaatttgtacttgaatgaaaaaacccacattgcacttgcacttatgttctgtgtggtaataagaaagaatttaaaagaatatacattaaaatgcaactattaatctaggcatttggaaagctgaggcaacagaatggcctaggctaactgggaatacattgaagtttctagtccagtctgaaccattttacaagatcctgtctcaagaaaataggctcatatatttgagtgcttggttaccagttagaagtgtttgggaaagattaggaaatgtagccttgttggaaaaggtatgttactgggagtgggctttgaggtttcaaaagccctgatcaggcccattgtctctctctctgcctgcttctggatcaggatgtaaagctcccagctactgttccagtgccatgcctgtctgcttcctgccatgattatggactaaccctctaaaactgtaccaagcccccaattaagttctttcttttataagagctctcttggtcttggtgtatcttcacagcaatagagcagtgactaagctttatcttcaggtgtgtgtgtgtgtgtgtgtgtgtgtgtgtgtgtgtgtattaaagaaggctatgtaaagaaatgaataaagagaaatgttctctataaaagtgtttaacttactgaaaaattactaaattatttctcataatcattcacttgttagttttaaatgtcactttacacaacctcgaaacccctgtgacaagagcctcaatgtgaaccgtgtagataaggtaacctgtggggaatgtctgcaggtgattattcttggttgacttaattgatgtgaaaagacacagcccattgtgggtgactccagtccctaggcaagaggtcctgagccatataagaagaaagaaaactagttaaacatatataaatgagtaagcacacatgcatttattttctttgcatttggatatcatatgagtatttatttcaagctcctgccaatgtgacttcctttttatggtggactataacttgaaattgtgaactgaaataagctatttccccataaattgtttgttggcagaatatcttattacagcaacagaaatgagtatgtaacacatattctttgtatctcaccagtaatatatgaggattctgatttctctacatatttgccaaaagttattatatctgtcttttttattgttttacttgtcttactgaattgaaagtactagatcattttggttttgatttgtatttccctagagacagaggacattgatcatcttttcatgtttattggctatttgtgtatcttatttggagacatgtatattcaagatttttgtccatgtttgaatcaggttgtttttgttactgttgatttataagagttaaccatgtgttccagacaataaccatctatcaaatatatcatttgtaaatatcctctctcatcctacaggttgctttcttgctctgttcttagaattgttagatgcactaaaaattaattttaatgtagtccactttacccatatcttttgttgcctgtccttttagacatcatgtaaagaagtcattgtaaaatctaaattcaggtaagctgttagtttttgcctaaaattttatagttttatgtctataccattttgagtaatttatttatttatttgttattgtatcactaaaacccagggccttatacatggtagagaactttccctaagctatacccctagtttgtgtcaatttttatgaatggtataaggtaaatgtacagataatttcttttattctggatatctaacttacataatatcatttgtttaaagattttctattccattggcacccttatcaaaatcaagtgaccacatctgtgagggctaatttctgggctttctgttttattcagagacttgcttttgaggctttgttacatacagtgtggcaatctgtgggtagttcaacttctctagtaaaaacctcccaatgatggaaagttttgataaaggcagacatttaaaaatttttttctactatgtcactggtgttgaaatcaatggttgataatacaaatgatagtagtctcttcagatgatgaatgacagtaaactatttctgaaagctactgaaaaaattaaataaaacaacataaagcattcagcatacatcgtgtgtaagaaaggattcttatttaaaatattcctactaatagtacccatgaatgaatagaatgatggatgcttttatctccaaatatgagaaacacggtgttgtagatctagagatacctggacttgagtagctctcagctgtttgtgtgtgtgtgtgtgtgtgtgtgtgtgtgtagaggagggatacacaaggactgggcacaaacaccttacttcctcataaattgttaagactggcttgcttgtttctagcatgctataaacactaaatgagaactagtgttgagatgccaaaggagaaaatgaatttagggtgaagtagaaggaaagcagacatttggcaggcagctttatagttctaaaggagcaacgtctggaacaccatgaagcacatcaccaggccaacctaagagattagaggtatttacatagatttaaatctaatcttcctgatttttctgcaaagtagacattatccccattatatagacaaggaagcagactctgagagattattagagaataggtggtaaatggcagaaccaagatttaaacctaggtttatctggaccccaaggcctgtaatctgaagcaacatagattttatttagtttctttgttaaatgtcatccttattggtaagtgtaagaatagctaagacaaatttcagaatcatttgatggttttttttcattgttatttttctggtctgtaactagtaagcctttaaaaaattaatatcctgtactgctgatttaactggcagattagagtattcaaaactgctggcaaagttactgtaagaatgtaaattttctaagttataagcctgtgtatttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctatgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggatgtgtatttttttataatttgcagtagcaacagtaaaatgtaatagcattcttgctatttgtagtttgttgcatttgacaagatatatggtagagtaggtggatgggtatggtgtgagtctctgtctctgtctcatctccgtctctctctctctctctctctctctctctctctctctctctgtctcatctctgtctctctctgtctctctgtccctgtctctgtctctgtctctgtctctctctctctctctctctctctctctctgtgtgtgtgtgtgtgtgtgtgtgtgtgtgtgtgtgcatatgacaagagtagaaacatctgagtcaagaaaatggaaaggtacattaaaaatggttcccagttaaaatcatgtaattctagtgctaaaagacagctgtttctttcactctgcttctaagttcagccagtcatttttataatcccatgttgttcgttgcaaggtaataagagcagaaaatatagctagtttatccaagttaatacctttgtattacctttgttataacttgccacagggaggtatctttcagtacaactgatgccatcttcatagaaaaagtatggaattgttcggatgtatttgtgggcatgtatagtggttcagaaagaattgtattagtggtcccctgagtacattcggtgaagtctaggagaagagttcagactgtagagctgaaatgtgtggttttgaatccttgttcagatgctggcactgtgaccttgaaagatttacttaagggaacaggcagtagtggttgcttatttcaaaacaaggtcttactcatcatatagtcctgaattccttttcctcctacttttgccttcagagatctgggattacagctgtgtctccctacacctagctaggtttgaggtttatatgaaaagtgtgaataataacaggatgtttaattcagggtggcaataagaataaaataatacatgaaaagctcttagaaatgttcccagatcctaaagttttcagtaaatgccagctattttgtttgtcattgttgattactgttattattgttattattatgtgctgagaaataagcaaagagaatagccaaggttttttctttgtgctcttgcaatgtgaaatatagccttttctttgagcttgaagaaagttgtagtccccatcatagagaaattctttaaaccaaagatctggaattgtatgtgattgcgacatctttatggaaatttgacttcatgatgacgttattggatttgtgttaatacaagaaaaaaaaagtcccttttggtggggcagtctaaactaagagcattgcttttgtagtatggagactggttctacttaaatatatgttttaattgttggacatttctacttcccaatttaggacaaaacaatctctatatatcataagatataggaatatcaaaaggaaatgttggatgtttcttcattcatttcttttttttttttttgagattacgtcacactgtgtaaggatggctgctctggaacttgctgtgtagatcaggttaacttcttctgcattccagctactggaattacaagtgtgcatcacaatacttggtttatttatttaattgtttgtttatttagtaaggtatttattgactaactattttgtgccaggtattgtgtattacgtgctgaatatttttattacaaccaagaaaacaaacagcatttcagatcctgatgtaactaatggtttctcagtagggataccaagtatataagaaaatacatgtttatatgtgagtgaataacagaaaagggtcttatttaattagaatgaatacacaaagacttactaaaggagaattgttataatgagaggtaagataagaaaggcattgaagggatggagagatggattagtggttaagagcactggctgctcttccagaggaccagggttcaattctcaacatctacatggcagctcacaaatgtctttaattccagtttaggagatcgacactctcttccggcttctgagggcaaaaggcacatatggtgtccagacacacatgcaggtaacacattgataacataaaatattatttaaaataacgaatggaattcagacagggaagttctgaaaaagcatgtgtgaaagtctcaaagcaaagaagatctctggacgatggaagagctaccaaaagagcagtgtaagtgtgaagtcataagggggaaagctgtgtcttatgagctcgaaaggtaggaggatcaatgtgctcctgcccacagtggtcaggagactttacctatttttctcagagcagtcctaagacagcaaagagtttggtgtgttgaagggataagaaggtgtcagtgtgaatggagtccaatgtgaataagccaaggctgataatggtgtttacttattgattgtattaaaatgggaagctgagggtttcaagcacaaaagtaattagaaaaatagggatttttaaaagataaaaaagatgtaatagtgtgcatgtgcagaaggaaaattaaagagaagccatgcgcagtagcatatgcctttaacccagcacttgggaggcagaagcagaggcaagtagacttctcaagtttaaagtctaacctgctctacataattagttccaggctgaccaggctttcacagtaagaccttgtctcctatgaacaaataagtgaatgcagatcaacataaaggctcttttatttctggattaaaatcatgttagcattgcactaatgtggtgtgtgtgtgtgtgtgtgtgtgtcagagagagagagagagagagagagagagagagagagagagagagagagagagagagagaatgaataaagggcttattttgcatgtaacacttcaaaacttaggcaaccaggaatgtaaccttccatatactcgcatgagaacagttgtggagtaacagacttggagattggaagggatgtggagattaggtaggatggtgcttgcctttagtccagcactcaggaaactgaggcaggaggatcacaagttcgcagatagtctgtaccacagtcagtgaagcattgactgtaaagtagggactgagggtataattcaatggtagaagctaataaacgccaggctctgggtttgatctctacccccaccctcacaaacaaagggaaaaaagtaaaagaggagttgatggcatcattagttgatgacaaattagaaaacattaaccttactattttccctttaaaaaaatcaatcttgctatctactccagataacttgaactcactgtgcaaccctagttagctttgaacttgctttcagtccttcagcatccacctcctgctgaacactaagcatttcaggcctattgtaccatccctggcttggaagttattaatcttgataagaacagtttcagtggtactgcagggttcaaacagtttagatggacgtatgtgtttgtaagctcctgaagataatctatggagaaggaattgatgatttaggagagagatgatgtgctgattagctttatgtcaacttggcagaagctagagtcattgaaaagaagagagccttaattgagaaaatgcataaaatctggctatcgggtattttcttaattagtgattgatgtgggagagcccagtccattgtgggtggtgccaaactgggatcgatcctggtcctggatgctataagaaagcacgctgagcaagccaggaggagcaaaccagcaagcagcacccctccatcagctcctgcctctaggctcctgccctgtttgagttcatgtcctgactttcatagataataaacagtgatgtagaagtatataaatgaaataaaataaatcccttcctctccaagttgcttttggtcgtaacacttgataacattgatagtaaccataattaagatgaatgggataaccaaaatgatgtttgaatgcaagataaatataatacagagaaaaaggagaaagcttatcctttgagagtggggaatagggatttatgtactataatagaaaataaagatgagaaaagtgtttagattaaactggtagacatagtagtgagaagggagtgtgtctgtgtctgataacaccattcttaatagcataaggggacaggatcatgagggtagagaaggaaaagcagataattttcttgtaaagcattagttgagaaaagtcaatttcagacagacagtatttgatacctatttgtagtctgtgatcacgaatttacataaagcttttcaacaagattatatgattttctacagcaacattaggctgctttggcataaattcaggacagaaaaatctctgaatttattcagtggtgagaggatttgttttattattgacagagaggaagagatgaagaagttgcggaaatgcttataaaggtagatcagtgactatgctgaataaggaaggaggacatggagggatattgtgaaagtggcatctcagtgaaattcatttgttgaatatcagacaaagaattgaaaagagtaaaaattatagaaacaaatataatattaatgttaaataccaatgtgccaatagctataaaattctacataggatagggtgacagacaagcaaatctagaagttatataatatcagctgggaataaaggatgagtagcaaaaaagttagaagaataattagtataacaaagacattgttttagagaagccaaagaatagcttataatattttcactgtcttgaatatggctagacagtcttgtgaatatcatcatttttactacacttcaagcttaaatattcccaatgaaaagtagccttactgttagatcactattcttcaccatcttgtatttgatttttgtttctgactttaatggactccagggaaaaattttaggatcaactgcttatatcttctaactgtcctatcacagctattgtgagtacacaaatctatgagagaaatgagatggaatgtgcccccaaactatgagcaaaataaaccttccttccttaaaaaaaaccaacaacccattatctaaataatgtaaatgtcttcagatatgtgccccttttcccaactgaaataaattttggcacatggagtggagtgatgtgaccaataatccttcaaatttatcacaaagcagtaggacagtgaggaagctggtaacagtacatccatggtcaagaagcagggagagatgaaggctgttgcatctttgccttcttattcactcctggatcctggctcatgggatagtgtcaccagcagttaaggtgggtcctcacaccttgattaactaaatctggaaactccctcacagacatgaacagagagttgcttccatggtgattctagatcctgtcaatatgacagtaaaatctgcattcatgtattcaaggctctgaaaggctctacagtcttgggtgacctttggctacatgtcatcttgtgtttccccaatagctttgcttttgtctcattccacagtatggctttccatttttttccagagaaggcacgctgaggaattctggtttcccaagactgtgcatctttctttttaaaaaatatttttcagatcccatcattaaatcatttcccccccaccttttgcttcctacaaacctttccatgtactcctccaccgctgccttgctctctttcaaattcatgatctctttttaattgttgtcacacacacatatgtatgcacacacacccaaatacataaatataacccattaaatctgtataatgttacttgtaggtatgttttcagggctgaccatttgctattagataaccagttggtgagctcttccctggggaagactatttagccatatgcattttttagttgtctattgttctttgtatagaattcaggcctcttgagcaccctcaaccccaatttacattagtatgtctattgctgtcgtccttgttcagttcatgtttaggctgtcatgtttttgaggctttatggttatagcttctgatgtaactagaagatgcaatgtcaaattctttgttcttctggctcttacagtgtttccccctcttctacaatgacccctgaaccttaggtaagggaattgtattatagatgtatcccttgtagtttttttatagtgatctccatctattgcaaagagacgtttcctctatgaagggtgaggactacacttacctgtgagtataaggataaatatttagaatgtagttagggattatgctgggttagtagggtggtgattgtaggtttttttccccaagatccatgactttagtagtttggggtagtcgtctaagttttcagtattcagaacagttttcctcaggttatttgaatttttagtattaaattacactggaaaccataaggggctaaggaaaagaacaaacagattttgagtgaattcactgataaaaattaggtttatattactttttaaaattctggagtgagttacagttatatgtgtagttacactcattttagatatagtgatgtttttagaactgtcataaaacggaccttatttttcacaggaactatattaccattgtcgtgtgacattgtcagtctatatttaactttgaaagaaaccagtactatgtttctcataatggatgtagtaatctaaaatccaccagtaaatatttcacactttccctttattcccatcttaatctacattatttattattcatttatatcttttgtgctaagctcaagatggcatagaagcccttatgaagtggctttgatctcatgatactcctgcctttgtataaggtacctgccttgactttttgattttccatctgagcatgtgtgtgttgtaagatatgtgttcgttgttttagtgatatctgttctgtgtataatgattatttataataatttttgtttatcattctctgattattattgaacataacttcagattacctgttagtagcctttaaaaacagtttgcttactaagtcagcatctcatgtagttcaggttaatttggaagtcactgtatagatctccattttcaactactgggattagaagtgtgtgccaccatgcccagtttctgttagcaacttttaatgtcttctgtggagaaatgtttcctcaggtcctttactcattttagatcaggttatttgtctaccattaggttatttgtatttttatagtacatgttagataattaaccctcatcaaaatacaatttttgcactttatctcctaatctacagacttccatctcattttcttggtggtaataaagtcaccacacaataatagctttggacctataatgatagaagatgacagtggtccaggctctgtgaaattgagtgcagcagcaaaaaggatgtaatgatggcaaaatgtcaccatggcttggttctaacggtgagagcaatatagcaatgactacccctctgggagtgaggagacctcagtaattcagattggaaagctaatccaaatgctgatagacaaggcactatgtctctttggcctggaacatcaattctggtgggatggcacagtttagctaagatggtagagaggcacaatatttacttggccctggaaaggatgtgtatgcatgttaccagagcctccagatccctagggtataggacatgacataaaccctgcagctagtgagatatatcaaagactcagaggctttagagtccaaggtcatgctttacctatggatttatattaagagaagaactagggtcaattgctctggtgtgctggaggcctgaagtccctcttagggattgagtcctgccttggtggaggatacaaatcatacaatacacagaatgcttgtactgggagaatggagttgggcttcaacttggccctaagggaagcatgcacttgttgtttggaatgaaggaaatgggaaggattcatggtacactggctctacgaattaagaaagagtaccatcttggctggcaatggctaccagatgggtgtatttcagtgatggcaaagcctctagttgagaggcctttatggctacttgcctgcagaacatgtggtcccaagatggtaccatacagtagcagcatgggctatgagaagtagaatacagtgttatctccttctctgggggtagcttagtatcaatactgggtagtttcagaggctgttcttccaaatgattcttgtttgattcctagcacccacacggccactcataactctttgtagctccagttccaggggatctgacacctacttctggcctttatgggcaccaggaacacaagtggtacacaagcatatatgtagccacaacacacatacacaaataaaacaaaggtatgtgtgcttgtttagtatgtatgagtacattcctgagacatatgcacatgaaaaaaacgataaaaccaactaaaaatacttacattgttttcctttccctagtagactgaaaaccacatctgggcaaagattaaattttgaaggaacatggtaaattgaacattgagcattgaacattgagtaaataacgctcctctctattagcaagataagcagaagatggtattgcatgacatgttcacttttgagaaactcatcctctaaataggttgcattcaaagatctcaatatgtgatcctaaacttcattattatagcattaaagctagaagccacttagataatattatatatctactacattttttaaggtgaagaaactggggccttttaaacaattatcatgttgggttattttcttcactgttttctttcctttatatatttattttgtatttcagcatctgtgttccaaagagctaatggtgtttttactctaggacctaagagccaaggtcattttctgaaaagggtggagctgaggaagagtaattctttgaatgtttgaggaacatgagaaacaaatgaaaaatgtggcagaaagtgagaagaaaacacagcaaaattaatgagcaatgctcaatgtctagctgctactgtttgttttgtggctttaccccacaactagctaatggatttaggattggagaaaagatagaagaaatggtcattggtcagaatttaactagatgagttaaaccatcatcactgaagttataaataacaacaacatttgtaatgaaggaagagagcttatgatttcagcaagtctgtaatagaagtaatgtactaggacacttaagctagctaaggaggaagtcagaaaaaatgtaaatggcaaagtagaggaaagatcagtgaactagccttgatatactgaaagaatggttgttagtctggaatattgctattgaggactactgtgcttatattggtgattttggagattgagtggtaaatggtcatctatggttgcttccagttgcgtgaggagtgagtggtagatgcggtatggaaggaagtcactggggatgaggaaattaatgactcagagttcagcatattagataagctacaccatacttctatacgtttatcttctctttcttttttcctttattatttttttttaaatttaatttaatgtgtatggttgttttgcctgcctggtgtatgtctgtgcaccacgtgtgtgtctggtgcccttggaggctagaagaaggctttagatcctctgagattggagtcacagatggttgtaaaacatcatgtgggtcctgggtattgaatctatgtcctctaaaaaagcagttactgctctaaaccactaagacatctttccaacaccaaggacaggatcttattagtgttcattagagacatctaaatgccagctctaggacagctattctaaactattcagagtttatcctccaaggaatttaggagctcttaggatgagtgtattagattagatgttatggtaagaaagatgtatgaattttcagtcttttcctgtctgctattctctttctctctagacatagtcagatttttttcttttaaaagctctttcctctatcttgggatataactcagtaggaaaattaacctttgacccaactttaagctttctttaaaacttctctctcaaatctattattcttttcattgttataaatatttatttattggaaatgcctaattttcactgagcaatattatggggaaaagagtaatcatcatagtatacaacttttgtcacttgggagtatacatacatacatatatacatacatacatcttatttttcttatagtttgaatcataactgataatataagagaacaaaggctttatcacacacatacatgcgtgtaaacacacattaatatttgtgctggggggtagaactcaagggtttatgtatgtaggcaatcactctaccattgagccctatgaccaatacatttttaattttgtatttttaaagtttttagcttacatttcctgttttcttcatattctgtaaaatgttcaaatatttaactttttatgtattataaatttctaatctgttttcttatggtcagacctttcaagtaattcacacgttttgctgttcctgataacaatatattctacttcatcttgtgttcatgctttttttaaactctaattctttaaaaatatttttatgtgtctctatgtgtgcacatggatctttgtatgtgcatcatatttgtgtgtgtgtgtgtgtgtgtgtgtgtgtgtgtgtgtgtgtgtgtgtgtattgaggcctgaagttgatatctgaagtcttcctcaatcactctccaccttattggaggtctcagttgaatgtagaactaatctaactagcaagcctgctttaaggagcttctgtctcctttcttagcactagatttatggggaggtcaccgtactcacccagcatttacatgggttctaactacacaacttcttgtcctcaatcttgaagacaaatatttatctattgaaccatgtttctagcccctaatttttttgttgagctgttttaagagataaattcctagaagtgagattagctggccaaagattatgaacattttccttccgatgaacttactgaaagaactgtataccgtttgccttcatgccctaacactttccttaagtatcttggaatttgtcatcagtcaaacatctttcagagattacaaagtggcttcctatttggaaaatgaatcggctcattctgaattttaagaattcttataatttataagatgtaacactttgttgcaactatcttcttgaagttctcctgtcttggttcatgatatgatatttagttctctttctaccttcgactgattctgtttcttgaatgtctgaaatgaagccttctttaggttgtgttcagtcccttccaacatgaataaactacaaaccactttctctggttccaacttctcccttcttaaattgacaataaagttgttttcatacactatgttctaataatggtttcctgtctcatcttctccttgatcctttccacctcccaacccatccaactccccaccttctttctctctcttaagaacacaaataggcaaacaaaatagacaaagataaaacaaaatgaataaataaaaaaaaagacactaaggaagaacaccagaaatgtatacatacacacaaacaaacatatgaaatccttaaaacctcaaaattgaaaaccatatatacaagcaatagaccagtaaaatgttaaaaagggagaaggcaaacaaaataatataagattttaaaaacctccacaaatacctttgcattcattttatgttggctttgtactgctggccatggggcctcctcttagtgtggtttgtatacccccagtgagattcccttgaagaaagtaagtttttctttgtgagtgatcattggagataatatcttggttgagaatgagaacattctctactgtctaccccggcactgggaccctgtctggttttatctgtgcacattctgtgcatgtgaacacaggctctgttactccatgtgtgcacctgagttctttattgctctaaacatccattgcttgtttttgtaccatgtatcactgtatctacaaatgaaataatttccactcttcaaatctgataatactatttgcatttctagagtttgaagattatgggtagacacatgtcggacccttttgccttattccatctgttctgctggttgtcatattatgttaattctaattattttacaacctctgggtttttttcatatttttatatgattctttcatttaacaaatatttttagagaactgtcatatgcttggccccaagggtacaccaggagcacaacaaaaatcctggacatattgaagatatttttattgcgggaaactatgcaagcatgaaagtaacgcatgcagaatataagataaaaagttacatgttaaagaattggggaaagtcaaaacagggtgtatatgtatgcacaattagtccaggaaagtaaccaagaaagtaacatttggtcaaagacttgtaggtagtcagaagagaagcccacagacgggaagagaatgatggttcattccagatagaagggctagcggtttaaaggttttaagagagagagagagaaaaacaaacaaacaaacaaacaaataaacaaacaagtgctcagaatggacagagtatttagtgtaaatgaatcagaatgagaaaagggaaggtaagtggggtgggcgtcagatgtaaagtgaaagaaccagatcttgtggagattttgatgtgctgtgagtgaaatggaaagtcatttgggcaaaagattgagctgacttgatttcttattgatgtaactgtagcttctgggtcgaagctagattgtatcaagtcaagggtagaggcagaaagcaagtgaggaggcagttagagcaaatgaaatgatgatgatgctttggaccagggatggtagtaatgaaagactgttggattctacattgaatattgttgcaatgtgatatttaagaggaaagaaggctatcaaaaatgacttcaaaattttggcctgaagtgaaagaactaagttcccccctctctttattttgccttttttggagctagggtctttggaattccctttatgtagcccaggctgatcaaagtcatgatgctcctcctacttcagcttccaagtgctagatctacaggtataaggcattttcacccagctgagttattcaattacttttatgtatttactctttttataaatccccggatgcttaattctgttctactctgttctgttgcaattcttaattactttttaccctggctgtgtcaatattcttgataaatgttcagtggtcaatgggatcatcctctcccagcctctctccttaatccagtacatcctcaatacagcgaagcactggtcatatattctttttaaaatcttccacagttttcagttgcacttaactccacaggcagactcttctactttgcatttaaaacctttcataatatgagctcaacctatttaaccggctttatcctttatgatttccatatgtccttcaaattaaaatggcttgctgtctctctgaagttagtgtttatcaacacctccagttataaatcatgcttagttgatataacatggtggttaggagcatagactctagctgaacattccaagtttgaatcatgtctctacatctcattgtgttttgatgcagtttacgtctacctctcaaatttcaatcagacaaacaaagacaatagttgtgtacttcatagaaatgtttgggaaattaaatgggtttatatatacagcatttgaacattgcctgacccatgtttagttctcaaaattgttagctcttactgttattgttattaatatcattttcttttcctagtctcactgtagtgccaggctcatgtaggtaaggactttattctgtatactgctctatttgcaagacctacaatagtgttttgcagataatgaacagttagtaaataaatgattgcagtttccctggcctgagattctagttgctgctgccacttctccacattcttttaagaaccttatgaacctacaaagctcatcatgaatgacgtttattccatagaacgctctggtttttctgattcttattccaaactaaatttaacctctcatttctctgaattcccgaaatatcttgtatatgtttcttttacatcctttactttccattgcctttcatcttagtcatttgtatctaatcttgcttactagatattaaggtcttaaagcacgtactgtgtcttactcattttttttattctctgtggtgttagcataatgccttgaacatggtagatgctcaataaacttttgctgattgaattgaattgaattcattctcctatttatatgcttagctttatatgaatttttagatttctaagtcatgcttccaaagtattaaatctctctgcaatttacttcttaggtatcctaagtagtcaagcttagaaagactatttatatgcaattgcaaaagaagaaactttgtctctgccaagccttcttcagatggcctgaggatttgtgccagatcacaaaattgttctaagtcagtgaaagggaaagtttgttaaatatggtaatatacagctgaaattcagtattctaataaatattcacctaaaaacccagatggagaaaaacagcttttgtgcagatgataaagtgtatggtgtaaaatatatgcacttaagctcatgtacttacaggataagctcctcaaatactaactcataatttatttactaatcattactcttaaatcatcacttttagatttacagctaacagctggggagaggtaaattataaatgctaagaaagttcacagaagatagtaggagggagagactgctgactcccatctaagagacagaaaaattaaaaaccaggtgaagaacctacagcagtgtggaactaatagccccatagagcttaccgacgccttgagggcatcagtgccttatgacaatacagtgattgataaattgacgttcataacgattcataaaagcattaaattgatacccaccacattatattgatgagataagcagtggggattaagtgttcagatttcatccagaagattaaagtacagattatattgtatataaaatagtaaatccttatctagctagctagataactcattcctgagttaagcataagttaaatgtaaaattcctactttttatgcatacctttctgtaccagtccctctaactagaattgaaatgcaatgctaaagcagaacgaggcagtaaatccataaaaatgaattgttcattcacactacatttataacataggaaatacgattatagaacagatgttgactgattgaaatgctgtatgctcaatcatgttagtgtttatttgataaggaatgccatttgtttagctttgctcatttatttagtgactgtggtctggaatttgattagatgctgtctggctgtgtatctctacccaccaaaatcctgagtcagtattagcttacaggagaatggagaagttacagctttttagctttgagaatgaaaataggaagacagttttgtcaatttaaacatctttgtttttctgtatttcacttatgtattggtatcacaacgcagatgtgactaatagtctggcaatagtccttccttgtttaactttacactgaaaattgcatcttcctaaaagtctttttagtgacaaccagggagagagagagaaccaagaatatttcctgaaatgaaatcatttacagatgatgtgtttatgaatcatgggaaagactaaaagttaattgtaaagctactgtgattctaaatagtcctatatttaaaataaactactcaactaatttttgatctcccttggagacagcaaatgtcttttctgtggcagcaagattacagcaaatgatttcatgggaacatttattcagatgctatattttattagctgataattcttatgatatacaatgtagtataataaatatttgaatgaatagatttagaaagcaggtaatttgtagtaagcatttcaaaacatggattaactttcatttctagaagtagtacatcaagctattttgtgatacattgtaaaaatcctgtttcagtgaaataaaaattaagactttacttatataaaacatttcagaaagaattttctttacatttacagaaagataaataagattttaaacacaccactgaatatttctgtgttttttccatctttaaaaatattagaaaaagagtcctttgtttatcatcatcattattttacatctatatatttgtgcttgtatctgtgtgtgcttgtatatgtgagtgtgtgtctgtctgtctctctctctttctctctctgtctctctctctgtctctctctgtggggtgtgtatgtgtgtgtgtgtgtgtgtgtgtgttggtattttgctaaaatggaagtgtggaggtcagagaacaacatgagagttgtttctcttcttccatcatataggttccaaggattaaagtcaggtcattaggcttggtggaaaacacctttactagctaagcactctcactggcctaggaaagagtttttagtggttgccaatacatatcaagtattgttgaacttaagccaggcctgttgaagtgtctgtcatcccagaacttaaaaggctgaggtagaaagattgtggcttccagaccaatctggtctatataagaaaataaatctctggctcaaagaaaacaaaacaaaacaaattagtatattctcttaaaaactacagagtaaaactgaagaaagtgcagaagaatatgaatattatagaaacataatattttaatgcagaattagaagtttcttctataatctctgtcttagggtttccattactgtgaagagatagcataaccaaggcaactcttataaaggctaaaatttaattggagatggtttacagtttcagaggtgtagtccattattatccagacaggaagcatggtagcatgtagccagacatggtgttgaagaaagagctgagagttctatatcttgatccacaggcaacataagggaactatgtgtcacaatcatccataactttagttgcaggaaacccactaccctcttctggcctctatggatagaaaccaggcatgcatatagtgtacgggcataaacacaggcaaaattctcatacatataaaataaagttaaaataataataataatgataataaacaactgcatgttaacacaaataacatcttaatgacaataactatattctattgcacagcaataacattgttaaattcaatgtcatttctttttctgaatgctggtgagactataatgtccatttgtataattttatatctgttaccttattccaattcaaagccccagcacttttctctacacccactttaaaaataacaatgtattaaggtatttagtaccataaaatttattcactaaagcagcattgcttcaactatcagattgttttatagtggcaactatggatatccaattaccccacacccctttcttttctcttgagacatagtgttgctattatacaacccaagctagcatcacattcacagtgtgctggaaactgtcctccattataagttcccaagtgcttgcatcactggcatgcatcgtcataattggctacttccacatttcaaaaaattatatttatcccagtgagtccaaagtgatatttcaattgtgcttttgatttgtattccataaatgatagtgatagaaatcatcttttcatgcaagaatctctttgcttgtgttctttggataaatttatatttaagtcctctacctgttttttcaattgaacatttactttttattattgggctataattttggaacttctaaggatttttttagtttcagctcttacattcagatctcatcatcatcactatcaccaccaccaccaccaccaccaccccttccatcaatcaccactccttccatcaactaccaccaccaccaccaccaccactaccaccaccaccccttccaacaaccaccaccaccaccaccactaccaccattttgagacagtatctggctatgtagtctagggtatcattgagcttctcatcttcctcagcctctcaattgctaaaattataggtgtgtatcattgtgcctagctgcaatccattattaaatttttatgtattatagtgaaggtgtctataatagctaatttttattgtcagcttaatggggtttagaatcaccatggaaatgtctcagagtacatctgtgaaggtgtttccagaaaagtttgacagatcacagaagacttactctacgtgtgcatggcactatcccattggctggggttccagactgaataaaaaagagcaagtgacctaagtaccagcatctgtttctctctatttcctgactgtgactactatatgatgagcacttttggcttctgcctccttgatttcctcactacaagggactgtatcctcaaactataccaaaatgaactcttaagtctttttgtcaggtattttgtcacagcaacaagaaaagtaactaaaatgtgtccacattcattgttttgctacagttgtttgaagattatttttctcctccccagttgacctggtatctttgtaaaaacataattgattgtaaatcatatatgtgtgtatcttttgtggctgatatatacggtccctgtctaaaatgtatttctagttaaaaatagtgtgtgccacgatgtatggatgtgcacatgagtgtaggtatttcaaaatgcagagatattggattccctggagctggagatataggtaattgtgagccaccaatgtaggtgtctaggaaccaaatgtgatcttctgaacaggcattaaacactcccaaacactgagccatctcttcagcccctgtttatggatatggatattgatatatggatatagatatattcttctggcagtagagcactcaattaccttgtagtttctctaaggtttatttttaatcatgtgcatatgtgtatgcttgtgagtatatatcacatgtgactaccccgtagaggccggagctctcagatcctgatgtgagtgcttggaattgaatttggattttctggaagagcaatccactgagcaatctcttgtgcctgtacttcatagttttaaaattaaagtttacatgtatgggtatgtgtgtgcacatatgtcttcactatgtgtgtgcctggtgcccatggagaccagaagagggtgtcagattctctgaaagtggagtgacagacagttctcagccactgtgtgggtgctgggattccaaccctggttctctggaagatcagctggtgctcttaatcactgtgtcacttctctagccctattttttagttttgtactcagttttgatattggaagcgtatattatttgttttgttttgtttgtttgtttcttggcttgttttgttttgttttcaaaattgtttttggagttctgtgcctctgaacttcagtatgagttttaaaattcaacttatataatgattctaactgagattttagttggtagttttgcatttgtagatcaattaaggggttattgccatctagataatattgacttccactctatgaacatgggtatctttatttaatcttattttacttgccttatttaaaaattattttgtacctgctattaaaagcctatacttctgtttgcaaatgtattcttatggattttgttttatgtttgatgttattataagtggggttgattttgatgggactggggattaaacctaggttctattacttgcaaagcaagaagagttccatcacagaatttcatccacagccatataataacctaaatttttcattttctaatagttcattacatgtatagaaatacagataatttttttacattggcatttcggacttgatgaattactttattagcattggtaattaaaaaagaaaaactttttattgattctttgtgagttctgcatcatgcaccccaatctcacccagcctccattccttcatatctatcctctgacttgcaaccttccccacccccgagaaaataataaacaaaagtaaaaaataagcaaaacaaaaaataaaatttcactgtgaaagctgtaatgtcacagtgtgtcccacgctatacccttttgaccacacatctttacttaaaatgtacattgcaatgggtctcgtgcaaggtgtctggttctgctataccatcaatattgggtcctcaccagaactcctcttggatatcccgttgtttctctgtggagcatctacagctttggatctgcaagtccagccccttcatgtgctccagcagttcatggatgaggtagatgttggggtggatcagctcaaagccctggatctgagcctgggcggtagctgagctgattagcctgccagttctcctagacccacaccaccagggtgagccctccagtactgccctaactaggtcacccagcgttgtagtcaggaagcagcagggacagctctcctggtctcatgcccttgggccagagtacctgcccccataccaactgggccagctctactgtgctgtccaggtgagtatgggggctgctctctcaagtgttgcagctggtgaggaataggaccagctttcctgccctcatgatctcagggccagcatccccacctgctgcagatgtgtagagatgaggaagtagggagggcatctcttcaaaggctacaccatctcagggcaggctaacagtggggccagctctcctgtgcttatgccctctggtctggctcacccacaagtgctgctcaggagaggtgctttagctggtgaagagcagggccagttctcccacactcatgaccccagccagctttcctgactgccacaggtggtgagaggtaagggaatgatggtaattttttaaaaaaaaatgaatactcattttttataatactcttgtcatctgaaaatagaggtaatgttatttctttttttccaaagtgggtgcttattacttattgttattcttagtttaatatggagaatagaagtcataagaagacacccttgtaaagggaaatagtatgctcgctctctctctctctctctctctctctctctctccattccaaaagttgctaccctttccagtccccccctctcaagttcttcaccaccttcccttccccccacctctgaaagagtgtcctccaaacctactcacttccaccagcattcctcttccctgggccattaagtttccacaagtttaagtgaatcctctcccactgaggccatgccgtacatgtgcccagggccatgaaccagtccatgtatgctctttggttggtggcttagtctctgggagctctgaggggtcttggttagttgacaccgttgctcttcctatgggatggtcctccccttcagctcctttagtttttcctctaactcttccatataggtctccaacctcagttcaacggttggctgtaagtatctgcatgtgtctcagtcagctgcttgtagagcctctcagaggacagtcatgccagtctcctgtctgcatgcacaatatggcctcagtaatagtatcaggatttggtgtgtgtgaataggatggatcaaaagttgggttagtcactgtgtggcctttctttcattctctgggcatttttgtccctgtatttcctttagacaggatacatatgatgtcaactttgggtctttcctagagttattgttcagctatctgaggaagttcctttctattgttttgttttaaaggtttcattttattttgtgtgtggatgttttgcctgcaagaatatctgtgcaccattttaatttgttaagttttttcttttaactatgagaattttcttacattgtcttgctgtatagcccagattggcttcaaacttatgatcctcctgcttcacctttctaagtgctgggcttgctggtgtgtgtttccatgcccagctaaggatatttcatgttgtcaacattttatgtgattattaagatattgtagtggtttaaataggtttggaaactcatgtgtttgaatgcttgcccctagggagttgcactgctagtaggatgtgcccttgttagaggaagttcatcactgttgggtgggctttgagtttttctatgctcaggttccacccagtgcaagagagaccctcctcctggctgcctgtggaagacagtctcctcctggccacctttcgatcaagatgtagaactctgccaggcatggtggcgcatgcctttaatctcagcacttgggaggcagaggcaggcagatctctgagttcaaggccagcctggtctacaaagtgagttccaggatagccagagctatacagagaaaccctgtctcgaaaaaccaaaaaaaaaaaaaaaaatgtagaactctgggctcttttagcacatctgcctggatgctaccatgcttcccacaatgataataatgaactaaacctctgaaactgtaagccagccccaattaaatgtttgcctttataacatttgccttagttatggtgtctcttcacagcaatagaaccctaactaaggcagaagtttatggatttcttcttttatctatggtacattgcattagctgattttctgatagtaaatgaacattgcaatcctgggataaattctacttggtgatgatatataattattttatgtatggttagattcatttttaaagtattctggtgctgggtatgatgccttacacatgtaagcccagaacttcagaagtggagatcagaattgccaatacgatggggcctgtctgggctatagagtgagaccccatctcaagaaaaacaaacaagccccaagtattttgatgaggaatttttatgaccatattcagaagtagtatttgtttgtgttttttctttattgcttttgtttgatttgggcattatataataatagaataaaataaaaaatgttttaccatcttaatatttcttcaaagcgtttatgagccttaactgtaatcttttactggaattcattaataaatccatggtctgagcctaggattttctttgttagtacattttggattggaattcaatttctttcttaccttcatagctacccttattttgtttttcttcttaaataaacatcactttttgtttttctaggaaaattcctacttcattttggttatgtacatagagttcaagttattccttcatagacctatgtgtggtcagtagcaatgccctcttcttcattccaaattttaataatttgagttttttgctgtatagtttttctgttaaatacacttagaaattatttgtttcttttttcagtgattaatttgtttttgacaattacacacacatatatgtgtgcatacatgtgcacacaatgtattttgattaatctactcccttattattatataattttatgatgtaatatataataaataatatgcattattataatattatctgactattttacctctccacttatcgattgccatctctctataatagcaagtctagcattttagtttagttctgtgatatctgttgtaatcttgtagtagtataataacgactcagatgctctaccaagttaccaaaactcttcacattgtgctatacaatctgtttgagcaaagggggaaaaaggcagcttgatccatctttatcttccttttacaagtttctataccctgctatcaggatttactttcacttattactgagtaacctttggctttattgttttcatttgaggaaatgagaaaactttccttctaaatgtttatcaacaagaagttattccttttggaaatagtaattgaattctgctgtcctgtgtgatgccagagatgagctcaatatttggcctaggcctctttcattttcctggaaggaagaaaatgtggtggtccttcacatgtgcctggccagcaagtgtagcatgaatctgcagtagctccatcactgacttcaccttgtatacaacgtataaagaaggaatcttgaaaagtaaaatgggatcagtgattaggtttcaataggtcatttgtagcccagtctgatgaaagtaggccataaaatgcagttataacactaatgatagcaaaatactctatattccacattccatgcaagtactgtcccctgttacagtcttggatctcactagcattcctaacttcaaccaggatatatgttattttttttctgagtcataggttgtgaaaacttctgaatggatgaaagaatgtattttcaagggatgcgccctagatagctcatctttttcattatcaatatgagcttaaggaaattattcaacctctgaagttcacttttcacatgtaataaaatatgggtagcataaaagagttgtgaaattttaatttgataatgtgtctaatacttaaaaatatacaagttattataaatagtctttgtcaaaatattttctcttctaaggtccatctggatgatgtaaacagatcattaaaacattcttagctgtatttgaaatgtcaagattgaactatctgaacttaaatctgttgacttttagtttattctctgaaactttaaagcatttgtataatgtattttgaacatatctgtccaatgctacttccctcttactatcgctgtgctttcccttgtctccatccctacttcacatcttccttttttactgttattaataacttcctaagtctaagtgctgtccatatgtgtatgccaggtgtagctaactatgtgtgctcagctgtcaatgggtcaccatatcaacctctctgacccaaatctgctgactttttaagatttttttaaaacaagagaagttattattaacaaaccatacttgtttaccccatcctgttattgaaatgtcttctgtcatactttggtttctgcccagcccctggctacacaatcattttatttttctaccatctcatgtaatcctggtatgttccagctaatatttatacttgctggaattggagtagaatctcaactcaaccaaagcatttatcctacctgaaaaatattcacttgattggcatagtactatgataacagaaagtgtctcagaagaggggaagagtgttttagattataataggaaagagatttacacccgctttggtgatattaccaaacttgcttatagacccaaaggctcttataattgaatgtataaaggttatatatctaattcagtaattaggatactagacatttattgagttttcattatatgataggtgcagtgataaatgcttacctgtatcatttagtttaatcctcacaacagctataaaacttgtttctgtttttatctccatctttaaaaatgagtaaatacatgtacagatatcaacacattaaggtttacatagacgacaaatggaagactgaggtttcaaactgacatgattctagcactacattcctaaacatagtatatggtgtttcttatgtattgtgaatgtagcttctacagaattccagaatgtttgttttagtctaccaggatggtctgaaatattgtctgtttattattttcttaaggcagccttttctgttatttgaacaattaaataggagctgagaatgatgttgaaataaaacctgatactgtatatataaactcaaagcaaataattgtctgtaatatgaatacccacttctcacattaaacatgttatccttaccaaaaataaataaataaacatgagagttaaatgacatcataggtcaaagagatgtagcaatcttctaccaaccattccagttaaacactgcaaaatgcattcttcttggtacctcatagaatatctttaaaaatagatcatatattaggatgcagagccagtcctaacaaatacagaggaattgaaacaatttattttattctagctgaccacaatagaacaaaaccagacatcatgaacaagagaaactacaaaagatatacgaactcatgaagtttgaacagcacacgagcaaatgatgaatgtgtcatcgaagaaattaaaaataaatttgaaacatttctagaatcaagttagtcacaggatatagaacagtcaagtttatactgactaggaagctttctccttgctggctagtttcaagagtaccctgtcagaggatggccatgtgggacatcaatgggaggagaggcccttggtcctgtgaattctccatgccccagtgtagggaatgccaggacagggaagagggagtaagtgggttggtaagcatgggggaggggggtggaataggcggttttcagaggagaaaccaggaaaagggataacatttgaaatgtaaatttaaaaatacctaattaaaagaaaagagtaccctgtcaactgtgataatgaccatagtggcaagatatgcacttgggtgcaatagtggcagaaattttatgtgcataacatgtgctttctgattggatttaagggagctccgtgggaggaagcacatgctttatattaaaaatgtggctgtggtagtttgaagaggaatggcctccataggctcatatatttgagtatgttaggtatttgacagggatttttaggaggtatggcctgttggggtaggtgtggccttgttgaatgaagtgtgtcactgggtgtgggctttggagtttgcatgctcaagctaggcacattgcacagtgtcatgctcttcttcctgctgcctgtgaatccagatgtggtactctgagctcctgcagcactgtctctgtagtatgcaattatcctttttgccatgctcataatggactaaacatctgaaactaaaattcatctttattaagtgctttccatcataagaattcccatggtcatagtgtctctttacagtattagaatagaacattgactaagacagtggtcaaaaagccaagttcataggcctcaggaattaacctactactattgttttgctaagttctcatagtatccaactgcctctaaattcttatttccatagctgtagattagtgcaactctaagacctcatcagaaaagtttctttgtgcagtgggtggtagttaatgaagaatatcaaaagtggtcaaagtgcagaaaataactatcaatggaatactcagccacaaatggggcatctaagtcacacaaaatccccagtgtacaatgtacaaggacaattgtagaagagaggacagaaagattataaagcaagagtccagaggagacctgagcaaaacagtgtgttctggataggacaggaccactgtactcatgaactcacaggctctgtagttggttgcacaaaatcaagccagtcaccattcaagcatgaagtgagttcttgagcctgtacccctaactgagtagatggcttctgtgggaggagggtcagttttatttaagtgtgtgtgactctacttaggagacagagacagtgtctacataatgagttttaggccagtcacagctatgcagagaaaacctttctcaaaaacataaataaataaataaataaaaaataagaacacaaagggggagaatttgggtgtagggatgtgtgtggtgggagttaaggggaggagttgtcagtgaatatgatcaaaatacattgcgtaaaaattttaaagaataaaatatgctttaaaaaagcaaaggaacagaaatgatgatttaatgattgagaacacttgctgctcttaaagaagaactgggtttggattctgacaccaacaacgggtggctttcaactcctctgtgggcacatgcatatttgggaacacacgcacgcacgcgcacacacacacacacacacacacactcacacactttgtatatgcccagtgtactggctagttttgtgtcaacttgacacagctggagttatcacagagaaaggagcttcaggtaaggaaatgcctccatgagatacacttgtaaggaattttctcaattagtgatcaagggggaaggccccttgtgggtgggaccatctctgggctggtagtcttggttctataagagagcaggctgagtaagccaggggaagcaagccagtaaggaacatctctccatggcttctgcatcagctcctgctttctgacctgcttgagttccagtcctgacttcctttggtgatgaacagcagtatggaagtgtaagctgaataaaccctttctttcccaattgcttcttggtcatgatgtttgtgcaggaatagaaaccctgactaagacacccagggagtggcactatttggaagtggccttgttggagtaggtgtgtcactgtgtgtgtgggctttaagaccctagctgcctgaaagccatctagctgccttcagatgaaaatatagaactctcagcaactcctgtaccatgcctgcctggatgctgtcatgctcccaccttgatgataacagactgaacttctgaagtcagtcccaattaaatactgtttttataagagttgcctcttataaaaacatggtgtctgttcacagcagtaaaaccctaagacagaagttggtaccagggactggggtattgctgtgataagcctggccatgcttttatttggaagaatgtggatttgggaattttggatttggaaagcaatggaatcatttaagtggggcttacactagtaggaatacggaagactttgttaccgtgagtgatttgaactatgcagacctggcccaagaggtgtcagtggagaacatttgtgtgtgtgtgtgtgtgtgtgtgtgtgtgtgtgtgtgtgtgtgtgtgtgttattttggtgaagaatgtggctgccttttgccattgtccaaagagtctgcctgaggctaaagtgaaagtgaagagatttggattaattgctttgaaaaaaggaagcctggagggtgtgggggacttttgggttagcattggaaatgtaattgaggaaaatacgtaattaaaaaaaaaaaacagcctggtataaagtctgttgtgtggttactaaagttcactcttatgaagagcattttaatgaaatgtagcaaactgagaaaggaaaaaatacaaaatacatggctcaagtattaaaggagcactgggaaatagaatcgagctgaatcctatgttctgggagataacagattaagggagtgggactttggggcaagatcccacccagctaagtttagatcaaggcatggttgtacatacctttaatcccaggagacaaacacaagcatatttaaaccatgatacatataaattctaaattttgatttgagactataatctggagtagtcaatgaagataggaatggaggaaaggatcagtgggaggctttaaacaaagctctagagaggggtaataggacccaggtgctacaaagcagacactgaggaaatgggtacgggcaaaagagtaatacagggggagaaggaggaaggacagagaaatagcactaaggatatttgaagaagctataggtaaacatttttatgagcttatttaaaaatgcatgttgtattaacctctggccttcatattcatgctacacacatgcattgtaccaatatgtacagatacacacatccacatacatataaaacacacacacagagacagacagagagagagagagagagagagagagagagagagagagagagactccaccagaaaaccttttagatctgactaacattaacacagtgattcttaaccttcataatgctgtgaccctttaatacagttcttcatgatcgggtgccccccccaaccatagaattattttcattgctactttataactgtaattttgctattgttatgaatcataatatatatctaatatgtagaatatttaatacacaaccctcaaaggagttatgacccacaggttgagaaacactgctttaacaagttgtcagtgtacaaagttaacatataaaacatagtaggcttcttatatttataacaaatatgtttagaaataaatcagaaaagcaatttcattcacagttgattcaaacaaagaaaatatcttggaacaaatttaataaagaaagtaaacaacctctatactgaaaactttaacatactgaagaaattgaagataataccagataatggaaagacctcccatgttcatggattggaagagttaatattgtgaaaatatctagacaaccaaaacacctatagactcagtatgatccccatcaaaatccctatgccgttcttcatggaaatagaaaaattcttaaaattcataaataaatgaccatggagagttaaagcaatcctgagcaaaaagaataatgttgtgtttatcaccatacctgatctcaagtaatattatcaagtcatggtaacaaaccgagcttggtattagcacagaaacaaatcaatggagtagaataacggatccagatatgaactcacacagccataaccacctgatttttgagaaatatgtatacatcatagaaaagacatcttttccaacaaatggtacagggaaaactggatatccacatgtagattaatcaaagtggatccttatttcatcccatataactatcaactctgaatcaagcactgaaactccgaagctgaaaacataggggtacaaataaggactttcccaaaagcgtaaaatcactcaggaaatagtaccaacagctgacaaatggggttaaatgtaattacaaatcttctggactgaaaaggaaaaagataattaagtgaacagatagtctatagagtgggagaaaatctttgcacactacatgtctggcagatgattaatgtttagaatatacaaagaacaccaaatatgaaacaagaaatcaagcaggctaatcagttctcaaaagataaaatacaaatggccaaaatagtacgtattcacttgtaagtggatattagctgctaggcaaaggataattatgcaacaaatccacagacccagaaaggctgagtaacgaggagggctcaaagaagaatgcatggctctccctgggaagggaaaatagaatagattttttgtaggtgtatttggggcagatggagatgggaacaggaggggtcatgcatggggctatagagggagagattactgtaggagttagagggctcaaagacaccattggaacatgatccacagaatcaactaagcatggctcataggggttcacaaaaaatgaaggggttcaccaaaacaaaaaaaaatcactggattctgtatgggtcagagctcggtcctctacatatacattatggttgtgtatcttgtcattcttgtgagacttctaacagtgggagtaagtgtgtctctcagtcttttgcctgatctttggacccctttcctcctactaggttgcttcatcaagccttgatatgagggttcgtgcctagtcttattgtaaattgtttttctatgtacagttgatatccctgaggcctgctattctgtgaagagaaacagaggaggcttaggtctggggaggaggggaggtagagggtactggaaggagtagagggagaggaaactgaggttagatgggaggcagagggccggagggacctgaatgagagaggggagggggaaggaaaaagggggtaggatcaagtatcaggggagacaggagaggatcccagagatccaggagaatgaatggaaatatgcagcaatgtagggtgagggatgggggaaccactagaaagtcccagacaccagggatgtatgtgggaggctctcaggactcaatgggggtgacattacccgaaatgccaaagggggatgggagatggaacctgaagagaccacccccagcaggtagacatggctcccatttgaggcagtgggccacccaccaatcttcaaaatttttgacccagaattgttcctgtctaaaggaaatgcagggacaaaaatggagcagagactgaaggaaaggctgccagtgactgacccaacttgggatccatcccatgcataggcaacaaaccctgaaaccctgacaatattactaatgccattgtccttgaagacagaagcttagcatggctgtcctgagaggctctcccagcagctgactgactgagacagaggcagatacagccaatcattgcactgaggacatggacctctatggaagagttaggggaagaactgaaggagctgaaggggattgcaaccctgtaagaattagaacaatatcaactaacccagacctctcagaactcctagagactaagcctactaccaaagagcatacatgggctggtttgcagcccccaggacatatgtagcagaaggctgccttgtctggcctcagtgggaaaggatgcacctaatcctgtagagactagataccacagcgaagggggatgctggggtgaggttgggtggggaacaccctctcagaggcaaaagatttgaagagggggttaagaaatctgggaggagaacctggaagggggcaacatttggaatgtaactaaattgaataattaaataataaaagaagaattataaaaaaattaataaataaataaattaaaaaatgaagttgttctgggagacttctcttatagtgtatgatcacagagaggcctctcaactctctttcttgtgcattgattaataataacaatagtaataaaataataacaacaacaaaatatccaatctaaatagccttcagagaaataaaaaataaagttctatcagaaattcattaaaatacaacaacaaatgctggcaagggtggggacaaaaaggaactcataaacactttgggtgggaatgtaaactagtccaacctctatggaagttagcatggaggttccttgagaatctaaaaatagatgtcccatataactcaactattccatgtggtgatttgaataggtttgcaccccccacccccataggctcatgtgtttgaatgcttggcctatagggagtagcacaattaggaggtgtgaccttgttggaatgggtatggccttgttgaaggaagtgtgtcactgtagaggtgggctttgaggtatcatatataagctcaaggtggaatcagagtcttctcctggctgcctgaagaagataatctcctcttagctgcctttggatctagatatagaactcttgactcctccagcaccatggctgcctgtacggtgctatgcttcccaccatcatgatgatgatttaaacctctgaaaccataagtcagtcccaattaaatgtttgcctctataagagatacttggtcatggtgtctcttcacagcaatggaaaccctaactgagacattctactggaatttgtccacggaactccaagccagcatatcatttgaatatcaacatttattgtattactgtttactataactaagttactaaactaccaacatgtctattaataggggagtgggtaaataaaatgtggaatataagtgcaatagacatttttttcaaccataaagaacaaagtcatactctttgtgcggaaaatggatacagctagagatcttcttcatattaagtgtactattaagacacttcagacaatttcagaaagacaaacattgcacacgttctcacagtttgttccttgagtatatagatacacaaaattctgataatttaacattttattgaattaattttattatatttgtttatttatgtgagtgaacacatgcattgcacaatcacacgtagaagttggaacatagcttttagcagtcagttctctccttttgtgtgggttccaagtattgaactcagttgaactaactcagtattgtaggctcagtagcatgtatgtttgccaactgaacaatctcactgccccccaaaacaaataaaaaacaccctgatactttttaacaatataatcatggagtgtttatataagaggtatttagagatcgtctaatttattttctcaatgttacagatgagttatttaatcctgctgaagacagatgaacaagattttataggactttctgaaattttacttgtttggagcctctagaataactgttctacattcttcaaaaaatgctttcaatatttaaaattgccttttgttattcctctaaacttttctcccatgctaagcaccctgaggttttcattattattattattcctttttaatatgaattattttcaggctggaccattctggacagccatcttgatacccagttctgattaattatttccttatttaaattgcagtatgcaaaactaacatccatatgcttcatatattgcttatacagcttaagtcacttattaagagatttctctagtaatgttagtatagactgctgatgctatagactgtcctgctctgtgactctttctctttcttatcatcattattttaaacagcaggtatatctgaatcatagttctgaacactgatttaataattgttttctttagcatggattgctaatgtcatgattagtctattttcttagacactggtttattggaaaaaatgagatgggaggtaaaattgtatacacattttaattcttctagctatattgattgattaaattactttttaatttttttaaattttttttccttattttaaaaatatttttattacatattttcctcaattacatttccaatgctatcccaaaagtcccccataccctggccccactcccctacccacccattccctctttttggccctggtgttcccctgtactggggcatataaagtttgcatgtccaatgggcctctctttccaatgatgggcgaatacgccatcttttgatacatatgcagctagagtcaagagctccagggtactggttagttcataatgttgttgcacctatagggttgcagatctctttaactccttggacactttctctagctcctccattgggggccctgtgagccatccaatagctgactgtgagcatccacttatgtgtttgctaggccccggcctagtctcacaagagacagctatatcagggtcctttcagcaaacgcttgctagtgtatgcaatggtatcatcgtttggaggctaattatgggatggatccctggatatggcagtctctagatggtccatccttttgtctcagctccaaacattgtctctgtaactccttccatgggtgttttgttcccaattctaagaaggggcaaagtgtccacactttggtcttcgttcttcttcaatttcatgtgttttgcaaattgtatcttatatcttgggtatactaagtttctgggttaatatccacttatcagtgagtacatatcatgtgagttcttttgtgattgtattacctcactcaggatgatgccctccaggtccaaccatttgcctaagaatttcataaattcattctttttaatagctgagtagtacttcattgtgtaaatgtaccacattttctgtatccattcctctgttgaggagcatctgggttctttccagcttctggctattataaataaggctgctatgaacatagtggagcatatgtccttcttaccagttgggacatcttctggatatatgcccaggagaggtattgtgggatcctccggtagtactatgtccaattttctgaggaaccaccagactgatttccagaatggttgtacaagcttgcaatcccaccaacaatggaggagtgttcctctttctccacatccttaccagcatctgctgtcacctgaatttttgatcttagccattctgactggtgtgagatggaatatcagggttgttttgatttgcatttctctgatgattaaggatgctgaacattttttcaggtgcttctcagccattcggtattgctcaggtgagaattctttgtttagctctgagccccattttttaacgaggttatttgatttttctagagtccaccttcttgagttctttatatatattggatattagtcccctatctgatttaggatagttaaagatcctttcccaatctgttggtggtctttttgtcttattgacggtgtcttttgccttgcagaagctttgcagtttcatgaggacccatttgtcaattctcgatcttacaacacaagccattgatgttccattcaggaatttttcacctgtgctcatatcttcgaggcttttcccccactttctcctctataagtttcagtgtctctggttttatgtgaagttccttgatccacttagatttgaccttagaacaaggagataggaatggattgattcacattcttctaaatgataaccgccagttgagccagcagcatttgttgaaaatgctgtctttcttccactggatggttttagctcccttgtcgaagatcaagtgaccatgggcgtgtgggttcatttctgggtcttcaattctattccattggtctacttgtctgtcactataccagtaccatgcagtttttatcacaattgctctgtaataaagctttaggtcaggcatggtgattccaccataggttctttttccttgagaagagtttttgctatcctaggtttttttgttattccagatgaatttgcagattgctctttctaattcgttgaagaattgagttggaattttgatggggattgcattgaatctgtagattgcttttggcaagataaccatttttacaatgttgattctgccaatctatgagcatgggagatctttccatcttctgagatcttctttaatttctttcttcagagacttgaagttcttatcatacagatctttcacttccttagttagcgacacgccaaaatattttatattatttgtgactattgagaagggtgttctttccctaatttatttctcagcctgtttattctttgtgtagcgaaaggccattgacttgtttgagttaattttatatccagctacttcaccgaagctgtttatcaggtttaggagttctctggtggaatttttagggtcacttatatatactatcatatcatctgcaaaaagtgatattttgacttcatcttttccaatttgtatcctcttgatctccttttgttgtcgaagtgctctggctaggacttcaagtactatgttgaataggtaggagaaattgtgcagccttgtctagtccctgattttagtgggattgcttccagcttctcactattttctttgatgttggctacaggtttgctgtagattgcttttatcatgtttaggtatgggccttgaattcctgatctttccaagacttttatcatcaatgggtgttgtatcttgttgaatgctttttcctcatctaacgagttgatcatgtggtttttgtctttgagtttgtttatataatggattactttgatggatttccgtatattaaaccatccctgcatccatgaaataaaacctacttggtcaggatggatgattgctttaatgtgttcttggatttggttagtgaaaattttattaagtatttttgcatcgatatttataagggaaatttgtctgaagttttctatctttgttggatctttctgtggtttaggtatcagagtaattgtggcttcacagaatgagttgggtagagtaccttctacttctattttgtggaatagtttgtgcagaactggaattagatcttctttgaatgtctgatagaactctgcactaaacccatctggtcctgggctttttttggctgggggactattaatgactgcttctatttctttaggggatatgggactgtttagatggttaacttgatcctgatttaactttggtaccttgtatctgtctagaaatttgtccatttcgtccaggttttccagttttgttgagtatagccttttgtagaaggatctaatggtgttttggatttcttcaggatctgttgttatgactcccctttcatttctgattttattaattaggatgctgtccctgtgtcctctagtgagtctaggtaagggtttatctatcttgttggttttctcaaagaaccaactcctcgtttggttaattctttgaatagttcttcttgtttccacttggttgattttgcccctgagtttgattatttcctgctgtctactcctcttaggtgaattttcttccttttgttctagagcttttagatgtgttgtcaagctgctagtgtgtgctctctctagtttctttttggaggtactcagagctatgagtttccctcttagaaatgctttcattgtgtcccataggtttgggtatgttgtggcttcatttcattaaactctaaaaagtctttaatttctttctttattccttccttgaccaaggtatctttgagaagagtgttgttcagtttccacgtgaatgttggctttccattatttatgttgttattgaaaatcagccttagtccatggtggtctgataggatgcatgggacgttttcaatatttttgtatctgttgaggcctgttttgtgaccaattatatggtcaattttggagaaggtcccgtgaggtgctgagaagaagttatatccttttgttttaggataaaatgttctgtagatatctgttaagtccatttgtttcataacttctgttaggttcactgtgtccctgtttagtttctgtttccatgatctgcccattgatgaaagtggtgtgttgaagtctcccactattattgtgtgaggtgcaatgtgttcttttagctttactaaagtgtctttaatgaatgtggctgcccttgcatttggagcatatatattcataattaagagttcctcttggaggattttacctttgatgagtatgaagtgtccctccttgtctttttttgataactttgggttggaagtcgattttattcgatatttgaaaggctactccagcttgtttcttcagaccatttgcttggaaaactgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagtgatattaaggaaaagtaattgttgcttcctattttttgtttgtttgtttgtttttagagttgtcattctgtctttgcggctgtcttctttttggtttgttgagggattactttcttcctttttctagggcgtgatttccatccttttatttttttttctgttattatcctttgatgggctggattcgtggaaagataatgtgtgaatatggttttgttgtggaatacttggtctccgcctatggtaattgagagtttggccaggtatagtagtctgggcaggcatttgtgttctcttagtgtctgtaaaacatctgtccaggctcttctggctttcatagtctctggtgaaaagtctggtgtaattctgataggcctgcctttatatgttacttgaccttactttcttattgcttttaatattctctctttatttattgcatttgttgttctgattattatgtttcaggaggaatttcttttctggtccagtctatttggagttctgtaggcgtcttttatgttcatgggcatgtcattctttaggtttgggaagttttcttctataactttgttgaagatatttgctcgccctttaagttgaaaatcttcattctcatctactcctattatcagtaggtttggtcttctcattgtgtcctgtatttcctggatgttttgagttaggatctttttgctttttgtattttctttgattgttgtgccgatgttctctatggaatcttctgcacctgagattctctcttccatctcttgtattctgttgctggtggttccagatttctttcctagggtttctatctccggtgttgcctcactttgggttttctttattgtgtctacttccctttttatgtcttggatggttttattcaattacatcacctgtttggtcgtgttttcctgcaattctttaaggaatttttgtgtttcctctttaaggtcttctacctgtttagctgtgttctcctgtatttctttaagtgagttattaacgtccttcttgatgtcctctactatcatcatgagatatgcttttaaatccgggtctagcttttcgggtgtgttggggtgcgcaggtctaggtggcgtgggagtgctgtgttctgaagatgatgagtggtcttgatttctgttagtaggattcttacctttgcctttcaccatctggtaatctctgaagctagttgttatagttgtctctggttagagcttgttcctcaggtgaataagttagcctctatcagcagacctgggagactagatctctccttagtttcagtggtcagagtactctcttcaggcaagctctcctcttgcagggaaggtacccagatatctggtgttcgaacctgcctcctggcagaagttgtgttccactcatcagaggtcttaggatcccatgggggatcctatgtgggtccttgagggtgtctggagactccaagggcaaggaaccctggtgctggagtggaccggaagggacttgtgcccctgatcaggccgagttatctgcttccttaattaatgcaatctcaggtcccgcacgattggattggagcagatgctgtgttccactcatcagaggtcttaagatcccacgggggatcctgtgtgggtccttgcgagtgtccggagactctgcgggcaaggccccccagtgctggagtggaccggaaggaacttgtgattgattaaattacaagtaccaacattttccacatttgttattcaaatttttttgaggtagactagcttgtatgccattgacatcaaataagagtgcagagctaatcattacctgaaacctaggtgatgaaaggctttattctccaagtagtgaccctctgactcacataagaatgacctaatatggaagtcaagagcatgttgttttctcacattatgctctttttcttaattctcagaggaagggagaaggtatctatgaaaggaggtgtaagagacaggcaagctcaccagagactgttacagaaaaataaaaactgcagcatggagacaggatcagtttttactgtactattgttacttgtcctttaggaggattttttagtggagaaatcttgaagactagaggaaacatgctaagttaggactttaaatgatgtcccaattatcttgtcacattaatggtcaaaatgcaaattaatatttatatatttatatattgttatttacaaatctttgcccttgacaaatctcagttctgtagaatattctcctgtctgtctatttccttatatgtgagatcaagattagaatatagagattgttttgtagcttccacattatcttctaggggagtctgtttctacttagttctttaaactgctcttaggacttcatgtactaatttgtgtaaattgtgcttacctttgttctttatgtcccctactgtattataatctatttcaggtcagtgtctagctatattttatcttcgttacatccatagcttatgaatttttaaaacttaaatattcattacaatcattttagtgactttctctaagttatgaatttatatattttttgattgtacagtgagaattttatttaagcaaatacttgaacaaggaccaagtagaaaaaaatgaaagaacagaacaaagtaagtatacctgacataagagctgaattagtaaatgtaagaaatgaaaaattatatgaatactttaaaatttaagtagaaaagtatccgtgactattttaagaagtgtgaggatgaggactgaaggatatgatttcaagataagtgaaaaatggcttaattaaggactgtagcggtactggaaaggatcaaaattagaaaagagaagacagtgagaagtcagtgtaaaagagcattcaggacatatgactgtaaaatccctaatgatggctgggtaagtttgtgcatgctcgtaattctgcactttagcagctgagacaggaatatcttgagttcaaagccagcaagaccctttctcaaaaaacaaaacaaaacaaaacaaaataaaattcgaccctgtctcagaaaataaaaacctcagtacttaattagtagcagagaaatcacagggaaccatagtggttaagcacacatgtcagagtagctgagctctgccactttctaggtgtttgaaattgatcagattagttttctttgcctttcattccctgtttaagagaatgggattaatagtgcctttcccaggatctgttccacagatcagatgaggagatgcatgtcagtgtaatggtgtaaacatttagaaattagctgttgcagtttcagttgtatcttcaagtttattttcagtagggaactgaattaagtttgattcaataattaagtgataatgtatgtataacaatttatagtgttttccaatcgagtatatcatttggtccctatgtcactttaactcaccagaaccatcctttggtggtttgactggtttgggcatctgtgcagaagagctgttagtctagagtttaaatggttaagcagccagagaaggagagttgggattaccaatcctctcacctttgttgttttccaccctctcatttcctttccacaatcattttgtttggatagaggtaaactttagtcaaaatgcttaccagagtatgagacatagtcactttgtcttttcttcctatttctgtcacccacacacagtgttttgagcagcactaatatggagcaatgttttagaatttatgtgcggagtgttgtctttgaggtttggattaaaagcatcagtgaaaccaaaggaaagtaatcaggcacataattgagcaggtggaacaaatttgttaactttgctttgggaaaacaataactgttttttaagtattaaatcaaccttaggttccatgatccttaataagaatgggaacaagggagatgataatgcattggtttctgaagacatcagagactgtaagccttgcatctaatatggttgattccaattgggggagggtgtggacaggggatgcttgtcattggctcttctataatgcagatgtttcttcaagagaaatatttatcttgtgcgtgttgtcatgagatatttttaagatatcataaaacaaggaatttgaagtataagctcaaaatgtaatgtgctacatagatgaacataatttcttttaagtattgatctttaaaactgagctggacaaatatatttagcataggatttttatttgaaaagattgatttttcacttccgttcttttaaaagaagagacttaaaacatcagagaatctttgaattagaacagacacaaaggtcatccacctcacgtccttgctgtctttgtgaatcagctttgcttgtcatcatcctaaacttgaaatgtgtcagtaatggagaacttgacctcaccagagataatgcatgtcatttgtaggctgatttagttgttataaaatatctttcttattaaattctacaggcataaattgtcttccatatgacggccaatgactagaactcccctcaattttctctaaccccaccctcaagcctaagcatgttatttctactgttcctttattgctttgaatctgtatatttatgcatcctctcaactgtgagctccttgagggcacgggccacatcatatcttcgaatgtgtctggtatgtaaaagggtttttgaatggagaacaacatagtattcaactccttcactgttcaagctactcttgtttgttctctgacttgcctgacattaaataaatatttattaaatgtcttatggtatgagacactgccagcatttagctatacagcagttaaagatatatgggcttcaagtattagatataaacaagaaaagggcaatgcaaaacgaggtgattaggatgtggtagtatcctatgtacattaggatgtatatattatatagtttccaattttgttgttaaaataaggaactattctaagtgtgctttgactagtactacttaacatatattttacttggattcatatctgcttaatgtggttttaggtgataattgcttctaaatactagtacattattgtttaatcattcagtaagaatctatttagcttctatcatgtatgatgagctgaatcaggtattgaagctataacaattattagaaatagatacactagtaagctaatgaaagaaattctcaaaacagtttaactaattttgtattctgttctctaacgagacttctgtattatatgtatttgcatattatacatatacatctaagcaaaatcaacttgtatttgtctttgcttaagacaaacacaaagttttgttccatactataattctgatgtgagctgaggtgtaggaggatgggctgggaagaaaccaacaaacaacagcttcatatgcagtacatctagaatttgtcagctggaagcaaatacaaaagatgaaggaacagaagtgtggagtggctgctctgttgttatcccatttaagtggttagaaaggattcagagaaaaatagcatctgtaggaaatgggtaaagccatgtagacagttaagagatacagctatatggagaaaagtgtgcaaaggtcttaagtctagaatgtgttcgatgtgtttggggaatcctgcaacagaagctgtgataagaaatgaaatttgatgtcatggtgatttgttgagtgttctattaagtcataattttcttttttaaatttcttttttattagatattttctttatttacatttcaaatggtattccctttccttgtttcccctctgaaaaaaaccctccctctatctcctcgcccctccccctactcaccagcccacccactccagattcctggcattcccacacactggggaatagaaccttcacaggaccaagggcctctcctcccattgatgactgactaggccattctctgctacatatgcagctggagccgtgagtcccatcatatgtactctatggttggtgggttagtccctgagagctcttggggtactggttggttcatattgtttttcctcctctgaggctgcagactccttcagctccttgggtcctttctctagctccttcattggggactctgtgatcagtccaatggatgactgtgagcatccacttctggatttgtcagacactagcagagcctctcaggagacaggtataccaggctcttgtccgcaagcactttttagcatctacaatagtgtctgggttaggtaactctatatgggaaggatccccaggttggacagtctctgagtggcctttccttcagtctctgctccacactttttttctgtaactcctcccaagggtattttgttcccctttctgagtaagacagaaatattcacacttggtttctccttcttcttgagcttcatgtggtctgtgaattgtatcttgggtattccaagcttctgagctactatccacttatcagtgagtgaataccatgtgtgttcttttgtgattgggttacctcactcaggatgatgttttgtagttccatcaatttgcctaagactttcataaattcattgtttttaatagctgagtagtactccattgtgtaaatataccacattttcggaattcattcctctgttgaggtacatctgggttctttccagcttctagctattttagataaggctgctatgaacatagtagagcatgtgtccttataaccagtaggagctaagacgaaaaggatgggccatccagagagttggagcatcttctgggtatatgcccaggagtggtatagctgagtcttccggtagtactatatccaattttctgaggaaccgccaaactgatttccagagtggttgtaccagcttgcaatcccatcagcaatggaggagtgttcgtctttctccacatccttgccaacatctgctgtcacctgagtttttgatcttagccattgtgactggtatgagatggaatctcagggttgttttgatttgcatttctctgatgactaaggatgttgaacatctcttttttttagtttttttttaattaggtattttcctcgtttacactttcaatgctatcccaaaggtcccccatacccacccacccccaatcccctacccacccactccccctttttggccctggcgttcccctgtactggggcatataaagtttgcaagtccaatgggcctctctttgcagtgatggccgactaggccatcttttgatacatatgcagctaaagacaagagctcccaggtactggttagttcatattgttgttccacctatagggttgcagttccctttagctccttgggtaatttttctagctcctccattgggggccgtgtgacccatccaatagctgactgtgatcatccacttctgtgtttcctaggccccggcatagtctcacaagagagagctatatctgggtcctttcagcaaaatcttgctagtgtatgcaatggtgtcagcatttggaagctgattatgggatggatccctgcatatggcagtcactagatggtccatccttttgtcacagctccaaattttgtctctgtaactccttctatgggtgttttgttcccatttctaagaaagggtaaagtgtccacactttggtcttcgttcttcttgaatttcatgcgtttggcaagttgtatcttatatcttgggtatcctaagtttctgggctaatatccacttatcaatgagtacatattgtgcgagttcctttgtgattgggttacttcactcaggatgataccctccaggtccatccatttgcctaggaatttcataaattcatttttttaatagctgagtagtattccattgtgtaaatgtaccacattttctgtatccattcctctgttgaggggcatctgggttctttccagcttctggctattataaataaggctgctatgaacatagtggagcatgtgtccttcttaccggttgggacatcttctggaacatttctttaggtatgctgctatatctactcatttgtattttgacctttgtaaagggttttaattttaatttgtattccagattttattgcattgtattacagccaatgtagtatgctaatctttacatctagtaatcctaatgttaatgttgtaatttggacctttaccattcttcaaattctcatatcttgaaggattggtctcaagcactattgggaaatgatataactttttggtggtgaagcctagtggaagtaaatgaaatgattaagagagtgtccttgaatagatttttagaccaatggctccccactccttgccagctccctgctgtcatgaggtgaggagatttactctactgtgtacatctggccataataatctgccacattttaggcctacaaacagtagggtaagcaacagtatgttaaaattttgaaattatgagacaaaattaatattttcttcttttaaattatttctttcaggtagtttgtctgaggaagggaaagatgattaatataagtagctacccctttttcatttaggccatatgcaggtttagtcaatgtgactttgtttgctatataagtcattaatagaaatcttgaaaagggtgaacttctcttgtttggaaattaaatttacatttaatctggaaatcattatttggaatatgctttttgaaataccacttttctcagcttcaatggagcagattaatttttattctttctgtaagtgtattatgaaaacctaccaaatatattcctaaaatcaagaaataaaaacataacttttacttggtaacttttatgacaaagaggaagaaaggagcaaaagaactccaccatttgctattggttgttttgttgaactttgtcattcttggcaacttgggtaagatgaaatatcaatttgtaatttgcatttccctgttaatacaggaaaaatctccagaagcttgtgagccagctagcctggcagatgtagtggcaaaaaggaaggaaggaagggagggagggagggagggagggagggagggagggagggagggagggagggagggagggaggggaggggaggggaggggagggagggaggaagaaaggaaggaaggaaggaagacaggaaggagggaggaaaggaagacaggaaggaaggaagacaggaaggaaggaagacaggaaagagggaggaatagtccctgttagggactatgaacaacatttgagatatttcttagacatttttttctcttgttttgaaaaaaactctgctcctttcttaggtcaatgctttgaaggagtttggttttttgagttcttcatatactctggatattaatcctttgtcagatgtaaagctggcaaaaattctgtgccattcagtgtgtttcctcatcacgctattaattgttcctttggctttgtagaagctttttagttttatgaagtcatacttgccaattgttggccttaattctctggtaaatggagtcctattcaaaaggtccattgttacgcctctattgcataggtactgtctttgttttcttctagcagtttcagtgtttcacagtcaggttgctgatccatttggagtttttgtatgagatgatagatatgtgtataacttctttcttctgcaggcagacatccagggttttcagcactatttttttaaagatgctttcttttgaccagtatatgttttaggcatatgtcaaatattaaatggctaaaattatatgtactcatgttttggtcttttgattttgttaattggtctacatgcttatttttgtgttgatactatattatttttattaaaatggttccttaatatattttaaggtctagaattgtagtccttctggaattgttctcttttgtctgtgttattttggctatcttgggtattttgtggttctatatggatttatgacagtttttttctatattgtgatgagatgggtgttttgattaataatatatataaatagtttttgtaatatggctattttaacaatattaattctacctagctgtgagaaaaggatgtctttccattttctggtgtttttttttttttctatttctttcttcagaagtttgaacttttcattgtagatgtcttccacttccttggttatgtttattcctagatgttgtcttttcttttaggctattgtgaatgggatgctatccatgatccctgcatcttggttgctggtgtataggaagctatttatttgtcctgttgattctatatcctgccccattgctgattttttaaaaataatttctagagggataaaatggtatcaaaaagatagcattttggttctgatagaattttgggaatctctcacatatgacatatcatctgcaagtagaaagagtttgacttctttccgtatttgaatccctttagttttcttctttgtcttactgctcaagcataatactgaaaggaagtgggagtggggatactggacatcccttttctagttcctgactttggtaggattgcttcaagatgtgatcatttaggatgatgatatctgtgggcttctctttatatagcttttgttatgctgaggactgttctctgtagtcctttattctctaggatttttatcatgaagacatgataggttttgtcaaggacttttttctgccttgatgatcatatgattttttttctttgtgctcattaatgtgttttatttacatatattgacttgcatttgttgaagcatccctgtattttcatggataaggccaactttcctatggtggataatcatgttgatgcatccttttttgagtattttgttaagcccttttgaatctatgttcatcagagatcttgtcctgtaatttttttgttgtgttttttttttttattagcgtgactagcttcatagaagggatttaggagtgcttcttttgtttctatttttaaaaatagtttaagaagtattggctgtaaatctttgttgttttgaaagaattctgctctgagttcatctggacctggcttttctttagttggagaattttttattttcatttccatttccacatttattatggatcagtttaggttgttgaattattcttgatttaattttggtcgtttggctgtatctagaaatttatccacttcttttaggtttctaatctaatggagtagagtttttaaaacaatattccccatcaatattctgaatttctttggtgtctgttgtaatgttttatctttcactttaattctgttagttctctttctttctttggttagttggcctgaggttgtgtcaatctgctttatcttctcaaagaaccggctcttagatcccttggttctttgtattattttctttgcttctattttgttcatttcttctccatcttttattattccttgcagatgagtgggtttggatattgttttccttactgtccatgtttttgaattatatcattaagctatttttttcactccttctgacttttcaatgtggacacttaggcctacaaataaaccttttaggtctcctttcaatgtgttcaacaagtttggctctgttgtgttttcattttcattttattccagatcatttttttcaactcttcatttctttttatcaattcactattcagtgatgagttgtttaagcttcatgagtttgtgtatttactggaaattcctttgttatcaattgtacattttattgcgtagtgttcagatagtatccaaggaattatttcaatattttttaatttataaaagtatgttttgtatcccaagatatggcctgttttagagaagcttctatgtgctgctgagaagtatgtgcattttggggtgctggagtgcaatattctatagatatctatcaagttcatttgctatatgatgccatttatttctgatgtttcagtgtttagttttttttctccagatgacctgtctaatggataaatggatgtttaaatcatgtgctattattaatagattgatgctaatttgtgtctttaaataaatattgtttttttaaatgaaatctaagtgccccagagtttggtgtgtgtacatacatatatatatatgtacacacacacacacacacacacacatatatatatatatatatatatatatatatatatatatatatatatatatatatatgcttaaattgaattgaaaatttttgatgcagtttacgattattttttaacttccatattctaggattcatttaggtaatatcattgacagtcattttttctggattggtagatattggagagaagatatgggcttgatcgttcatgttgtttctatttttgtgatgagatctgggcatttgaactttttttttttttttttgctagttttgtgtcatatgaagaaagcagtttggtcctgaggagaggatgtttgagtaggttggctctagaggtttataatgacttagaaggaatgaaattgtgtggacacaggagacaggtgtgtaggatgtgcttcctatttcaagcctggagtgttggtagatatagatctgggtttgggagagtgtacatagaggggaatatcaggcataatcactagattaggccctggagagggacttgtagtatcttggctgggtcatgtgcatgtgtgagtgagtatgtatgtatgtatgtatgtatgtatgtatgtatgtatgtatttttcctgaaacttgtgtgttaattttgtatctttccacttttcaggaaatgtcagctctaacaattttctgatggagtgtttaggttctcttatgtatacaatcatatcatttgtaaataaggatactttaacttcttcccttcttgttagtatctcctttatttctttcctctgtcatgttgctatagtagacttctagcactatactgaatagtaatagagagactctacacctttgtattcaacctgatcttagtagaattgcctttgaatttttctccatttagcataatctggctataaattttctgtaattatcttattatattgcctctatttcttgaatttttagggcttttatcataaagagatgttggattttgccaaaggccttttctgcacctattgagattatcctgtgacttctggccttaagaccatttatgtgatgtattatatttatttatttgcagatgttgaaccatccctgcatctctggaatgaagccaacttgatcatgctgaatgattttctcttgatgtaatcttgaatttggtttgcaagtattttattgagaacttttttcctctatgttccttaaggaaaattagcttttgcatttttggttgtgtctttatctggttttaataacaaaataattctggctttgttggaagagttctctactattccttctcctttatgttatggattcatttgaggagtattagtgttagctcttcttaaagttgggtagaataagcagttaatttatctgggcctacattttggtaggtgaaagatctttttaaattactatttcagccaagttgttttttatagatctactaaaattatttagctcatttggcttaactttggtaggtcatatgcatcagaaatacacccatttcctttatgttttccaatataatgaaatacaagtttttaaggtgcatgcttatgattttctgaatttcactgacatctattgtaatctctcccttgtttctaatttaattaatgattaatttgggtctttgatttctctattagtttgtctttgtctttgcctatcttgtctatcttattaaagtgtatatagactttttgtgtcattgattttgagcccgtttttacccttgtttctatcatttatttctgccctgatatgactcatttatttctacatactgattttgagttttgtttattcatattcttctaagtaccttagatgtagcattaagttatctgttcaaggtctctgtggtttttaacttatagatacttatagctgggaactttcctttcagaactgctttcattgtatcccattggttttggtctattgtattttcattataattcatgtctagaaaatttgatcttctgtttgatttcttcagtggcctagtcattattttgtaatgtgttttccattctatagaagtttgtgtatattctgaagtttctcttgctgttgatttttagctttattccattgtagtagataggatacctgaagttatttcaattttactgtttgtagagacttgccttgtatagtaatgtttgatctattttagataaagtggatggaatactgaaaagaatgtgtatttcagaatttgaaaagaatgttctataaataactattaactcttgacgtttctctgtttactttttgttgggatggcctgtttcttggtgagagtaggataatatccttaccctctattactgcttttatatttgtttcatgaaatagggtatatccatgtccaatgtatagggtatatccatgtaggcttagattgtaatatcttatgtgtggatggattgtcccttttgtcaatatgaggagaccttctttatttctgttgagtaattctgatttgaagtttgttttgttatatatcagaacagcaacatttatcttaatcttagttccattttcttagcatatcctttgttttacttttttcacactggagtaatagctttctttaacagctaggtgtgtttcttaacagaagtgctctcaatcttcttttgtctaggtcctctattttatcatcaagccctgatgttgctttttacttgatgtattgttcaacttataatgctttcccctgaatcttgtaattagcctgttgagttttttaagtccattttcatttcagggcaagttcttttaaatgtttctgcttgttgggttcgttttttaaatcctgaactacctttgctttttcatttagccttatatttgtgttttctttaagttcattgtttggtttttgtcttatttaaactccctgattattcaatgacatttatgattgattgttcaagatctgtgtcctagagtttatgaaggtagttatcgttggagaacaatttttaggtttagtggaactggggagagagagtaatattttgatatttcatgttattttttgtttttgtgatgaaacctgggcaactggatgtctttgattgattgtctgatgtggacacagttgtgcatggcagttgggaatggtatggatggggttcctcaaattgcagtgggacattgggtttaggaactgggtgccatctgaagactgggatatgtaaacctccaagacataactttgtgtgtgtctaatcctacatttaattctatcagcctctgggttttgtatgtttgaattctgctgtttgttacacatacagttagggcattgtcttttattactttctaagttgtctttattttgaagttcattttatcttatatcaatatagccatttttctattaaaatgttaatgtactggacaaccagttggtatgttcttagctgtctagtgccaaacagtcagccctaaaaccatatgtacataacattatgtggtttaaaatggtacattaaggaatatatgtatatgcatatatacatgtatatatagtcatgcaatatcaattagtgaaaaaaagaggacatgaattgggaggagagtggggaggggtacataagagtatttggatggagtaaagagaagagagagatggtgtaatttcaaaaataaaatttaaaaaaatacttaaaatgtaaaattagtcaccaaaaatgttcatgtagtattctttccgaacaattttattttgaattatctatttcactaaatttgaaataagtttcttataaagaacatatatttgagctgggtgtggtgatacatggctctattcacagagctttcaactaagcagaaggatcacaagattgtgctctgctagagctatgcagaaagttcagttgaataggctacatagcgagattgtgggatacaaacaaagaactgagaagtctaatgcatacatggtcttttctctttacccatctgccagtccctgtcttttaattggctcattagtacggtttacacgtatgaaaattattgacatgtagagatgctcaagtgtgctatttattattttttttattgctgtcatcatcatcttttctgatcttgggtcctcagacctaaggttttatcagttagctcttcctggtcttaaactccaagcaagcatttcttccttccattagatgggaagcagggcactgccacaaccccaggattttatttatctgcttgttttctctatgactatatctccttatgtcatatgtatatgtatgtatatatgtgtgtgtgcatgtacatattgcttttatcaatagttattataatatctatgatactcagatatatgtatgtctgtgtatatataccatatataatataggacacatatattttatacacatatcatatgtatatacatacatgtattatatatgcacacatcagtatatatacatatatgtatatgtatatatatgcaaatatatttataaatacctacaaaatacatatatacacacatatgtatttatacacacatacatatacacacacatatatatgtgtattatagtagtcatgttgctattaatagattattatatgtatacatatatgtatacatattcatatatacaatgtgtacatatgtgtacatatatatgtatgtatatatacatataatactagtgaattgatacatttgggcatctaattacaacataatatatgttgtttttcattttttaatttaaaatttatatttaaagtatatgttgtacacacacacagacacacacatacatgtgcatgtgtattccctagtatgcatgtggcattagaggatgtcttgtggaagtaagttctctccttccactatatagattccaaggagagaaatgtcatcaagtttgttggaaattttccttacatgctgagccattttataatatttttgtcttgagtattagatggtattataattttgtttccatggatatatattcttgctgagttttttcttctctatttctggtacttttagattgttcttgttggtttctcttgtgtttcaagaagttcccttgaatgctttttaaggctggttcttctagcaataaatccttttagtttctgttcatctaaaaatgttttacatcccctacactcctaaaggaaatataccagatacaaaaatccatgtttgacagttgtttgctttcacaacatgaaaaatattgttatccctttcccattggcctccactcagaccaaaaatccttagccttttgaattagtgttcacatatagctcaatacacatttcttttggttttctttttacaattgtttgtcttaaaatttaagaatcttaattataatgtgttctggcaagggtgtttttgaatttatactgtttggaattcactcagcttcctagatgcatggcttgtaccaaattttgaaagctttcaagtattgtttctttgaatatgccttcagcaccttatgctttccccctctcattttgaaactctagttatatgaatattgaatactttttaaaatttcttcttaggtatctgagacccctggctgggtaacttttgcactttgtccaaaagtttacttattctgtccttcataatttctgctgtagtattgaatcctccaatagtcttttaaaaatccatcattatatttttatttatatacattttattaggctttgggctcttttatgatgttaatatctttactaaggtgtttattctttccattaatttcaggagagtttttagttggtgctgaaacatttttatgttagctattttaaagttttgtcaagtaattcccagtagagtatgcaagctccaatatcttaggtatacaaagtaagtctcagaatgagagaagagcatttatctccctagctacttaattctagctcttttgtgctagtgctagagacagtgtgcacatctcatgttgtcagaggagtattgtttcatttaggagagaaatgagcccttcctatactgacctctgttgctggcatcagggattcagaaacaccaggtctatttataatcccagaatttgggaggttgaggcaggactattgcaagtatgaggatggtctggtatataatctgttaagacattgtcttacagaacaaacagccattaaaacaattgtacccaccatgtatgagtattctttttctgtgttgcaagatctcttattgttttcctattcccaattcagctcagcctcttgttacccatcaaagttattttgttttctctgtgattagcagagatgaacagagaaaaatactgtcttactcggagtagatttttagaagttctatagtgcctacctataatcatggttacattcaacagcttgaaggcatggctttttagaaaataatcaggagtatgtgtacctctctccagacttctgcccatgtctcattattcacattactgtctagacagtagtttgaaaatcttagcccgcggtcttttctatatcctggaatttatttcattttatttattttgcttccttctatgaatacttcttgtaccctttcctgtcctggattttgttaacagaggccatatggaaataatacaggaattgaatcatttttgtttttctgtctaacattgttactgattgcagtttggaattcctttttattatcttcagtgtatctcttcctgaggctcaggtcatttggacattttaggtgttttgcagatagatgccactcttgtagttatcgttggatagttctttatactcagtccactgattatgtagataattgcgagtgtcagaaaatcttgtatgtggatctcacctgtagcagtctctagagctgtgtggtttggggttgttaacctcggagcttatttcctcacctgtaaagtagaagcaacactgctgctatcaagcagaccaacttcagacttcttatagagattaaacaagataatatgcattaagctaagtggcacagttccttatagagaagaagcattctaactgtggtcatacattttaaaaaccaaggtggtagacaaattttactgttgtttctttggatacctgttgttacttctctgtgattgtatagtcataatttcagttttgagagccttccagttaggttatataaattaaagttctcagggaagattgcatatcttttaaattatgaaatatcatctaattacaactgacactcttaatacagtgctggtgatgattttcttactgagtagtaaatgcaaatattttacagtgcagtctccatggaattgatgtgtaggtgttaaattagcctttctggttaaccatccataaatatttcaaaatacataccttgtgtgggtacctagcttgcttctacatgctgcaaaagtttttgcttgttagacacttcattatgtcttacctgtatttcttgacatattttaagtaagtgtatggttgtagtacatctgcattcctttaaaaaaaatgaagttaccagacatttactttgaatcttctaagtatgcatattattatattttgtacagtatataacatgttttaattcaggtgtttattataacttattgcacctaaaataacagcagtttcaggaaggccaaaaaaggcattattattagaatagtaccagcaacctatttcttccagtacacttttccttgagttaaagctggtaatctttttaatcttggtaaattctttaggtttcatgtttgatagctataattctggaacctcccaaaactaccttaattagaggcatgttggaatgtgtttgaaatttttctgctgtagttgagttacttctggcagtattatgtaatcttaaggatatgcactttctgcagggaatcaagctttcttgctagcttttacttatttttttagtgttccattctcacccctggagagaatagtaatccaaatataaactgtcgttaggcttttgcagatgtttagaactttaggtcttgctaacgctaaccttccaatgttctaccttgtttttgaaggtcagaactgctgttgcaaccaaattgaaatttcactaagttagactctggcaacagaaagctaaatgaaatagtacaaggtctagtgttttgtttcttggtgctttgaaatgccattgtacagtagctacatagttggctttctgtgtgattttttttcatgagctgatttctagatataattttatatgggtgaaaagtgttcatcagtccctgggaggaataaagtatttgattagtagtggggcttttatgctatcctacagaactatagccacaaaaacaaagatcaaacaacctcattcctttggctcaaactacaaccctgcttgagatgttccatgaccactgtgctttccccgtttcttttaggtcactcatggcccaatttgtttttttatttttgaagtttcagatatataatgactttgagttattttcagcccctcattatcttctctcatccctcctagtcttgatgaaacctcagaaaccctcctctttccgagaagggcacatcctactttctttggtgtttatttgtcttgttgagagattggtaacgtttcattatgggtgagggagaagttcaccaggcccacctttcccaaggggatattgattgtcagtagttactgtgggagaagatgacatttgctttagtggtgcagccattgataaactctagttcatgctctagtaagtaacatggcttctcttttaaagaggcttcagttatatagcctaggctgtcctcaaacttgtgatcttcattcctcattctccgagtgctgggttacaggtatgtgccaccctgggttcatcacttggtatttcatagagaacatcaattctggcttctctgtgtgcagaatctttattttctgactgcttccatttgtgtcttgcatagagaatttcttttgtctgccaagccatttttttctggtgtcatcttgaaagagctagaaattttacctccttcattaaactctactggcctgactgtcatggaagagacagttccctgagtcatagatcatgtaaacacttctccctgtcagtttatgtagatgtttagtgttttatgctgctgtcttggtatctttgtgggagagttatatttgttttttttttttttttttagatttttaaaatcacaaaataaagaagtgctttctgactttctggttactcattattagaagtcagtatttaatacattgttcttagatggtaatattgttgggggaaagtatataaatcacttctatgaaaatatataactcatcctgcttattgaacttgcttataggcatcagaaatgatacttggatattcaacttttacattcttgctcatacaatatttactcatagtgttttagaagatttattttacttttctataaatcagtcagatgatacaaagacttgaatttaacacagtaatttttgtatgcatgatgatgttgcctttgaatttataagcctttgactgcaggaaacttaaattttaattgtttcttttttaattttgaaaataacttttcaatagttaccataaatttcttttaaaaatccttactaaactactttatttatttacattagaaaatttgccctgctttctgctctaccctgcctgagttcttcacctcatctcccctgcccccacctctgagagggtgctctctcacccactcacccattcccaccgcacccccaccaccatcccttttccctggggcatcaagtttccacaggattaggctcatcctctgccactgatgccatacaaggcagtcctctgctatacatgtgcctggggccacagaccagcccgtgtatgctccttggtttttggctcactccctgggagctctgaggggtctgggttagttgacactattgttcttcctatggggttgccatccccttcagttccttcagtccttcctctaactcttccatattggtcctggacctcaatctaatggttggttgtaagtatctgtctttgtctcagtcagttgctgatagagtctctcagagaacagccgcgccaggctcctgtctacatacacagtatagcttcagtaatagtgtaaggatttggtgtgcatgcatgggatggatcgcaagttggactagtcactggatgtcctttctttcattctctgctccatttttgttcttgcatttcctttagacaggaacaattctaggtaaaaaatctggagatatgtgggtggctctctgcctcaactgggacccatgtctatttactggaggttaactatctgaacaaaattttgtagaatacagataataccttctacaaacagagttctgcctgacttttcttctttttgtcataacctactctgagcacgatcaaactagtcatgtcccctgctcactactgtacaatattgtacctttgcttctttctgcttaaaggcacctgagtgttttcaaagcaaaaaggggtcaaatttccagaaaaaaaagatgataaattgagataagcccaacattctgtgctatgtctccttcagggcatttgccagtggaagtagtatggacaaagaaaccaagaaactaaacccagagtggtgaacgagacagaaaatgagcaagagtccaacaggcttataggctttagagatacaaaagagagttaagagatatcctgatgatccaaacctgagctttcaaattgccagagaaaaataacacacaatgaaatgaattgagtccaatattttgtattcttttcccttggactagctcctgatgtataagcgggagggacagctgtaaagctcagcagctaagcagagctttcagtaattctgtaatgctggggagacagaaattagagttcagagcctgccaacgagtaggaaccctgaataattatcctaattattcagttgggatccccaaagggctaaagtctaggagtagggatgaactggaaaaaaattccccacagagactaaagtacagatttgaattagttcaatgttggacagaattgaggtggtttgtcccttcctacttgataaaagataagtaaatctctagaggacaacaataatgtattgagctttattaacttttaacatccaatatataacatgaataaacagtcactgggtttaccaggtatattaatcttctaagactggcatgacatagtactacagactggatatcttcaaaattctagaggctgtgtccaactagattcagaatctgtggaaggtactcttcctcattcatagttgaccattctcctgtttgtccttacagtgaaggtattgcagatgtctataaagggattaattccacttaagagagtctttatggctaaaggacttttatctactaataccattgcttttcaggttacgatttcaacatggagaatacaaacatccagtaaacaacaataaaagggaagcaaattctggaattgaggattataataattaaaatatattgattgatacatgcatttagcaataaattagcagctcaagaaaagattgactaatcaactggaagataggtctgtaaaaatattctgactgaagaaccaagcaaaagagttagaaatgtcaccctttcagaaaaaaaagcttgacacaactatgtaactttggaggattccttgagatcaagatttcaaacagcatggaaaagaaacactgctaacccaatctcaggaagaggaggaaatggagggggcaagggaaggagaaacggggtggagggcaaaggcacagagagtatatgtgaatatgagaaaatgacagtgaacccaaacaatggactggcttttataggtatccctgttgggaagccgtggcaaatctactcaactaaattgtagagagaccatagatttacagggtcagacctgggtctacctcagcttcgccttttgctttcttacattatctttgatttgtgattctctaaattgcagtttcctcagatatgaaagaaagttcaattctcttaaagacttattatgctaaatcattgatataaactacaaagtcacatgacatatttttcctttatttttcttagggtgtttacattattttgagctgaaatttatagattctagagacattatctttcctaataaatgttgaaagtttttactccatccattgtgtacttaatgaaaacggaggggtgtctacacttaagtctaggtctttaaattttctgaggttatctttttgctgtgttaatcttagttttggatgtgttaagtacttaatttcattgaatattgttttcttttcttgttgtaaatataattaaatcatttcccccttacatttctgacctccaaactctctcatatactctttcaaagtcatctcctcagttttcattatttttttattcctaaatatctcctgctcagtctatataatgttacttgtatgcatgctttcaagtctcatcatttggtattgaattaccaattggtgtgctcttccccagggaagactgactgttgttccagctttcagcatactttagttgcctgtagttccttttgtagtatttaagcttcctggctccccccacccccatccactttgacatgcttaatgttgttgttcttactcagctcatgtttagtgagtcatcttggtgagacttggtagcttttgactactaggagaaacagtatcatagcaaaatcacagattctctggctcttaaaatctccagacatcttacttcttcaatgatccctgagccttaggtatgggggctttattgtagaagcatccttttagactggactccacaactctgcatttgattggtttggttttctctagtggtctatagaactttccttgataaggcatgatgactctgctcatctatgggtatgaagagaaatatttggaatctagttagggattatgctggtttaataaagtgtcaattaattttcctctgcccactttgaaatatctgttgttttgttcagctcatagttagtcatgttagtgagactttataggtatagcttctgacattactaggagaaatgatatcacaacaaacaggttcccctccaagttccaagacttcactagctctgagtaattggctaggttttcagcaacaggaatgatttccctcttgttaaatagaaagctgctggctactgccaagatatacatgccactattgcatacttagggtaattgtaacattcttgtcattggtgttgttcataggcattatagctgggtaagactgttagttgcttccttctcttagaaccttgcatggcaccttctggaatgatgaaagctactctttggggaggagtcttccaggtcagatccagctcaggtgactctgggccctatatctaaagcacatggtgttttcagcactagggacttgctttccatctctgatggaaaaccaagagcaatagcaatagcatgtatgtttggggagtattttggataagcccaaccaacagctcaaaagaggcttctcatatcttgggttgggatttgttgttgttgttatgtggtctttgtctcttggaaggagttttgtccgtccatatgagaaatttttatttaaatccataattctcaaccttctttaactttttttcctgggatggagagatggctcagtggttgagaaaactggctgctcttccagaggtcctgagttcaattcccagaaaccacatggtggctcacaaccatctgtaatgggatttgatgccctcttctagtgtatctgaagacaatggcagtgtactcacatacatgaaataaataaataaattttcaaaactttacctctaaaattttttcctattattattatttacattgggaccaaagttcccacctctcccaatccatcccccacctccttttgccacccccatccactcctcccccatttctcttcagaaaaaggcaggcctcccatgaatatcacgtaaacatagcatactcagttgaggcaaaatacagcaagcccatagccaacatcaaactcaatggagagaaattcaaagcaattccactaaaactggggacaagacaaggctgtccattctttccatatctattaaacatagtatttgaagttctaggtgaagcataagacaactaaaggagttcaaatggttgcaaatttgaaaggaagaaccctaaccctaaccctaacccctgaattttgggtgtgtacctcccacagctcaggtaagctactgaatgcagggaccagctcttaatcttcttaatgctgtgacccttttatatagttcctcgtgttgtgatgacaccaaccataaaattattttctttgcgatttcatagctgctattttgctgctgcattgttatctgcattttctgatggtcttaggttgaccctgtgaaaatgtcatttggagtgcccacaaaggggtcatgacccataggttgagaaccatgtatgtaaattattatatctatatttatacacagatttatgtgtgtgttatatggtatttttggtaaatagttaatgtcaacttatagatttgacttatttttgtttctaaaagtcaattcattcactcaacgtctgttattgtactatgtgccaggcactgtactaaaagcttgtcataaaagatgagtgatagaaccagtggggaagcacctgaacacttcgaatgtggtaagatgactactacaggagacaaaggcaggcataagtgatgttatttttttcttgggcgctgctgggaacgaaccatttgagccaagtctctaaagattggaagataagtattccatgcagaggatatagtatgtaggaacacaggacaattgaaagattggttgtagtcagggatcaagtattattttatgtggctaggatataggatattaagcaagaaagggggatgtagtgagacatcaagtgtgagtgttgcataaacttggattggcagtaatttggtaatgtgctggagagggtcgtgaagaaatataaagaactgggacgctgatgcaagaaggttctaagtaagaaaggatcagggagaatggcagtggggatggagggttgacacaaagagtaaagcacttgatgctcaagcataattacctgagtttggattcccagaacccacaaaaggccaaatgtattagtgtgtgtctatcatcccaggtatcccactgtgagataagatacaggaaaatcctcaaaaatcatgctagcacaacagcaaagaagaggctattgaagtcaaggagcaaggttaggaccaacagtaaagtttgtcttttgacctccatatgtatgagatacatacacatatacacgcacaaacacagacacacacacacacacacacacacacacacagaaaaatacagaaaaagagggggaagagagggaagagagggagagggggagagattctttaatagcaagtcaaatggataaaaagctccactatgataatacctaaattattttaataaagagttatgataaaattttatgtaacaaggacataaacactacccatcttcatgaaattttatctaatattgaaaaattccataagaactattatattctgagggattcatagagattaagttttgctatctttttaacagcacaatgctgttattgccctgtataagaaatagaaagagtaaacatctaaggtcacacagtgggtagaatgtgagccatcatcaatttctagaacattaacatttatatttagctaccttttaaatatcaccagttggtagtaattgtttaatagcattttaaaacacaatagataattaacagagaaatacttaagtaactccttgttattctccatcttacagaagtaaatattctcctgagtgtatttccttcaactgcaaacatgtttctatattattaccaattctttgtgcacacataagaaatatttctgtattcatgtttataaaactgtttttatattttgtatattatgaatcatgttttatactcattaaattctaacaccatgaagagtctatagcaccatcatttatttttcaattctactgcttaaattgtcagggatttttattgctctctaaacatatttaacaccatactacttctcttcaaacatatgtaaaagtagatgaagtattggattaaatgtttaattaattaaattaaacattattttaacaaattaattagattttcatataacattcacattttatactaaacttattttttgttgtgagtttgggtgtgtgtgtgtgagtgtgtgtgtgagtatcagtattacagagggcaaaggacaacatcagctgtcctgctctatcaatctccatctcatttccttcagagagggcttcccactgaatctggacctaggccgacagccaacatgctccagtgacctaagtggagttcagtttagtgaaaccattttaatttcagaaatcaatacaaagctagtttctttgtggggagtaccaatgtaattgttaaacatttaaatatgactaatatcaagaattaatcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaaaaatgaaaaaaaaaatatcaagaattaaaatgaggcttatataacacattctgtggatatgtaaaaattaaaatgaggtccatctaggcacatagattttacatttagaagaaattgaccatttttaaagacagaaaaaacagagctcatgcttatataactaacaataatatatctagtaaacaaactgaatgtatagatatgactgaatactaaagggtttacatgggctgactggaaatttaaccaaatatttaaataaaattaatatgtagtaaaatacttcaattttagtgaaaatgttgatgagatttgacatatgtgaatgtactataaagataaaaatcagaaaaattgatatctaggagttaagcttattcattttccatacattaaagtagagaagaaaatgcactatatgtaatattcatttttcatgaatgtgttctgctgattttgttctactgatcaaaagccataaaatgtagatcatttttcaccaactaaagcactcaaaacaccaaataatttctttttccaacatcaagcttacactttctgagtacctcttgggtatatgcgaataaatcacagttcctgtcccaaagaaacaatgtacttatgaatgggaaacttgtagtgtttaatgagctcccaaagaggcacaacttaaagattgttaagattggagaggcttttatagacaagagtctggtgtggttgttacacaccttttaatctcagcacccaggctgcacaggcaattggatttctgtgagtttgagaccatcctagtctatatggtgagttccaggacagccaggctcgtagttacaaagagaaaccctgtctcaaaaaaaatccagatagatagatagatagatagatagatagatagatagatagatagatagataatctctttcatttataccttgactgccatttcttggtactaagacaaaatgcttcctctccccataccacaagagctcattcttacattcctatctccataaataacactgaccctgccaattacagtgtctgtcatcttccctccatgctatatatagctctccatgctttaagaaccttcctccaaactcacttccaggagagggccactaattattaatcaatttggtcattcagaagtatttactaagcacctaatacatctaggagctatggatacaccagtgaacaaacaaaatctacctcaaggagctctttcattagaaggaaacaacataaaataagcaagtaagtaaatgtaagaatgtaaatatttacatattatatgaagaaaaataatgcaggatgaattgtcaaacttcatttatgagttgaatgttttgcatgctagaaagacttgcagtagaaggatattggggatttgggaaggaaacctaaagagataagaaaacaaaccatttggtgttagtctatgaggagaggaagacagatcaaaaagcacaaacatcccaagtctagaacatgcttagcaagtttgactggcactaagaacaaagggtggagtggaataaaatgaccagaaagatatctttggacagatcacattaaagactgttgacttcattatcacacaatgggagtaaaatcagcatatgagttgtttttaaagggtcattctagcaattgtatagagatgagaatgacataggcgggaacagtgcagagtagctccaagatgttgatttgtaccaaagcaatagcagaggacataagaaaccatatggaaagtatttatgatgtttagttgatacaattgctaggagactgattggactatgtggggagagagaattgggttataattgctggaacagtgctctcttgttggaaaatgaagatggaatgtaatgcatagaaggaggagctggctttagattaaagcatggacagttcactagagaaacatgagaagaatttggcacagaagcatccaggtgagtaagtatgaggataggaaacctgagggctcagtactgactgctttctcttttgctgcagaaagaaacctggagctaggaatgaaaaggagagatttgaatatgaaatagtcatccaaacatagccactaaatcttaacctctgtatccatttccacccagctggattcattttccttggtttgtgtatgttctcagaagctctttcttcattaaatcctcaccttgaatgatagaaacactcatataagtagtttactaaggagaaaataataaaccattaatttccttataaaggaaacatctacttggagaaatgatgatgtggtctatctactactacctctgtcatgctgctcaaatctccatccccactgccattctccgtgatcctttcttacttggaactttatgtcagcatcccggctctttatatttcttcacgaccctcttcagcacatcaccaaattatggccaatccaagtttatgcaacactcacacttgatatctcactacatccccctttcttgctttataccctgtatcctagccacataaaataaaatctgatagttttatccaaaattgctgtaatccagattggcttcacatttactaagtatcttaggatggctttgcattggttgatctcttgcttctaatctccatgtggtgggtgtatagcaaatccaactgttgtgtagagatttcccaaagctataaaaaccactgaaaaaattattaaaattataaataacaagaaaaatgcatttagaaaagaatacatgttgaatttgatcaaatatattttggacttattgagttgatcatttctctttcctttttatcctgttaaacagtgacaaaaattatattgatttattttgagcattttattaacaagtttcattcacatctacattcacaagtggtgttctcctataatgccttttcttggttttcttattaggctaatacttaattcagatgaaatgggttggaaagttttcctttctcatattttctgcaagtttatgaggggttggtatgatttctttattttaaaatgtttggtagaatttatcaataaaataactagtgcttgaatgtttcttgctagaatttttataatagtaaaccaaagtttaagaaagtcatagaactattcatatcatccctttcattacaggaacccttgatagtttgtgactctgaaagaattcatccattttgtgcaattttaccaatttccaggcacaaagtcttgtcttttaaatttctgtggggtcaagcatggtgcctcttctttatctgatgcttatagtttatatcttctctactgttttcttggttaggttgtaagcgtctcagttttactgccccccccccccaccaccaaaggacaagttagctcttggtttgattaaaatcatgcaaataactgacataaaaattttattgattcctatttttgtctctttctttttacctttggtttaatttcctttttttttctagtgttgaaagttttgggagcttagttccatagtgtcttttcttctaatataagctttagtgttttcatttttaagcactacgtactataattgtatcccagacaatttgataagctaattatttaattactaaattttgatgctatggattgaactgtgggccgtgtgcatgtttgacagcagtctgccactgaactactccctcagctaaatttttattttcacgcagctcaaagtattttaaagttttgccttagaattcttttttgatccataagttatttacatatatgcttttaaatgtccaactacttaagaaataggtgttatatacatttttttctagtttaatttcattatatttaaagaacatactttatatgatttcaattcctgtaaaagtttcccatgtccatttaatgtactgctagtctaattataaaacttagcagctactatggaaaacaaggaggttcctcaaaaaataaatgcagaaagctataatgtaatccagcaatcccaatagagtcttgaaaagatacttcacacccacatttgtaacatgagtatttgcaatgtcaagagctagaagcagtacaaatatttttttgtcaatagatggatcaacaaactatggcttatagccacaatagacttaaaattccactttaaaagagaaagaaatgcagctacatagatggatcttgaaggctttttatattttctgaaataagccaaagattttatgtctccatttgcatgaattaccttaagtagttaaattcatagaaacagaaagtataattatgactattagggaatggggatgaaagtaaagggtagttgtaatctaatgagcctagaatttcagctttgtaaggtgaaaaattccataagatctctttacaacaatatgaatatactactgaaatatacacttccaaaaatggcaaaaatttttaaaaagctttgcattacatggatatttttactgcaattagatataaaataaatcttttttgagatttgtcttatggaccagaatatcatgaaagatggtaaatactctttgtgcacttgtaaagcctgttttttgctcttgtagaatagaggtttttttttttaataaatgtcaattaactgaaattagctaacagcattgtgcagttctctacgcttactgattttctgcctagtcgttttattgattgctgagagaagcgtgttaatatccacaactatagctgtcagtttcccttctcagactttttagttctgccaacttttgtttcatatatcttgaacctctgttgatagttgcatacataatctggattgtgaggatttctagttgaagtgatccttttagtttcatgtgatcatctctgtttatttcagctgatattctgtattttgaagtctactttttattactatgaagtgagctttttatatggaacatgtgattttttaaaatttctatcttcttaaggtatatttattcagatgatttatatttgatgtaatcattgatataattggattttattatctgctttctgattattcttgctagacttggttgtgattttctttctttaagatcactgtggaatatttattagtccattttaatttatgtgttactgctgtatgttacatttgtatattgatgtttgctgtatgaatttcaatccatattctcaatattgcaatgtcatgtttgagttactattgtactacttcaggtacaatatagaagatttaactgaccgtgtggcttcattatcttaccctatttgcattcataagtattttgagaattatagaaaattcaaagtactatttcataacattttgcttccaatagttgcccatattttgaagaacataaatgtaacttgtaacatttgtaagagatttatacttctcttgtattttcattgtttctgattatcttagtttccatctaatacattttccctcacctaaaagaatttcctatatagtttttggccagaatcatcatatttttagttatcattaatctgaaaatatcatttacctttatttatattttaaaagtttttttgagaatgtcatatatgagtgttgtaccttctataatttctatctctctctttccccttccaattcttcttgtgaaagtaatttcactgtatgtaaaagtctcacttatatttgttaagtaatttaaatatgaagttctactatcttctgacttccatttttttctttcaagaattctcatattaatattgttttgagacaggatttctcagtgtaaccctggttgtcctggtggaactcactctgtagtccaggctgaccttgaatttagagatctgcctggctctccctccccagtgctagaattaaaggcatagaccattactgcctagccatctacatataattttagttgttttgtttaagatggaggtctaactatgtaaaaaaggctgaccttaaactccttatataatatataacattttttaacattgtggccatgattttctttgtccatatcatgtttgagatttgttgagtttcttaagcctttaattaagccttttaccaagttttagaaatcttcaattgtaatagtttaggtatattttctatgttcatttcattcttctcttctaggactctagcacatggaagttaaaatttccgatgttattcttcaagtctctcatcatttcttcactttctcaacattttttctttttattaatcttactggatagttcctactgatttatcctaaaattgtcttttttcctgtcatttctatttctaatttactattaagtttatctcatcattttaatattttagatcccttatccctcagttataaattttcatatggttctttttatggtttgctttttctacttaaacttatctagtatgtttacctttattgcatatagcatgattctcatagctatatattagctctctattgctaggttgtgggcaccacctccagcaggaagacaggacatttgtggggttgccatcccacagtcacacctctgacccataattgttcctgtctgaaagaattacagggatggaaatggagaggagcctgaggaaaacaaggtccagtgacaggcctaaagtgggatccagctcaaggggaggtcccaaggcctgacactattactgaggctattcaatgctcacaaaaagggacctatcatgactgtcctctgaaagacccaacaagcagctgaaagagtcagatgcagatatttgcaaccaaccaatggacagaagcagctgacccctgttgttgaattagggaaggctgaaagaagctgaggagaagggcgatcctatagaaggaccaacagtcttaattaatctggaccgctgagatctctcaaacaccaaacagacaacatacaccagctgatatgagaccccaaacacacatacagcagaggacttccaagtctgtgttcatttagagatgatgcacctaaccctcaagagactggaggccccagggagtttagaagtcaggtggggcggtgggtgggggcatccacgtggagacagggggtggagaggaggtgtgggatgtggagcagttggagggtggatgggaaggtggggaatggaatatggagtgtaaaaatgaattacaaataaaattacatcatatatatatatatatatatccctttttaaaacgaagtaaagctgctatgaagaaaaaaagagaaaaaaacaaaatgttatacagctatacagccccatagtacaaagtgtatctgtgcactatgcttcttgttcattacaaagaagtaaaagcttgaaaaatttgaaaaaaaaccaataaataaacaaataaataaataaaaataaattgtgggctcttagcagcttaaaaccttaaaagggccagggtcttagattattgtaattaagttgttgctagagtcacctgaagcttggggtcttctactgacctaacatagttgttgacagaattagcccctggaagctgaaggactgaattcctcaattactaaaattacctgtagtttccttgccacaaggccctctcaagaggcatttcacattttatcaagttgctcctttaagaagaacacggcccccaatggaggagctagagaaagtacccaaggagctaaagggaactgcaaccctataggtggaacaacaatatgaactaaccagtaccccggagctcttgtctctagctgcatatgtatcaaaagatggcctagtcggccatcactgcaaagagaggcccattggacttgcaaactttatatgccccagtacaggggaacgccagggccaaaaagggggagtgggtgggtaggggattgggcgggtgggtatgggggacttttgggatagcattggaaatgtaaacgaggaaaatacataattaaaaaataatgataataaaataaaaaaataaaagaagaataacagacagctggtctaggtggcatgtgcctttaaatccagcactgggaaggcacaggcaggcagatctctgagagttcaaggccagccgagtctacagattgagctccaggtcagacagggatacacagagaaaccctatattgtcaaaaaacaaaacaaacaaaaacaaacaaaaaaaccccaaaaaacaaaacaaaacacccaaaaaatcccacaaaaaaaaaaagaaaaagaaaatctgtctggtgtactaaaactggtgtgtttttcccctttaaaagttttaaaagtcatttttaaaatttctactattgtcgattttattacttctatttatttttcatttaatttctttctcctttttaaattagatattttctttatttacatttcaaattctatcccctttcctagtttccactctgaaaaaatcccatatcccctccctccccccttccccctctcctgcccctgctcaccaacccacccactcctgcttcctggccctggcattcccctatactgggaccaagggcctctcctcccattgatgactgattaggccatcctctgctacatatgcagctagagccatgagtccaaccctgtattttctttgattggcagtccagtcacagggagctctggggttactggttacttcatattgttgttcctcctatggggcttcaaaccccttcagttccttgggtactttctctagctccttcattggggagcctgtgctctccttccaatggatggctgagagtatccacttcagtatttgtcaggcactggcatagcctctcaggagacagctttatcaggttcctgtcagcaagctcttgttggcattctcaatagtttctgggtttggtaattgtatatggaatggatccccaggtggggtagtatctggatggtccatccttcagtctctgctccggtctttgtctctgtaactccttccatgggtattttgttcccccttctaagaagtgtatccaaaatttggtcttccttcttcttgagtttcatgtgttttgcaaattgtatcttgggtattctgagcttcttggctaatatccacttatcagtgagtgcatatcatgtgggttttgtgtgtgtgtgtgtgtgtgtgtgtgtgtgtgtgtgtgtgtgtgtgtgtgagagagagagagagagagagagagagattgggttacctaacttagggtgatatcctccagatccatccatttgtctaagaatttcataaattctgtttttaatagctgagtagtactccatggtgtaaatgtaccacattttctatatccattcctctgttgaggggcatctgggttctttttagcttctggctattataaatgaggctgttatgaacatagtggagcatgtgaggaaccaccagactgatttccagagccattgtaccagcttgcaatcccaccaccaatggagtgatagtcctctttctccacatcctcaccagcacatgctgtcacctgagtttttgatcttagccattctgactggtgtgaggtggaatctcagggttgttttgattagcattcccctaatgactaaggatgttgagcatttctttaggtgcttcttggccattccgtattcctcagttgagaattctttgtttacctctgtaccccatttttaatagggttatttggttttctggagtctaacttctagagttctttgtatatattggatattagccatgtattggatataggattggtaaagatcttttcccaatctgttggttgcctttttgtcctattgatagtgtcctttgccttacagaagaaggtttgcaatttatgaggtcccatttgtcaattcttgatcttagagcataagcccttggtgttttgttcaggaaaatttcccctgtgcccttgtgtttgaggctcttccccactttctcctctgtaagtttcagtgtatcaggttttatgtggaggtccttgatccacttggacttgagctttgtacaaggagataagaatgggtcgatttgcatttttctccatgctgacagccatttgaacgagcaccatttgttgaaaatgctcttttttccactggatggttttagctcctttttcaaagatcaagtgaccatagttgtgtggattcatttctgggtcttcaattctattccattgatctacctgtctgtcgctgtactagtaccatgcggtttttatcacaattgctctgtagtacagcttgaggtctggcatggtgattccaccagaggttcttttattgttgagaagagtttttgctattctaggttttttttttattattccagatgaatttgcaaattgccctttctaattcagtgaagaattgagttggaattttgatggggattgcattgaatctgtagattgctttcggcaggatagccattttgactatattaatcccgccaatccatgagcacgggagatctttccatcttcttagatcttcaatttatttcttcagaaacttgaagttcatgtccaacagatgtttcacttgcttgataagagtcacactgaggtatggaatataattttaaatattgtgaatggtgtcatttccctaatttctttctcagcctgtttatcctttgatgaggaagactactgatttgtttgaattagttttatatccagcgacttcgctgaagttgtttatcagctttaggagttctatggtggaattttgggggtcacttaattataccatcatatcatctgcaaatagtgatattttgagttcttcatttccaatttgtacccctttgacctccatttgttgtgtaattgctctagttaaaacttcaagtactatgttgaataggtagggaaaaagtgggcagccttgtctagtccctgattttagtgggattgcttcaagtttttcctccatttactttgatgttggctactggtttgttgtagattgcttttatcatgtttaggtatgggccttgaattcctgatctttcgaagactattgccatgaaggggtgttgaattctgtcaaatgctttctcagcatctaatgaaatgaccatgtggtttttgtctttgagtttgtttatatagtggatttttgatggatatatatatatatatatatatatatatatatatatatatatatatatatatatatatttaaacattcctatatgcctgggaagaaaccttgattgtggtgaatgattgtgttgatgtgttcttggatttctttgtgagaattttattgtgtatttttgcattgatatttacaagtgaaattgatctgaagttctctttctttgttggttttttgtatggtttaggtatgagcgtaattgtggcttcatagaacaaattgggtagtgttccttctgtttctattttgtataacatttgaagagtattgttattagaccttctttgaagatctgatagtaatatgcactaaacccatctggtcctgggttttttttggatgggagactattgatgactgcttatatttctttaggggaaaggtgactgtttagatcgttaatctgatcctgatttaactttggtacctggtatctgtctagaaaattgtccatttcatccagattttccacttttgtgagtataggcttttgtagtaagatctgatgattttattagatttccttggtttctgttatgtctctcttttcatttctgattttgtaaatttggatactatttctgtaccctctggtttgtctagctaagggtttatctatcttgttgattttctcaaagatccagttcctggttttattgattctgtgtatagttcttttggtttctacttggttgatttcagccctgagtttgattatttcctgctgtctactcctcttgggtgaatttgcttccttttgttctagagcttttataggtgtgctgtcaagctgatagtgtattttctctccagttactttttggaggcactcatagctgagttttcctctttgtgctgctttcattgtgtcccatatgtttgagtatgttgtgctttcattttatttaaattctaaagagtctttaatttctttcattttttaaaattccttgaccaagtaatcattgagtagaacattgttctgcttccctgtatatgtgggctttctgttgtttttgaagacctacctaagtctgtggtgatctgacagggtgcatgggattatttcaatcttcttgtatctgttgaggcctgttttgtgaccaattatatggtcagttgtggagaaggtaccatgaggtactgagaagaaggtatattcttttgctttaggatgaactgttttataaatatctgttagataaatttggttaataacttctgttattttcactatgtctctgtttagtttctttttccatgatctttccattgctgagagttgggtgttgaagtctcccactattattgtatggggtgtgatgtttgctttgagttttattaaattccttttatgaatgtgggtgcccttgtatttggagcatagatgttcagaattgagaattcatcctggtagatttttcttttgaccagtatgaagtgtccttccttatcatttttgataacttttggtttaaagttgattttattcaatattagaatgaccactcgtgcttgtttcttggaaacacttgcttggaaaattgttttctagccttttactctgaggtagtgtctgtctttggcactgaggtgggtttcctgtatgcagcaaaatgggttctgtttaagtatccattctattagtccatgtctttttattgggtaattgagtccattgatgttaagagatattaaagaaaagtgatggttacttcttgttatttttgttgttagagcaggaattaagtttgtgttgctattttcttttaggtttgtttaaagactactttcttgctctttctacggtgtagtttcccaccttgttttggtgttttccatccgatatcctttgtaggggtgggtttgtggaaagatattgcttaaatttggttttatcatggaatatcttggtttctccatctatggtaattgagagttttgctgggtatagtagtatggggtggcacttctgttctcttagggtctatatgacatctgcccaggatcttttagctttcttagtctctggtgagaagtctggtgtaattctgataggtctgccttcatatgttacctgacctttttcccttactgcttttaatattttttcgttgtttagtgcatttggtgttttgattattatgtgatgggaggaatttcttttctagtctattctattgggaggctcttgtatgttcatggacatctctatttttaggctagggaagttttcttcttaattttgtggaagatatttactcacccagtaagttgggaatctttgctctcttttatacgtgttatccttagatttggtcttctcattgtgtcctggatttcctggatgttttgtgttagggtctttttacactttgcatttcctttgactattgtgtcagtgttttctatggtatcttctgcccttgagattctctcttctatctcttgtattgtgttgatgatgcttgcatctatgactcctgatctctttcctaggttttctgactccagcgttgtctacctttgtgatttttttattgtttctatttccatttggatgattttgtttatttccttcgactatttgattgtgctttcctgtaactctttaagggatttttgtgtttcctctctgagggcttctacctattttcctgtgttcacctgtatttctttacaggagttagttatgtccttcttgaagtcctctatcatcatcatgagaagtgattttagatctgagtcttgcttttccagtgtgatagtgtatccaggacttgctatggtgggagaatttggttctgaggatgccaagtaactttggtttgagttgcttatgttcttatgcttttctctcagcatctgattatttctagtgctccctgccctccattatccgactggatcctttccttcctgtaatcctggttgtgtcagaactcctcagtgcccagctatatctgtgatcctgtgattcagggatcctgggatcctgagattctgggtgtgtcagtgttcctggaagtcaagctgcctctgggaccctgagaatctggtgtgaccaagctcctgggatcctgggatcctggaatcctgtgagcctgtcaacctgagcacctgagatttgagcctcctctggatgctgtgggacttgctgtggagttagcacccatggtaaactggtgcagaacggaaagaatgggagccactggttgggtggggttcctgagtccctggatcctgctggtcccagttattcctgatggtgttggaacggatgttgtgtcctactcacccctgattctgcgatccttagggtgctagagtccctgggagtagagcctcctctgggtgttgtgggactggctgcagagttcttgcctaagttttgggttccttttaagtagatgttttttgtattttctccagaattttattacgaaaggtcagttctagtgagcttcttccatcttgaccaggagtgtaggtttttatttataacatatttgcacatttacagtgggtttcttagagacagcacataatgtacttatttttttaacctaacctcaattttgacatttaatttggacgttcagataattttttaaaaagcttgtggacaattttattagtttgagagaaaaactacaaggcaggaaagctgtaaatctcagcagctacttagagtaggaaaacagaccacaagtcatttcatttgtaagcagccatgtagtgggaagtggggggagcttcagagaaagactgagaaaacccagtgtcagggaaagcatgcggagactttggaaaatagataaagaaattttttttttcgcttttatctgcaacacacaaaaaaaaaccttgttcaggcttcacatagccacattgtggtaactccataagtaagtgcagtgaggagaggcttctgggaaagaaaagtacattatgtaatcaagagaataattattcctccactctcctcagcatgtcttcaggtgaataagatttcctggggtgtgtactcttgggcaggtggttgacaggcccagttggactaattcttattccaggatacaatagtatgtagagttctgatctttggagccattcagaacattgcatctctgcatctctgtccagggccagacacagatcccattcttttctaatttttcttcttcttcttcttcttcttcttcttcttcttcttcttcttcttcttcttcttcttcttcttcttcttcttcttcttcttcttcttatcaggaaagaagtagctttatcgtaatggccctcaacagagctctgatacttatcctccgtggtatttctgtaacatactttcttaaagagtgaagaccctaaaatcgtttagaaatagacaaaattaaaaaaaaaatagttataacctatttctgccatgaaaatgcagatgtaattgtaaacctgtttaccagagggaattagtgtctggactggtggtttctgtcataccctcatgtatagcctccaagctgggctgctaatttaggagaagataacaagaaataagagctcctttctggcattcttggcctctggccagaatagaaccaaggacatttccggcttctggccaaggacaagaatgaaaactgttccctttggggtctctgcccctaagtctgtctaagctgtttctgtttcctgtcctcatttaactgtttaaagaggagaatattgttgggaaatttgggcaataactggttctggcatatgcctgctggatgggggtcctcaaaccgtccagtgggcctagaaaagggacttcagaagtccattagtgattccacttgtataaccaaaaggtgtagggaggaaaagcatcccctgcatagacagagatgtgagggtggagaaaaagcaagaaaggagtcagagaaaagtgaaattggagccctttaagcagaggaaatgattccatcccaccaggagcaggtacagaagtttaaataataccttagagttataagccctagtcagaaaaccagaagtcagaacaaaggacattgaaagatatctaagtcaattagaatcccttactagactcacaagaacatcatccatatgaggcttattgggtttctccttggagtttttcctatagtatttaaagtccgactaaagagcgacgaactgagggtctcctttcaaataagtactttgatacttattggagtcatgataaaaatcaaatggtaaaacctacagaaggtggctcaacagttaaaagcatctgttcctcttatagaagacttgagttcagttcccaacatccacgttactagtgcacaaccagcaggagatctgatgccctcttctagcctctttgggcagtggtacatggtatacacacacacacacacacatacacatacacatacacacattttaaaagattaaacaacagctaaatccttttctcttttttcccccttagaacctacctagaagggacctaattcattattttttaaagaaaatattacttggtactgtacagggggcagcaatctgggaagtaataacaatacttaatgtttgcccataattttcatttaatatcattacaataatatttggatttaaatctaccatttttctatttatattctattgattccatctactttttcatgacttgtttcttctcttcttgtcttctttcagagtaatatatttctatgatttcattttatcttgacttttagatcactagtcttagttctttgtttttaatggttgcaccatttaaaaatcttcattcaacaccacatataaaccatacagagctatgcctgtgttgtatatgtgtgtgtgtgtgtgtgtgtgtgtgtgtgtgtgtgtgtgtgtgtgtgtgtgtgtatggtgttgaggatagagtaggggaaagctaaaagattgctacacactgttaatgacaactcttggcttttgtttggataggatttgtttagcacttaaatttgaaagacaatttcattgaattaaataagctaggtttacagatttttgtttaatcacttaaaaatgttactctactctcttctgaatctcatagattctgatattatgtttgtaattattcttaacctttttcctatgtctttaaatttgggtacttttagcattttctttttatcactgggttaaaggaattagatatgacatgttttactgtgtttttgtttgtaattatgcttcttgtggcttgtagactttattaagttatcaggattatcattttcaaccatctggaaaaagtttggtcatatttttcattaaatacatttttgtctttgtctccttgtatgggtccagtgctttgtttattttgaattttctttcttggcataattccatttgcattgtttctattacctattcttcagcattgctgatttgtatagattgtaatttgtcattttgcttttatatgtttactgatttaatttaaatttactgctacatatattcatctgctacatatattcatctctcccctttgtgtgtgatagtgagatattcctacaagtgaaataatatattgttatatttactactttatacaacatgttttgttcgtttgttttgcagcactagtatcaaacccatatttttatacttgctaggcaagtgttctaccactgagctatatccccacttctctgtatgacatattttaaagtagctgaaagatttaaggagaacaaaaacatattcatagggtttattatctttgtgttcctgttgtatttctggttctttacatgtttttttgcctctaaattcaagttgccatttgctatcatttccttattcccttggtgctattattgtcattaatatatttctatatattatatatacattaattcaattataaacctatagcttcattcaattaaaataatatgtacaaaaaagtaagtagaaaaatatacattttacaatagttaatatttatatatttacctttacaagtcctatgctctttgtgtaagatcaaattaccaacaaaattaaccttccttcgtaatatttcccacccttctctctcttctgagaggatctcactgtgtgcacaggttggtctagaacttgtgctgagattgcagtgccattttaggcttcttcagtatttctcatcagccaggtaaagtagcaacatttttgtttgaatatcttcatttcattttaagttttgaaaggttggtttggagagagaactcttggttgaccccttttgtatttatttttctttataattgcatccttctgccatttgttgtcctctataatctctgatgggaagtcactttaaacttagttggttctcctgtatatgctacattcatgattttgactttttctttgaacttatttctcttgtcataagccttgatgtagatctattgccattatcttcttggtctttttcaggattatcatgtttaggttaatggattttgttatattttattggttttagttttggttttctaaatctcgggtttttccattcattatttcctttttttttaaaatcttaactctttttttggtattcttttaattatatgttgattttattaatgaagtcctgaatttctctgagaccctgttttcttttgattcgctgttctttcagttgcacaatatgctgcttttccatgtttgctaattctttatcagatctactattgacattcccttgctctctttataaagaaaactgaaattatattacatacattcaataattatgtgttaatatatttcctatctctattaagattacgtgtttaaagagacatttatagtagtttactttttagtcattgcttgcttcctttggctttttaaaatgtttatgtcttctttacatattttgctcagtcagtaactgtgcttttttttaatgataatctctcctttctactttttaaaaagttatatgggccacaatttattaattctttctatatctgaaaagacctgcttggctttataattgacctgagtagggtaaaagagtaaaaacatcacaggtatagaaaggctgggatcaggtgggccacgcactgtgctgaagttgcaccagaagccgggaaattcaacatgcttatttcatccagcagaaggaggagacaggtttatgacatatagtggaacaaggaggcaggtttattatatacagatgaccgagtaggcgagggaacagatagaatcttcataggcgctctctgctggggagtagtttcctgctgaagtcctctggaaggaggaccttttgcttgacacccttctttaaccaggagaaggcatccatcccaattgccatattttgatagatttgaattgagtccttgacatgctatcaatacacagtcactcagtaattaatctgttcctttagatatctgtcaagttttttgtttaaaactggacatttgcggttagagatggagctcagggatagagtacgtgaggaccatgtacaaggcctgtgagtctatccctaccaccagaaaaagaaacataggtattttagatatatcatgtcactatctagttactgattactattactgcagtcccattctgtaatctaaactttatttttattgtctgtttgatgacttgaatgtattattagtttagtgaagttcatttcttcagcatgtacaaagtttggcatgtgcatagttaccttggaatgtcaatgattttagaagaattatgttctaatatgtcattttgtccctctgatatcatatatttagcttgttgccaacagcaataatcaactggttttttcctattattttttataatgttttgggaaattctgatccaattacattctagctgttttggtagttagccttttcctcctccccctcccccaccccctcccccctcctgctgctgctgctgcttcacttctgcttctgcttcatcttctctcctcctcctcttcctcctccttcttttattccttagttttagtccaaattgacttcaaacatgtgattctcctgccttagcctcctgaatgctgggattacaggttatgctataatacatttttgtgtcagtatttttgagacaaatctttgaggtttagtctaaccccagggggcctctttttaaatgaatcttaccctggttttgccttaagtgtctaactggtggatagtttagttgtttcttttatgaatcaacgagtctttcagtactcatcagtaaaaccttcatagtgtttggggactaaccttctccccatgctcttttctaagtaaaatcaatcacctagggccgaattacatggagtcctttcttcttatggctgttctgtccctatgggaaaagttgtctatcattcttcagaggtggaggcagtgaaaatagcctgttgtttttttcctcatagttatactttgttcctgggagtaccatcttctgaactccttggttttccttctcagcataataattcaccttatgacagaactgagttaaggaaatttgagacccacaattcttggccaactatttcaagaggagcttatgaagtggtagctcggtaaaagaagggagtctcagattcttagctgtatctacctggattggattacaatttctgaaactcaacattgggtgctatgtatgaactttccgaattctaccctatgtcacacaacaccatgatttagatacagcaaactggagagtatgcctgtgttcttgtttataattgtctagggtagtttttgtcattagaagttggggaaatgggttggagtctaggtgataatagtgtcttaagtgccatatattgatattatataaatattttgatattaataaatattttgatatttttgatagttttaaagaaatgcttttcattgttctatgctcttagaatgatttcctggtacctttttctctccctcttctcccttgtgtgtgtgtgttcgtgttctgtattcacatgtatgtatgagtatactggacatgtatatggaggcaagtctgtgggacattttttaattaattaattaattaatttatttattcactttaattcccaatattagatcccctctcctcccagtcccccttgaaactcctcccccatgctcccctcctattctcctctgagaagagggaatcccttgggtccctgacccccagcacatctcattgtaggactaggcacatgctctctcaataggccagagaaggtagcccagttaggggaatgggatccacagacaggtgacaaattcaaagacaagccatgcttcagttgttgggagacccacaggaagaccaagctgcacatctgctatatatgggggggggggtaggtccagcccatgtttactctttggttggtcattcagtctctgagctccccaaaggtccaggttatgtaggattgtagggaagtgcagagacactgctctggggttggaaaaacacagtgtgagatgtgggaaagacagtgctggttggaggtctccaggcctgcaatgagtcctgggccatggggttctcaggctcatggacaaccaggcactgcagggagtggcagaaggggagagtgtggaattgggggctcaggctggggagtgtctagcctggggcccagggccagggaacaaggagagctccagcttgtcacacaggggatgactgtggcttgatggcagcagatttggtggtggatatgcctgggaatgcagagagaccttctatgggagattaggttgcagctctgtaggtgaaggtcttcttcatggctccccatggcagatttttggggataccctccttctcagggtggacctaagattaaataccttttgcagggagggatgtctgggaagggcagcttattgactaagccctccaggcctctaggtacctctttagagggagaactctgttttcgggcctatgtgactgtgatcatgtctcttttcctattgtcttggtctgagatgttagggatgcttcatctacatgtggaagggattggggcattgcccctacatgactgatggccaaaattctctctacagagggctgtgtatacatgagaggtacctggtgccaagagcaggtaacactcctattgtcctattgttcagggtctccagggcttctagcctttagctcaaccttaccaggcttcttttcatggtccaccaccccacaaagttagttgactctgttggtcttcctgtggcgttcctatcctcttcagttcactcaatccttcacccaactcttccacaggactcttgaactccatataatgtttagctgtgggtctctgaatctgttttggtcagctgttgggtggagcctctcagaggacagttatgctaggctcctgttctaccatcatagcagagtatcattaatagtgtcaggaattggtttttgctcatgggattggtctcagtttgggccagtcattgattgaccattccagccatctctgctctatctttgtccctgcatttcttgcatgcaggatacattttaggtcaaaggttttgtaagtgggttgctgtcctcatccctccaccagaagtcctgcttggctaaaggaagtggccacttcaggatccatctactgtggggcattttaggtggttccatccctggttagatagttttgagtggtaacagaaagcaggctgaacaatgtgtggcaaggaaaccagtaggcagtgcccccatggcttctgtttaggttcctgccctgtttgtgctcctgccatgcttgagtgcttgccctaacttcccttcatgttagaaggtaagttgtaaaccaaatcaaatccttctcttccctaagtagctcctgctcatggtgtttatcacaggaatgagaagcaaactaggatacttttcaccttagttttggaggtagaatctctttctgaacctgaagatccgattttgattaagccgggtaactagtgtactctcaggtgctacctgtctcctacttctcagcactgaggttacagattaaaagtggacatggccatggtcagttacatacctactaaagatttgaactcaggtccttttgcttcatcagtaagcattcttacaaactttagccatcatcctagcccccaattttctgtttaattacaattgcttcttataatattcactaactctggttatctatctgggttgagagtgaccagtggtgtatgctattatcgttaaagtcattccttctggttttttttttttcctgaaaatcctttctctcagttttgggtagctcctggtcatgcatatacagattgaataatcagctaattactcatggagattcccctgacccaagtaaatcactgaagttcttatattctgtggctctctcattcacaattacaaaacatagtgactagtagtaacttcagtctgtttcttcagtcccgagaaaacattgattctctatttcagttccttcttgcctgtgacttaaaaactgcctcagtgccatgaactgtaataataataatttgcctggtctttccttagcaattacagtcttgtgcagcttgtctaatatcagaatgaagatttttctagctattttcctgtttaaggaaggaaggtaaatctgaccctttttactacacttatctggatataagattcttacatcaatttttttccttttatttttcttgaaaaggcactatgtagtagttaaggcagctgctccatttttctgtgcctcattattggcctctgtggactagagatagtaagactcttacccttgcagtgttgttaacatgactgagttaatgtatgccaacagtttataaaagtttacacttaagctgaaataagttttaaattctacatccagcaatattttcaccatcattaccactgatacaactgtctttatttcccatatatcattggagaaattttccaaggcttcacttatgaactgtatataaaagtggactagatcaaaatatctaagttacttgtaaatattagacattgtagcccttccgctcgactcgagactcgagccccgggctaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggtccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggcccacacgggactccccacgggaccctaagacctctggtgagtggaccacagtgcctgccccaatccaatcacgcggaacttgagactgcggtacatagggaagcaggctacccgggcctgatctggggcacaagtcccttccgctcgactcgagactcgagccccgggctaccttgccagcagagtcttgcccaacacccgcaagggtccacacgggactccccacgggaccctaagacctctggtgagtggatcacagtgcctgccccaatccaatcgcgcggaacttgagactgcagtacatagggaagcaggctacccgggcctgatctggggcacaagtcccttccgcaagactcgtgactcgagccccgggctaccttgccagcagagtcttgcccaacacccgcaagggtccacacaggactccccacgggaccctaagacctctggtgagtggaacacagcgcctaccccaatccaatcgcgtggaacttgagactgcggtacatagggaagcaggctacccgggcttgatctggggcacaaaccccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtacctgccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagatttacaggagagcactgctaaagagttacaggctctaaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcatacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaccaagttcacacaatatctttccacgaatccagcccttcaaaggataataacagaaaagaagcaatacaaggacggaaatcacgccctagaacaaccaagaaagtaatcattcaacaaaccaaaaagaagacagcaacaagaacagaatgccaactctaacaacaaaaataaaagggagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgccagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttacctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgtaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtaataaaaactgcatggtactggtatagagacagacaagtagaccaatggaatagaattgaagatccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtaggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtccatctacacaatggagtactactcagctactaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaattccagggccaaaaaggggaagtgggtgggcaggggagtgggggtgggtggatatgggggacttttggtatagcattggaaatgtaaatgagttaaatacctaataaaaaatggaaaaaaaaaaaaaagaaacaccaaaaaaaaaaatattagacattgtataacagttgttttttgtatgtatgaacacttatatatttgtgtatatatagacaaaccttaggttggtagagtttgagagttaaaagaattacatatattgatttacttggtccatgaacacatttatgcccattatgctgagtagcttgatgaaatttccatagcaagccttttaaaagttgtccatgaagcattcttttacacaatgtcactagttggccctttggtacctaatacgttcttggccaccaactaagtataaaattgcactagcaattctgtacaattatctagttttaaaaattgagagccaggcatggtgattcatgctcttaattctagtactttagaggctgaagcaagtatcttaagttcaaagccatcatggactatacagtgagagcatatcttttaaaaaattaagataaaactgatgataattgaccacatggaattttagggcaatttaatccaagtagttagaagggtccaatacccaagcattagcagaatatccatggcatgttttctattttataaagatctggaaatagttaaggtggctacttttagaaatatattgcatttccatctggtctaaatcaataaaattaaactttatgctgtgtgagatggagattccagatttagagactgttatataatgttcttagaatcttcatttagtattatttgagaaacttatctagttatcaggacacaggtgatatggtatacataattttttatgagaaaaaatgaatttttttgtgatttggacatattgattttgagccttccctgtatagatgttctttatcaagtgaagtttatgttttagtataaattttttttcatcatgacaagatgatttagtacaatttataaactaatattgatcattgtgtaccagggattgtgtgctagaactataacataccctttgtgtatgttatatcacctaatcctcactgaaccagtatggggactggagcaatggctcagtaattaagagtatggactgttattcacaggacctcaattctagtcccagaacccacattaggcagcacacaactgcctgtaactccagcttcaggggatcatacacccttttctgcactctgatcatgcaatcaagtatggaaacccatatatatatatatataaatgtttgtgtgtgtataatttaaaaataaaagtaaaaaaaatcattttgatgtaggtgttatattccagttttatagaagagaaagatgaggttcaaaatatgtaacttccaagattataaaacaattcaatagcagatttagaattctgacccagggtcttactgatatcctgtttttaaagaacttcatcattagtattactattaacatctttgctcataccactgttacctaatgatagttctagcatacagattgttaaaggcattgttagaaagaaaatacagtgtgcttttatacccagaagattaccagggggagtaagtaattaaagattacatgtcagataagactttagtgaaagtttaacagccaccaggtggtcttaagagaaaagagatgtttttaaagctaagcagaaacagaaaataaaaagggactgtggtttagaattgtaagaattggtagtgggaggctagttgctaggtgcctgtaggatcctagtttgattataaatagaggttatcattcctattttcagataaagagtttaaagcttaataattggcttaaggggacgagctgtgtattcatagttatcctccaggttgacctgcattttactataccctattttcccctcccaagtaggattctggtagcactgtccttgcgactaacttattttcctcttagctttttttattacttgcttctttttcagtggattacaggaagaactatttcttcagcctgtaaaacttttcactggagagtagtatgtggttcttcaggctgtacttaatctgtctggagtcagtgaaggagaggattaaatatctttgaaactgtttcatgtcctaattaacatgtttcctgtcacgtttgctttatcaaatgagggtggcactcattgtcacatagtgatcccaagttccattgggtagctatgtatttttttattgataaaatccaaaaactggccaatttacccatgagattaaactttcaaaaatgagatacttttgggcaactgggagcaaaagaggcttcagtgagaaaagttcttatagttgatgttttgggggattggtgaatcttgttagattgatagattctgcttcttcccttccattaactaccctttaatcacagctatcacacacacaaaaatgagtaaataaatatctaaatacttgactttgcactccaaatcctttcactatggttgtttggtacatcaaagcagtcttttttttttcctcattaagagtagaccctataagtcagctactaaatatttcactaatggaattaacttattagtgttccaaaatatcaagtgccccagaaacattctgtcataaaatggtaaatggaaaagaatgatcctgtgttcccccttctccccacttccttccttcattcagctgctcttacttctcccgtccctcctatgcccctcctttatctgataatctttcttattctccattgtgttttcctttcctcctgctttccctcttttcctctttgtttacattagaaccgctgctcctttatgcgaacactaagtagcagtcatgtttgttcaggttgccatggaaatattgcaagtaggcctttacacaaactggcttgctctattaatgaatcacacctagaacttctaaggctaataatataggaaaaaaaattctacatagaaattaggtctcagaactcaagtccaattattttctccttcagatagagtttttatccattgtatcattttagagatacatgtatgactttattaataagctatttctttagacttttatttcttttcaccacagaacagtgacttccagtatttttcatttcagagtacacggggaatttacaaattgaaatcttggtttggggtagaaataaaaatgttttagagtagaaggagagagacttgttgactctctcaaaggcatgaaggtaagcagcagcagaggcctcttttgtttggggtgtgtgtgtgtgtgtgtgtgtgtgtgtgtgtgtgtgtgtgtgtgtgtaaagacttcccaacccctgtctctagaataagaagaaagcagttgaaggagggcttcagcctctgagggataaaaagtgggcatagggaagagacaaaggaaatactggatactgtgagggagatagtgtgagaaggaaaataatatgcccaactgtggcctcagaaaggcccaagtatcatttacaagtctgttactctagctctatgataaacagctgcttcctcctttctccaaataggctttgaggttttgtttttgttgttgtggtggtggtggtttaaatcacttgagatactgttgtaagtagatccaatctcttccttcctagaggttagcttagttctggggccggtgggggggggggggaggtaacaactttcaaagacagcaaaaggaatgtaagatgaagaaaaacataggatagtgataacaaaaggaaattaaaatgggaagacaaactctttgataagataatacgcaaagtgagacttagatttgttcacatttagaacccttgagaaagactgattcagatagagaaaaaggcaagttcaaaaggcaagtactattatactgatagtagaaaaacttccagcctttattaggaaccaagagtaagtgaataagtgaagactgggaagaagtgacagaacccagatcatgttgattaagatttataggccataataagggatgagtattttattctagatatagcaggaaaaaatggaggatgagtctttaacaagatgatgttgtacagaatggataatggatagaaggaggtcaaaagtaaaagcagacagactaattaggaagctgttgcttttattcaagactgagatgatggcttaaatcagataacaaaggagatagaagcaggaggactttgttgataatttaaaggtagttaacaggaattgctgagggaataaatgtggtgatttaaagatttctttttaaactttggtaactgggtagcttgaaatagaatgtgggaagagtgctccttggattagaaggaagggcagtggtttggaaaaataaaagcccacatgagactggcagagctctgaaattgataggctgacaacagtcagttcagtagctgccaaatgcaagagaagtagcatcctggaacagacaaaagttaggacagttgctcagctggcttaactcttgttgttctgtagcagttagaggtgcagaagaaatcctctctggaaaagaagaggaggaataaaacgggtgttctaggattggggtcagaagggtttgattttcttggcaccttcattgtgactcaaataattagtcttccccgcctccctcaaaaccataggatgcatattaagcctgtagtggaaaagttttggaagtgaaatccccatttttctgtttctaaagtgaggattgatgagataaaaagaatgagtgaaagaggactgcactgttcttcccaaccctgggacttttgagagttttcttattaagactcaaagggccctgtggtgcagtatgttatacgtagtcatcatgtaaacaaacttcttagtcatcatgtaaacaaacttaggatgtttgccacctgtctgtttgttttgaaagaactacaacatcaatagtttacattttttagaagaaagcaaggcatctttaggataattgctaaaacagccctcataatttattttcttctttgggaggatggcataacataattgctaaaaccatgactcttgatctatctgtggtctaatctctgctctaccaaataagcttttcttatctgtgaaatgaagctaacagaatctccctcctaaggattttgtgctaatgaaatatgttgacatttacaaccttcttagagcagtatctatgtgtttgttttaaaaggtttttttttaaagtatttagatgggaagctaatcaaaaaatatgactgacccagaattcaggttcactgggttaggtcagtcagcaagccaggcattgaacacgggtttagaaaaagctctagagtaggactggtatgcttactatgcagtgccctggtttcaggctgggagttgataggatttagagagactcttgagttccaggcacaggtgaagaatccccagattctctcagtgtactaaattatatacagatagttaaattacttcctggtgacataaaattcaataggatattatttcttaaaaacactatttttccaaaggtaggtgtgactctcactgtgtccttatggaaactattccttaccaaggtttctttttttgtcaggaaaagtcagatatcaggaggagagtggttcaaaagaattgatgaagtttgaaaaatctttgtcttgctttatctttgtcataaaagtaaccctgtactcttctgatcacataatgtatattgtttccttcataaatgaggacatttcttttatctccttatattattacaaataccccatccaaaagatttataattggagtctttatatattagatgaactaccaagtggtgtgttatgagcatcagattgcaaaaggcagcatctcttgatggatcaagatagtagttataagtggctgttttatcctaccccatctgtgcagtacagcagaaataaggccttttttaaagttataggactgtataggtttgtagtggtctcatatatcttcctccctctatgcttacctctaacatttctagaaagatgacttatttttaaagggcctttgagaattaaatttcataaccctccttctaagtcatttcggtgttgagaactttcacagtcaagacattttgccttttattcaagtgaaatctcattacaaagatatcgttcctctttcttcaggtgctttatagggaaggtgctttgttgcactgagtacaatgggctacattactacaagcaagcctattcaagcaggcttttttccttgccctaattctgtatcagctagtttacaagacatatatctaagtgtgtgtgtgtgtgtgtgtgtgtgttgtgagaggaaaaggaataaaaggtatgggggatgtataagcagtttgttttataatgtttattctttactgctaggctatgatcacatgctgatgtatcattgacattgacctctcttgctttgggagcccatggatccgtaatataatttctagaactacaataatttaaaaaattatcttcaggcttagtgtgtctctaatcccgatgcttggaaagctgaggcagaaagatcacttcaaaggaagcctgcacattacacagagtgcctcacaacatcagacaaaataacaaaagacaaagcttctaccgtatagtgctaatcatccaggcagaatatgcccaccgatgtaataatatcatgaatgtttggagagtaacaaaacacattatgattatatgtgaagaccactccacaagaggtgatatatgcctgattctgtaaacctctgtgaaaaacttatggctgcagatttcaaaggcattaagggagaaattactactaatactttgtgatgtacacatagagtcaaagttctcgctaatcaggtactgttttcagtctaagaggaacctcaggcctgtgtattagtgccgtgctcaaccttgatcagagaagtttctttttgcagaaagcagaagtaagtacagaaactcataatttaccaatacactgagaaaaggtgactattttctctcttaaatagaatatctatgtcatgtcttctaaaatccaagaaacacttcagaaaaggggcagaaggattgtaagagctgaaggacagaaagggagcttggaaatggggttttctggatatgacatgtctatttcaatcataagcacacaacagctatgcctatctgcacaaaatctttgtgtgcaagttcatgagtacatataccccaaagtagaaggggagaaagggactcaagtgggagtggaagttgataaaaataatggggtgaatattgaatatattcatgatacattgtatacatttatgaaactggcatacatgcttaaaatgaaaaaggggaaacaatggacccttatgctggctacttacttttaagaggctgacaaaaacatgttatttaaaaccctttcatccgaggttccataacataatggttagcactgtagactctgaagcctttatgtatatttggaaagcaaacaagcaagcaagcaacaacaaacctgtgtgacatgaactgatagtggcacaagttcaaaccaggaaaaaccccattgtggaacaggaggtgtctatatattccaaaccctagctgagaagtgtttggcaattaatagttgctggggaggcgagaggaagttttcttcaatgacgtagccactagaaagctccccatgctgtagtagttggcaggtttgatcagaacgcattagataactgtacgaaaacatttctccaacattaaaaattacctgtgtgaaggaaaaaaagaaataactgataaaaatgaaggctgacaaaggatatatcaattagtgataatagttatctctatgtaacaattccatgtgtctttctcaatatttgaaatcttctggtccttttgattttcacttttttttttcagaatgtagcccatgaaaacttcagagtagatgttgttggctaagaaggattctcaagctgtatttctttaggagttaaagtgagtgctacatataatcagataattagtggacatgctgacccaccatggttgatgaaatgtgatacttcacagttcatatctgcttagataacttaactccaagattgactattagttaaaaatctctctttttaagctaatactgatcgcatgatcctgagtactcaatattaaatcatcttaagccagcgtatttcttttaggaggtaaagggtatcatctggtaggcattaaggctctaatgtagtccatatttctttctttataactaaaaatattctaacttcatctcagcagatactatgatagctgctcagcagcaacatgttcagatttaactctgccctgaggggtactgtaaagcattgtgaacagaaaactaaactttcataatgaagccattgtggatagtgtgtcaaaatgtcattttaataatccatattttaatcatactgacttcacctgtcagatcctattttagttcctattagccatgcacttctgagaggctcggtaagaggcagtggtgatagaatctacacctgtcctaatttgtttgctttgccaggtattgctgggagagtgggtttaacatacattgtataaagatctccatctgggctcagtctctgaatggaatatgttctttatgtgggtacagataggaacttgtcagcatcttttgggtatggagtcatcattttcaagtgatttgtctgtgtttttattgtatatcactcagaagtagagtttatattgaagtttatacgaaatgctctagtggtgtagacagaaaaggaaaaaggagctggcacttccaatgtccttagaaagaacaagttgaacaatcagaatttatagataatcattgtgtgcttgcttttctctctgatactgctctcatttgaacgtttttctttaactgttacttggctcagggaacaatatttgcagatagaaaactttttaaatgcactttaaaaattatctttaatctttttctacagtctaattgttatcctcctcctggtacgccttccaacagttacttcttcatcccatcccccctgccccatctccaagaggatatgcccacttccaggccttcccactccctggggcctcaagtctctggagggttaggcgcatcttctctgactaaacccagacccagcagtcctctgctgtatatgtgttggggacctcatatcagttggtgtatgctgcctggttggtaatccagtgtctgagagatctcaggggtccagattaattgagattcctatgggattaccctcctcctcagcttcttccagcttttccctaattcatccacaggggtccctgacttctgtccattggttggttgtaagtatctgcacctgactctctcagctgcttattgggccactcagagggcagccatgttaggctcctatctataagtacactatagcatcagtaatattttcagactttggagcctccccttgagatggatcacaatttgggcctgtcactggacctcctttccctcagtctcttctccatttttgtccctgtagtacttttagacagggacaattctgggtcagagtctttttctgtgggatagcaacaccctccctccaattgatgccctgtctttctactggaggtgggctctacaagttccctctccccactgttgggcattttatctaaggtccctccctttgagtcctgagagtctctcacctcccaggtctctggtccattctagaggatccctccacgcatctcctgaggttgcctttttctattcattcttctggccctctgggcttctctcctgtctcccccaccatacctgatcatgttcccctcttcccctccctgtttcctattccctttccctttcccacccaggtctctccctccctgcgtcccctgtgattgctttcttctccctcccaagtgggattgagccatcctcacttgggtccttcagcttgttaaccttcttgagtgctgcagattttatcctggtattttgtaccttttggctaatattacacttatgagtgagtatacacaatgcatatccttttggggctgagttacctcactcagaatgatatttacttgttccatccatttgcctacaaaactcaggatgtcctcattcttaatagctgagtagtattccattgtgtaaatgaaccacattttctgtatccattctttcattgtggctatcacaaatagagaaactatatacatagtggaacacgtgcccctgtagcatggtggggcatcttttgagtatatacccaagaatggtatagctgggtcttcaggtagatctatttccaacgttctgaggaatctccagactgacttccagggtggttgtaccagtttgcaatcccaccagcaatggagaaaattgataaattggacctcatgaaactgaaattgttctgtaaggcaaaggacatatcaatagaacaaataagctacctacagattgggaaaaatatcttcactaaccccatattggatagagggctaatattcaaaatacataaagaactcaagaagctaaccttaaaaaaccaaacaacccactttaaaaaaaaatggggtattgaactaaacagagaattcacaactgagaaatcttgactagccaagaagcacttaaagaaatgttcagagtccttagtcattagggaaatgcaaatcaaaacgaccctgagatgattaagttgcacttgtttaactgtaaatctagatgggcaagtttgctttaaaaaaaaagataagaaaaaaaaaacaaaaatcacatagtgatcacatccttttctttccatatggacacttgtgaaaccagttgctgccgtgttggagtttatggatcacacttgaatcctggatccacataagaatatatgacctgtctcatccagttagcttctaattcattttggtgtttaaaattactgtgagtctctaaatgtttagattcatggcagattgggttttattattcagcaactatctgtatcttaaggttttctttgttctggggaaatcagtggctttacttttaaaaagcagaattgtttcccggtagagcagtgtaactgatgatagctaggatatgttcaatcccaagtggaaccaggttgattttctataaaactggaggaaaaagttcatctgtagataagcttgaaggaaaatggcttgtgttttacctttagaggagcatcttgaagggtatttaatttgatattcttatctataagaaatgcggcaggatgaagcatgtacactcagatgtgtagctgataacactcgtgaaaactggaagttccattttttaacttttaaaaatatgcaagaagggcccaaaataatgcagggaaagaaaaatgataccaaactgaagtcacaggactcaacatataattctggtgaaactcaggaagaaccgtattagtgatagtctagaatatgcacagtgctttacaataggttgattgcactaaacaaaggagaaaatcctttctctgaagagcttacaatctaaagatgcaagttagttacaatgtggaatgagaacaataagagatccccatggtgggtggccttcatagatgaaatacttaaaaataaggtgagggttagagagagttgaagggaaatagaagcttctttgagactggtgaatagggataaggaaatgaagattggacaatgtgtctgaaaagaggctcagcataagaatgggcaaagagatgagactgatgacattacagcgcttggagatttagtgaacaagagaaaaaatgccagcagaggagaattgagacattctataaacattctataataaggctctgaattacagagaataccacagctttaaagacacagattccgagaatgcagcttgcaacagctttcttgccacagtgttggcttcgatagcagaagaaggaagagtgtagcaggcttgaaacaattcagtgagattctatatgtgcttcataagcagtaaagcagtacagatgtacatacagtcatcatattttgcttaactttgattttattaaaattttggttagcataatattttaagtcaaatgattatcagtagaatgttccattacagagatgttatgaggaatttatctgattataaatgtttcatttgtttccatgtttttacaagctcattgcaaattctcctcatgagtgtcacagagcttagcctttctttgaacatacatacatcttcatgtcagtgaaattctcatcgccatcatccctgccctctcacttgcttccagcctcatctatacctttgcatttatatgtcatgcatttcctttgatgtaacaatattgttttatattatgcctaatttcaataaggctttcagtgcatttactgtatatatatataaagcttaagccgggcatggtggcacacacctttaatcccagcactcagaagccagaggcagacagatttctgagttccaggccaggctggtctacaaagtgagttccaggacagccagggctatacagagaaaccctgtcttaaaaaaataaacaaaaaacagaaacaacaagaaaaacaaacaaacaaacaaaaagcttaacacattgacaaagaaatgagcctgttagaaaaatatatgtaagttaaaggggaatcagataaggttagtacaataaatacataaacttaaggattttatagttatgctctgacataggtgccatgcttctcaccagactcaaaaaaaaacaaaaacaaaaacaaaaacggatgagttaataaaagggtttgcaggtgtcaataagctgagaagcacagctttttaaaatttgtgagaaatttctgtctgtctctcctccccaatctctctctcctatgtgtatgtttctctctctttctgtctgtctgtctgtctctctctctctctctctctctctctctctctctctctctctctctctctctctctctgtgtgtgtgtgtgtgtgtgtgtgtgtgtgtgtgtgcataaatataacctacaaagtccatataatgttacttctgtttgttttcagggctgaccatttgctactggacaatcaattggagtctctggggaaaaacacctctcctgctttcagctttcctcagttgcctgctgtgagtgtgtgtgtgtgtgtgtgtgtgtgtgtgtgtgtgtgtgtatagtgttgaggcctcatgagctctttctaccatccactctgacatgccatccacatgacatatgtgtcatctatgttcagcttatattgaggcagtcatgttaatgagtctttatgaatgtggcctctgattttactaggagattcattctcatagcgaactctccagtcctatggctcttatgatcttcctgccttcctcttctataatgtccccggagccataaagttcagagtgttttgtatccattgggactgggctccacaactctgcattttgattgattgtggttttctgtagtggtctccatctgttgcaaagagaagtttccttgataagggctgaggactacacttatctatggctataaagacaaacatttagattgtagttaggaattatgctgatttagtaaagtggtagttttacattctcctccaagttacatgactccataagcactgagtagttggctaagtttccaataccagatgtgatttccctcttgctgagcaggtcttaagcccacatagagagctgttggttactggcaaggtatgtgtgctattattgtaaccttagggttatcctgctatgctgtctgttgatgttgatatagttcataggcatcatagctgggtagaactgcgtcctgactctggaagctttcatggcaatttctggtatcatgaaagctagtcctgaggatgaagactttaggtcaattctagctcaggggtctctgggccctgcttctgaagtgtgtggtgtcttcagcaatagagacttaccttccacctctggcaggcaaccaagggcaactcctagacaacaattcaaaagaggacttttcatgtctgttattagagttttggttaattggtctttggctcttgggggagcattctcagtacagataagaaaagctcattaggtaagtagtcagtagtttgtttccttatggctttttcagaaaccctcatctaccacccatcactaaagaaccctatcctgtcataattccctgatcatatcacttgtaccctagtattcccttctgcattgctccccaaacctgggaaacactcctattttatgttacttgatttctgttgttacttaaggtatagcctcacatgtgaacatttggagctaggatcttttaaagagtcttttggatctggattacttcattacaatgatctctagttgtatctatttacctgcaaagctaattatttcatttttctttgtgctgaatattatttcatagtgcatatgtaccacattttattaattggaggacatttagttgtttctatttcctagaaattgtgaataaagcttcactgaatatgtctgagaaagtatctatagagtaggatgtcagtcctctgggcaaatactgaggagtgctatacttgggtcatattgtacatttatttttatctttctgaaggtttttcacacttattaccagaatggctacaccagtttatcatcccaccaactgtggatgagggttccctttcccccaaatctctccagcatttattgttattattttgttgatcttttcctttctgactagagtaaaattaaatctcaaaattgacttccttttgcattttcttaattgctaggaaccatggacattttttgagatacttcttagccatctttgtcctttatagaactttttgttcaggtctcaggcccatttttcaaatgagtcatttcgagtctttattctttgtttcttgaactctttatagattctagatattgctcctctgtcagatgcatggctggcaaagattctctcccatcctgtgaggtttcctctttacccagttgactgtttatttagctctgcagagcctttaattgtcatgaggccctacgtgtcacttgttggtcttaattcttggggaaatggagtcctatttagaagtcatttcttcacctatattgtttaagtactgcctttattctcttctagtagtttcagtgtttcaggtttcacattgaggtatttgatcaagttagagttagtttttgtgtaaggtgatataggtttagtttcattcgtctatatgtggacatccatttttagcaccatttgttgaaagtccatttttcctccagtgtatgtttttggcatcctcaacaaatattaaatggctggatttacatatattaaaactttggtcttcaattttgttccattggtctctatgtctgatttttgtacctgtaccatattgtttttattactatggctctgtaatatattaagattttatttcttccaatgttgttcttttttccagtcttattattttgtctgttttgggtcttttgtgcttccatataaattttaagagtttttttctatttctgtgaaaaataggatcagattttgattgagagcacattgaatctgtaaatagttttttagtaaaacggtcattttcataatattaattatcaatctgtcagcatgggatatctttccattttctagtgtttttctctatttcttcagaattttaaagttttattgtagagttacttcactttcttgtttaggtttatttctggatactgtgttttctttgagggtttattgtaaaagggaatttattcatgttttccttctctgtatgtttgttgtgattctatagaaaatatgttggtttgtgtaagttgattctatatgcttccataatgctgaatttgtttattatttctaggtattttccagtacactatccagtaggatgtctaatgtataatgtcatctgcacatagagatagtttgatttcttattttcctatttgcatccttttagtttccttctcttgccttaccactctagctattgctacaagtatattaaaatggagtgtggatgttgaacatctcgttctcattcctgagttcagtaagattgctttttttttccatttagtgtaatgttgtctgtgggcttctctatatatagcttttattatgctgaggactgttctctctattccttcattctctagaacttttatcatgaaggcatgctggattttatcaaaggctttttctacatctattgacatgaacatgtgatttttatatttagattgatttatgtggtttacttagtctatggaattgcacatgttgaagcatcctgcttttgagggataaagtaaatttgtcatagtgtatactcttgatacatgtttgtattctatttgtaagcattttttcagtatttttgaatgtaggtttatcagagatgttggcctacagttttctttttgttgtgtctttacctgtaactggatattagagttgttagcattctgtcctagctctaccacacagttacctggcaacaaccaggtatgctcctccccacagttacctggcaacagccaggtaggcctgactcactataaaaggaactgcctgaagtctcctctctcttgcccctctctcttgcctcttgctctcttgctccctctctctccccattctctccccccctccatgtggtcatggctatggctggcctctacttctctactctctccccctctctgcctttctctgtctctactatcctcttaactctcctccccatgttttgaataaactctattctagactataccattgttgtatggctggtcccttgggggcgggggagagatgctttggcatgggtctgctgagacattctcttcccccatacctcaccaccacctcccagagaacatattcttatatctctttatcttcttataaacacatcaagagtgatcctgtctccatgaaaggattttccttccttccttccttccttccttccttccttccttccttccttccttccttccttccttcctctctctctctctctctctctctctctctctctctctctctctcttttccatcctccttctcctgctcctcctcctcttcctcctccttctccttctttgttgttgagacaaggtctcatgatgtagcactggctgttctggaacttgatctgtattaaaggtacacactattttggggtattttcttcttttcttcttttttatgttttgcttttgaatagtttaagaaatggttggagatctactttgaatgtcttatagaattctgctaagaatccatcttatcctgggatttcttttttttttttttttttttttttttttagctgaaagccttttaattactatttcaaactcatcatttgttattagttaatttaggctgttgacttcttcttggtttaattttggtggtttggctgaatttaaaaatccatccatttctattaaggttttctttctatgccattgacctagaattcttctccctcatctacacctataattcttattttttggttttttattcatggcatctcatattttctgtgtgttcctttatttttatttttatatattccttgcttattatttggtctagatcatctactttatctttgagttctgatattctattttctgcttgattagttctacttgtaaggctttcctttagttcttagttgagttattggatttttcaattttattttcatttcagcttgagtcctcttcatttatatcttttgactgaattctgttctcaagtgatgtattgtcttcatcagcctatgtttctgttttttggtcattgttcagtagtttgttctctttgagctctttcttcttaatttcatggagctgtttctttgtgtcttcattaaactctcccaattcttgttagagttcatacttgttctcttaaattctgtgtcctggagtccatctaggtaattctcattatcaaacatttctacacaacttttaaatttcagacagaagatactggcttgatctatcatattcttggtatttttgcaatgatatctgggaatgtggacttttactgttagttctgggtctgatatggacagagtaaattggggaagaagacaatttgtgtaagtggtttgggtctcaaggtgtggaatgaagtcacagcaatactgggacaggactgctctacagaatatgcttcctatgccaagcctagagtgtaagggtagacctgtctaggtgcaaaaggttggctatgtcatggaagaatactgtgggttagagtatagctagggaggatcctagccaaagcctagtgttccttccctgtgcaggcaggagaggtcaggctaagctgatgcatttgttgtgggacccaggctagatttggtgggttgtggaaaaggcatggatgaattggaaggtcaaggggactcactggaccttgatggggatatgggaagtttgcataatgagtgggctggttggaagctgtgcagaagggacttttgggtggttgcagtaagacgggtcctagtataaccctgaagttgtttgagcaacaggcatagaaggtcagactagactggagcatgtgatgtgggaccctacgaaagcctagaggctcactaaagtgcaagaggggtactcctgaaaggcagactgaggctgaaagagactagacggggagagaaataaagacaccaagacaaaagtactctgttcaaggcaccttaaagtttacttagtgtctaagcttatatagggggtaggcccatcccccgccagtccatccaggcacctgtagaaagctacactgcaggtggccccacttcagttgcgacaaggtctgcacaagcccgcttcaggctgggggaggctacaattcctccctaagtatataataaaaatagctggaccaagacataaaatttatttatgctccatagtcctgcctgggagttatggtagctggtggccatgcctggcttgggaaatctcagatttttccgaactattcttatctgtcaaggagtatatatgcagcttgtttgtgtttattttacacaaacatggctctgtggtgtattattaacaaaccacggcctcttggcataacccttagattgatatagttccgaaatctggttgccagtcattggctgaccagccctcatagcacaccttattcccaaatcagaccaaagccacaatatatacttaaaatgcttcttcatattgacgaatttctgccacctgcgcttgctggaggtgaggctgcacacttgctgaaatcaggctgtaaggagagacttacgtgcttgaaaaacaaagtagaaacaattgaaaaacaacaggataatagcttctttggggatgtccaggtactttattcagttgcaaattagcaacgatcaagctcagactctgacctcctagtgtgggggagctggctttgagaattaacagaaagactgtaaattctctggaagtggaggttatattccaaattaactcttctggccaaaaagaatttttagccatcatcgaggttagaatcatacttactagaagattcgggatctgtgaccacttgacaaaccaatctttcaggcagccatcgcgcttcatcttctttttgtgaataaacacagtccgaacatcttccccagattaaaacggggtctggaccattccacgcattagttaatgggtcccgccaattaaccatggcataagaactggaagtaactggatgccagtggtgattcctgcagactgacctttaacatcagtttgcaaaaaaatttaaaacgaacaagacaaaagcaagatgtgcttttggtgaccttgggggggggtataactgcccctcttttgtttttaaaagccaatttttcagagtgcaatgagcacgtttaacaattccttgtcccatggggttataaggaattccagttttatgtttgataccaaattccttacaaaataaagtaaaattgttgccagtataagatggcccattatctgtcttaatgagtttaggcaatcccatagcattgaaggcttgtaaacaatgatcaattacatttctagaggcctctcctgtatgtagagaggcaaaaagaaatcctgaacaagtgtcaatacaaacatgtatatattttaattttccaaattctgcataatgagttacatccatttgccaaatatgattaggcataagaccttgtggattaactcctaaatgcagcactggagataatgtaatacatttaggacattgttttacagtcattcttgcctgttctttagtgatcttgtgttggagctttaaggtatggctggagagatgaaatttatcatgatcacgactagccaaaacaacaggatctggaattaaggcctctcctattagagctctgttgatgcaatcattgcctgcagctaaaggtccaggaagaccagagtgagctcatatatgaccaatataatatggatgttttcaggcaagaatgatgttttgcaattgtgaaaacagagatcctactggcatattaaagttaaacatgccacaagtctccaataagggaatcgattgtgcaccatataaactatcagtaaaaatattaaaagtatcatgtacagactgaaaaacattcagtactgctgtcagttctgctaactgagctgagaggctcaggagtctctatgactacttgttgattattcataagatatccagctcatcctttagaggagccatcagtaaaaatcaaaggagcatcatacaaaggctgtaaagaagtcatattaggaaatatcacctcatgtacatttaaaaattttatcaacctatcttgaggatagtgattatctataattcctataaatcctatttgagcaagcaaccaatccgtactgtgctgattcagccaactatcttgatccatactataagactgaacaatgatatctggctctttgccaaaataagttagtgcctacttccatccaagtatgatcatctgagctactgcttcataatatcctcaaatgtatccatgttagaggagccctttgccacaacaatcctgtaggcatatgaatcatattaaaaattaacagatgtaaaggcaaagagtaatctatataagtgacaaattgttcttcaatagctctttctacttgttgtaaggccagcaatccttctgaggttaaagatctaggggaggtaggatcagaactccctttaagaatatcaaataaaggtttcaattcccctgtagtaagctttaaataggggtgaagccaattaatatcacctaacaatttttgaaaatcatttaaagtttttaagttgtccctgcgaataactatcttctgggggaaaacagcttgatttgtaagtctaaaccccaaataattataaggatcctgagtttgtatcttctcaggagctatttatagtcctttatcagctaaggccttttgtaaatctgtataacacaaaagcaaatcctgggggtcttttcctgccatcaaaacatcatctgtataatgaattatttaaatcataggccattgttgtctcacaggctgaatggcttgtgccacaaacttttgacataaggtaggactattagcaatgccctgtgggagaactgtccattgatatctcttcataggttctttaaaatttatagaaggaatactaaaagcaaatctttcacaatcctcaggatgcaaaggaatagtaaagaaacagtgcttcagatctaccacaattttataatatccttttaggaattgctatcagagacggaagcccaggttgtaaagctcccattggtaccatggtttctttaacctttcttagatcttgtaacaatctccatttaccagattttttcttgataaaaaaaaattggagtattccaaggagactgagattctgctaaatgtcttgcctctagttgctcctgcactagcgaagtggcgacttctattttcgctttaggtaaagaccgctggtaaatcaacccacaccagaatatcattaagccattgaattttatcagcatgggatgcaggcaagatagtagccattactgaaaataccccaaacctcttgtgttagagtgggttttaggaccttcaaaagtcttaataccttgtactttctttcctagctcatgaccaggcaaaaatccttgtctgagcatctgcttgggtgtttttacaaagcttctccaactctctcccaggttctgctagctaaagttttttcttccctgaaccatgggcaacaagaatctatcttatctgaaatttttttctaacaattgttcttcaaaccctactcctctcgcctgtagcagctcttgaaggctgtggacaactgcctctttggaagtgtctagtcccatatttcgatgccaaccctaagtggaatcagcgccgggttagcactgttccaacttagcccgtatccaatcgcacctccagcaacactttaaaatatgaagtttaaagccagcgctagcataaatacctgttgctcactgtgcccgatatgatattcttgttcttcccttcttgtggagctccacataagacagcagtccctcagctgtaccccgccattttcaggtccgtgttcatggcaccaatctgtagtagtaagctgcccagggcctacatgaactgggtactcctgaaaggcaggctggggctgaaagagactaaatggggagagaaataaagacgccaagacaaaagtactctgttcaaggcaccttaaagtttacttagtgtctaagcttatatagggggtaagcccatgcccaccccaccccaaggtctgcatcagcccgcttcaggctgggggaggctacagggattgtcagactagccctatgcactggttgagagaccagtgctagatctggtgggttgtgggaaaggcataaatggggatttctgagaaactcactaggctagaatatggaagagaaagaacatgggacatttgggtgctaagggggtggctcaagactgtacagaaggggcctgtgagtgattgcaggtagggtgagtagtagcagaaatgcaggtgcggcttcacactaggcagaggcagtgcttttgaaacctgtgctagatatggaaggagcaaaagacatggatcagaaagtcagatggactcactcacctggcttgactttggaaaaagatatgtgaagtcgtgtacagagtgggatagattgaagtggtgcagaacagactggtgggtggttctgctctgagctcttatcattacattttggagcaaatacaacaaagaaaatgggtgtagctcattttttataaggtgctttcacacaactcactcattttgtctttgtgtaactcctacatgaaaagtagtagtaagcacattttacaatttaataaacctggggcttagatgaactaatctatgtaatatgatataactgataagttctttgctttcttccatatgaaaccatatggtaaagcagtgctttaccatagagctctttgtgtaatattactggaagactaaattgggacaagttaacagtattgttatcgttatggtttttttgtttctactttgctttatacaattgttgaactgggatcttttgatatgaatgacactgcttgctcgggcactaaatatcccccagacttatattcttataaattgtcctatcttctttttttatcctttttaaatcactttctctgctctgagctgttactatttgatgtatcttgcagctcccctacttctaatcagtaggtaagtacataggactttcatctgataatacaaaacctaattctctaatgttttcattatttgaatatacatttttgcctgttttctatgttgttagctaattctggatagttgaaggtgctaggtaaattacctccagaagtgagatattcttatatttctttaccacctgtgggcagctccattttgagttcttattgttacattttggaggaaatacaacaaagaaatagagagtaggacatattttttgaagtgcttttatacactgtattattttgtccttgtgaaatttctgcatgggaaatagcactatctacattttacaattttttaaaaaaaatctgagacattgtgattaactgatctatataaacatatctaattaataagtgaagtactcaatacttttgtttatatttattttttgaggcaaagtcttgctatattgttcagacttaacccaaactcacaaactcctggcctctacctcctaagtattgaaattacaggcaaccacacctggcttgactcttactttaaataaaacattactgtggccaagtatatgattcagttggtacacagaaacctaaggatctaagttgagatccccataactcctgtaaaaggcaggagtagtagtgtatgcttgcagtcccagtgcttgggactcatagacaggaagatccctagggctggctgatcagccacttatgctgaatttgtgagcttaaggttcagtaagagactctgtcttaaaaataaattgaggagtgattgaagaacacaccaaccattgacttctggcctgcattcaatctgtgtctgtctgtctgtctctcatattcctgttaccatactctgcaaacaggattctgtgaaattttagaaagctatttattgaaggtttgaagtgactgcccaatgtaccttattccatagtagtacttaatttctttttttttccagtcttttttgcttaccttttgtctccctataagtcttccaaaaatagtcactgaagcttcccatataaccctctctgcctaggtttactcgttaacctcccttccatttttggataagttttgacataaagatgtattggccatctacagggacattgctcttataggtagcactgcacttcatgtaaaatttgtgtctccagctggctgaatagtcttatagtactcagtactgtgtatacataaaattcagatgtgagagttgtaaacatgggcagatacgttgtgtctaaatagaaatggtattttttttaatttttattaattgtgattctcacatcctgcatcccaatcctactaatcaccctgttccttcatatccaccttccgcccttgcaacctcccacctgaagaaaaaacattttgcagcagaagctgtagtgcgtcacacatattgtgtcacacagtatatttgtccactcttctttgcttgcaaatgttcattgcaatgagtcatttgtctggtttaaggtctcttgtttctgctgcattattaatacaggatccccaccagggcttctctcagatatcctgttgttgctttgtgtcagaaagatcaggtagctttcattctgcaaactagcccccgcatgtgctctagcagatcatagatggggtatgtgttgaggtgggccaactcaaggccctggatctgggcttgggtggtagctgagttggtcagcccaccagctctcctgcactggaaccaccatggtcagctctcccatcttatgctattggggtagctctactgtgctgaccaggtagggtgctgggcctgctctctctaaatttactttttaagttatgtgtaaggtgatggacaatttgtggctaatcagtatatgcgttaattcaatggaacttgatgaaaatgagagaaaaggatgcagatttcatcctctgtgaagtatgaaattaacaaaagttgatatcactagctaaaacatttggttttaaaaatgtctcaggaaagattgtattcttcataccaatgagaaggcaaagttcttatttttgtctatataatttaaggtaaaataattacttttactgttacaaattacatatgtgtcacctaatgcaaacaaaaatgggaatgactttggaatttctgtggtctatgaaaaacatggagctgtaatgttactaacttctgcctttgaattgggctttgggaaaatatttttggtttgatgctttttggaactcacaatggaatttaagattcatgagatgattggtaagatacatgtccaaatgcccttgcataaatccatttctggcatgaaaatattttctggaaatagataggacgtccaagccttccagtgatcctggaggtcagtttcctggagtctccttgtattacttacttgtcagtttgctgtgataaaacatcatgcccaaaggcagctcagaaaagagggagtttattttggtttatggttccagaggggtaagtacccatcatgtttgaaaaaactgagagattgcatcttcagccacaagtgggaaatagagcaaacttgaagtgaagctatgaacactcaaagcccttccccaggacatacttcctccagcaagcctgcatcctccttcaaacagtgctaccaaccagggaccaagttttcaaatattagtgcatatggggacacagtttcattcaaaccaccacaccttttttctttagtagttgttatgttttacatgtgaacatgtcagtaaataaattttgggctgacttttcagagagaaatctgttttttttcttttatatctaagtgtccattataggaacatacagttagtaggcattccaatgatcctgatgagatgcttattggtaagtgaaaaggtgttctctgaagggtgaaagtggtctgctctctaaagataatcaaggttaccacttcaaaaatatttcaaagaaactgaagtatcagggcaaaatggtaaattatgaattatgtctctagaatactgcatctgctcctttatgtgacctcaactctagcaatataataaaggtaaatgactaaacatttataaacagcctcacttattgaataaagacaatcagtagcttgatgtgttatgtttggaggtagtgctacagatactttacatggtataatgcttgtgaggtcagcccctgatatttgaaagacatgcaaatttaaccagagcagcacagtttggagttttctttgatgtatccactagctttagtttcctgtagacgatgatgagtgggtatcaagtgtaagctataatataaacaaatgagatgtatacttttgggttttcaattacttttcatctaactgcattgaactttcatttagtgaaccaaattgaccgactggcaactgttgtgagactctgctataataaatcttgattaagcatcagcagatgtaataggtataagagttgagctagacagaaagggtcagatgggtggacatttttgatctgtagagcggataatgagatgatatcaaaatgaaacttccatacctcttcacccttcctctgccattactttattctgagaactgaacttatagatcagtgatccttatttaacttttcttataccataactgctcccatttatgctttgtattaataatgtagcagaaacaagagaccttaaaccagacaaatgactcattgcaatgaacatttgcaagcaaagaagagtggacaaatatactgtgtgacacaacataagcttttaaaaagttatgtctttttggaagttgcttattaatgaatgacataattaaagaaaaacatcaagaatgactttgcttatctttgttttacttgttttttctatgtattctcttatttaacacatcccaaccacagctttccctccattccctctttttagtccttctccaaccttttcttttcccccagatccactgcttctccatttctcttcagaaaagagcaggcctcctagggatatcaacagaacatggcataacaagatgtagtaatactaggcataaaaactgaagaaaatcaacctagtgggagtaaaagagtgagtcccaagagcagggaaaacagtcagagacaaccccagtcccactgttgggagtctcacaagaacaccaagctacacaaccataacatatatgcagaggacctttgcaaagacctatgcaggctctattattgttgctttagaagtctccatgagccctgcttgtttgattctgtgggccatgttttcctggtgtccttgaccctctggcttttctacaatccttcctcccactattgtgagaggttccctgagctctgcatagtgcttggctgtgggtctctgtgctggctccattcagctactggaggaatcctctctggtgattgttggcctgggtactggtctatgaacatagtaaaatatccttaggaattatttcattaattctttttgtcagttgtgtttggttctaccttaggtgtctgagcatggtataggtgtctgagtatggtagtttgaatagatatagccctatagactcatatgtttgaatgattggccatagggagtgacactattaggagatgtggccttgttggattaggtgtggctttattggaggaagtgtgtcactgtgggagcagagtttgaagtctcctatgcttaagctacatccagtatggcatgtagtctcctactgctgcttacaattcaagatgtagaactctccgatcctccagcaccatgtctgtctgttcactgccatacttcttaccatgacaataatggcctaaattctgaaattgtaagccagccccaattagatgttttcctttataagagttgccttggtcatggtgcctcttcatagcaataaaaccctaactaagacactgagctatccagcttccaatttacttgttttgaaaaatactgcctaattttcatcttacctttctttactgacactgtaagaataaatgccttataaaataatcttatacatacttgttataatagaattctcataaatgactgaaacaattttgcttatctgagaaatagtattctttgggtcacatctcaatcattctgacaccctgtcgtctagggtggcatcccgggatatttataatcttctcagtggttaccatgaaattatcaaactaaaattaatttgaagtcactttatgtaaaatgatttagataagatctccaaattaaattgttatacacagagaaccatttaatagttagaaattggtgctttggaacaatggttcttaaactatttcatttctacatgaaataatttattacactccactctatgaacaacagtcatttagaactaaatattgtaaatcatagtctgtcaagattctgggtacttatgttggtgttagaacttttatatgaacaggaaaaaaagacttaagctatcaaacttgctgtttctggccttgatacctcatttgggttatcatgaagaataaagaccctagtagatgatgaacaaattctaatgccatggtcttgaacttccatgctcctagatccatgatgtaaacaaacttgtattctttataaattaccatgtttcatgtattttgttataacagaagaaagcagactaaaacaaacagtacatagttgggggttatcactttctactattatgcttttgtttctagtctaggatgctgctcaggtctatagcatttgtgttagttagggtttctgtcaaaacaccatgaccaaaagcaacttggacaaggaagagtttatttcattttacaactctcatggcacattctcatcactgatggaaatcggggcagaagcctggagggacaagctgatacaggggctgtgaaggagagctgctgcctagcttgctcctcatggctttctctgagtgctttcttatagaacctaggaccaccagcccagggcatccatagtgagctgggcaatcccacattaatcatcaatgaaaaagagcaccccaacttgtacccagtctaattgaggcattttttttttcttggttgaatttgactggtgtggagttgacaaaatgaaaacaaacaagaaaaccctaccagaacagcatcatatccattcttaactatccttcctgtttgttgagtttttccagtgtcttcactttattttttctttatttttaaaattattttaaaatatcttaacataaccttttacttttaaaactctgcagtaaatttcaaaaagtcgaaaggtcggtttctcccagtggttacattttgtatagctacagtataatatcaaagcaggaaactgatactggtacactaattatatatattgtggtagtttgaatgtaattggttccataggcccatcgggaatgacactaataggtgtggccttgttgaggtaggtgtggccttgttgaggtaggtgtggccttgttgaggtaggtgtggccttgctggaggaagtctgtcactgtaggggtgggctttggggtcttatatgctcaagctgcacctggtgtggcagatatcttctttcctattgcctgtatatgaagatatagaactcacagctccttctctaggatcatgcctgcttgcatgctgccgtgcttcccaccatgctaataataaactaaatctctgaaactgtaaggcagcaccaatgaaatgttctccgttataggactcgccatgctggtcatgcttctcttcccaggaatgaaaccctaactaatacatataccttctgccattttatcacatgatatttttatagtcaatcaagacatagaaacatatcaaccacaaaaagctccctcttactacctacattttagggtcaagcccatgccttcccattctttaatattcattaaaaccaatcaacaactaaatcttttttaacactaaaacatggtcactcctagataactattataaatactgcgtgtgtatatatatatattacaaagttcgtttagtgttgtttgtatgtacttgtgtttagggctgatcacttaggattgtttaactataaccatatgttcatgtggtggcatacattgttaattactgtattctgaaggtataggcaggtgaatttctgtgtgttcaagattggcctgaactatatagagaggccctgtcttaggaaaacaaaaccaaaaactaaaactaaaaaaaccttgaataatcataaccattcatgagcttaagggcattttgtctgtttccagtttggctataatgatatgaactattatataaagttcccttacataagcataaatttctctggaattattattcaagagtataagcaattgtggttacattgttttgttttatatgagacttccaaattgtttttcagattatctgtgccattttatagtcccaccaacaatgtgggatcccatcttgccagcatttgatattatcagtaatctttatttcacttacctttactgtctacatgcacacatgcatgtgtaaatacatgtgcctgcacatatatgtctatcacacgtggggaaatcaaaagacaacttttgggagctattttttccttctaccatgcgttcctggaactcaaatcatcaggattatgtcacaagtgctctgagccatcttgctagctattttagtctctcagacctgtaatgatatcccattattgatataagttgcatttatttaacagctaatgaggtggaacatcttttcatatgcgtatttctcttcaatgtatgacgaaatatgttttcatgttgctttcagtccctctctctctctctctctctctctctctctctttccttcttcctttctttttctttctttctttctttctttctttctttctttctttctttctttctctctctctgtctttcttcctctttcactttttctttcttttggtatctatacatgctatatatgtgtataaatgttcttatgtgtgcatatgtgtgtacaattttgtgcgtgtgtgtgcatacatcttgagatcagaagtcaatgtcaaatgttttccttactctccatattgttattaagcaactgatgaaaactgatgcagaggcccacagccaaacactaagtagagtttggggagtcctgtggaagagggggaggaaggattgaaggaaccagagtgttcaaggaaatcacaagaaaacctacagaatcaacagacctgggctaacaagggttcataaagactgaactgccaaccagggagagtatgcatgggacagacctaggccctctgcacatatgtaaaagttgggcagatggatcttcatgtgggactcttgaagtgggagcattggccttctctgactctgttgccttggcaacaatagatgtgtctagttcttctgcatcttgctatgccaaggcaagttgatatctatgggaggcatccccttctctgaggagaagggtaggagggatggatcaggggaaatgagaggagggactgagagggaaggagggaagggaaactgcaactgagatgtaaaataaataaataaaaaatgaatatgggtaaaacaaaagcaaaaccaaaggttccatacatttatagaatgtgtattcatcatatccaccaaccgccacctcccttcagctccctctagtgacaacacactatcttgctcccagcttcatgtcctctttttatttgtttttttaaataattactgctcccttagtccatttggttccacttatatgcacacggagtgtgtgtgtgtgtgtgtgtgtgtgtgtgtgtgtgtgtgtgtatgacattctaccggggcatgaacaactttcaagtagccaaatacccaaagaaaacagactctacatcagcagctatcaacagtcaatgactactctaaaagttatggtgccatagagcccatcctctgtccatgctggaattttttttttttttttttttttttttttggtttttcgagacagggtttctctttatagctctggctgtcctggagctcactttgtagaccaggctggcctcgaactcagaaatccgcctgcctctgcctcccaagtgctgggattaaaggcgcatgctggaattttggcaggccagctcttatgcaggtattgtgcaggaaaccacaattgcttggcacctgcagctctcatatcacgaccagaagtcattatttcacagctctcttctccactcactcactaactcttaagttctttgtgcctcttattctctaagccttgcttggtaggagattgattccctgtccctgcctccccagcattgggataacaggtacacagcactgtacttgtttttttgtctttttacatcaatcctggggagctaaacacaggtatccatgattgtataggcatcactttatcaactgaaccatccaccccacttctttcccttatattttttatttttttattctctctctttcttttctttccattttttcacgttctttctcctcgtccttcctcttcctactctcactaaggttggaacttttataggcatgattactattgacaggctgtcccattgtttatttttttaattatttcttggttgttttatttacttttttgataatcttacatgtttataatacattctagtcaaatgcatccatctgccctgttttatctttatcccacccctacaacttccttgccttcttgtaaccaagtccctatttgaattttttgtctctttgctttgtttttgattttgctttgctcctcactttgttcaatcaagcccaccttagtgggaatggctatgaagctatctcctggagtataaataacttaccaattgactacataactgaagacaatgactttcttcactagtcatcctatactgcagtcatctcccgtagtagggcgatgtagtagggtgaacaaagaccctgtgagccctttgttcatctatgactgaatatttactgaatcagctttgtgcaggccccgtgtaggcaagtgtagctgttagtcatgttgtacccccaaaccactcttcatcaacctaccttatcatcactcagctcttaaattctatatacccaatcttctgtgatttttctcagaactttgcacatagtactgaacgtgaactctgctctgctgaataagccttggatctatacagaatagtcatgccactattgcaccattaagtaactatcatctgcaaaattagtaggacaacatgtaactggggatgactgttactgaccttttagtttttcctccagttgtctgcatgggaacttctaaatacaataaagatgccttagttacttgcttgttgctgtgataaaacaccatgaccaagggtttgtatcggtgtacagttctagagggaaaatagtcagtcaccatcatgggcaagaagcatggcagcaggaacagctgaaaactcatatctctaacctcatgcaaaaaacacaggaagagaaagtggactcaaaatggtgcaaatcttttacctctcaaaacccacccctagtgtcatactttctccagcaaggtcacaaacagacccacgaactggggaccaagtattaaaatgcctgggaatatggagtcatctgctatccaattcaaaccacaatagaggactaaccaacaggaaggaagcctctagctcggttctattacaatttctctgtatttgcatacaaagtatcttcaaaaatagtctcttaccttccaatttttctgggtaaccaatgacaacttgtatagtttttgaggactctgggacctttctgttcaacagctcctaaggaggtgccccacacttggattttctttgaacaacttatgacttctgagatcatcattagccatccaatatatatccatatatatatatatgtagatatatatatgtagatatatatatatggatatatatgtgtgtgtgtgtatatatatatgcatgctttataagctaattataatatatataattatatattataattaacttagaaagtagtcagcttccatgtggtttcattatgaatacttatctttggttagtcttttccatgaactccatcttctcccccttctttcatgcctatccttgtttaaacttgccactggcagtatttctttccaatgtctccatatcatgtgtatactacctttcttacctttcttcaaatctctttcctacttcaccatgacccctttcttgcttccacatctctacaggcataccatgataaccaaatctaaaaaatgcaatgctgtgttccgcatatgagaaaggggacatggcatttgactttctgagcctgagttacctcattcaatataattgttctagttccattcatttttatacaaattctgcttttctttccagctgaataaaaatacattgtatacatgtgccacactttactatttattgacctgttgatagatatgtttgatgattccatttcctacatattatgaatagggcagcaatgaataaagatgtccttgtttttaatagctgagtagcattccattgtgttaatgaatcacattttctgtatctatttttcagttgacgggcatctggatcttatccagcttctggatattacaattaaagttgctatgaacacagtggagcatgtgtctttctgatatgatagaccatctttgggtatatacccaggagtggtatagctgggtctaaaaggagaacttttccaaattttctgagaaacaccaaattgatttcagagtggttgtgcaagtttttatttccacaagcaaagaagtgtcctcctttctccacatcctcaccagcatgtactgtcccttgaacttttgatcgtagtcattctgatgagaattaggtgggatctagagttgttttgatttgcatttacccgatgactaagagaaagtaatcccacattgactcaaagcatattatgttgtaaattatttgtagcatatttcaccaaatttattgcattatctagaaaatatgtctaatttgtctaatttacttgggaaattcatttttaacatgtgatattaaagctacaaaagtttaatataatcactttaaagggtaccaaaatttggaagaagtagtaatagatgatagctatattctatagctatatcaaaatctattctatatagtatagagattatgatttgctcagataactataaaagacaacaaagttaataactacttgctaatcatagatcattaattttgaaacttaatagaagactctggacttaatgggttatattgaggaatatactggttacttttaggaacacatatgtatatattaatacatgtatacatgtaataataataataaaaagagatcatatatttgagggagaatgaggaggtatataaatgagattgtagctaaattgcaatctcaaaaataaaaactaaatgaatagaagactcatagttaactttatttccaagttgaatcaatatatttttaatagaaatgtaagaaaaattctaataggcatagtatataaataggaatggaaatatattaaagtctttaattgttattttacaaaattgttataatatgacaaaaacataaatttgatgacagcaaagcttaatattgtacttgtgtctcaaaattttagatgagcagaaatgtgaatacaatttcaatacacatattcatgcataaaattctaaaagaattaataaaaataattattttaaaaactatatattcgtgaaaagaagtctgaccttgttagttagcagtgtgccttaaaaaatccatactagttaacctgataaaacaaattaatgacttaggtggccattacaaatttagtatataaaaaaattcaagtgtgtgtgtgtgtgtgtgtgtgtgtgtacatgatgtacctatgtacgtgtagttacatatcacagtgtgtatgtggagatcagagcacagctttgtggagctatctttttccacctttatataggttctggggattaaattctggattccagacttgtgcagcaagtagatttactcatcaagcaatcttgttgaccctgttacacagcatttaaattaatttaaaatattttaaatcgttggaaattttgtaagttgattggtgttcccatcaccccactgggggttctgtctggctactgaaagcaatctcttcaggttccatatccccactgttgggcatttcagctaaggtcacctgcattgagtcctcggagcctccccatctcaggtctctggaatttcttagagattccctatacccctcccccagcagctgcctatttccactcattttcctgagcctttcagcttctcttctgtttctccctatacctgattctgcccaaccccattcctctctcctcatgtctcccaccctgatccctccctccctctggttcccatgactattttggttgcccttcttttttttttttttaattaccaactctttttttatttttaaggcattttctattagacattttaagtgggatttatgcatcctcacttggaccttccttcttgtttaactactttgattcttttggggtatatcatgcatatcctgtactttatggctaatatccacttatcagtgagtacataccatgaatgcccttttgggtctgagttaatcactcagaatgatattgctcctgtctaaaagaaatgccgggataaaaatggaccagagactgaaggaatggccaaccagtggtgggccaaacttgggatccatcccatgcatgccatgtatgcacaacaaaccccaacactattgcagatgccaagatgtgcttgcatacaggagcctgctatggctgtcctctgagaggttctgccagctcatactcacagtcaagcattggactgagcctggggaccccaagggaaaagttaggggaaggattgaaggagctgaaggggatttcaaccccataggatgaccaacagtgtcaactaagctggacccctcacagcttccagagactaagccaaaaaccaaggagcatacatgggctggtctgtggccctgaacacatttgtagcagaggactgccttttttggcctcaatgggaaaggatgcaccttatcctgtagagacttgaggccccagagaagagggatgcttagcttagcatttggcagggttgaaaattaccatcagtgggattaatgcatctcacttatttgtttaataagccaatataagattaaaagaagaatgtctttataaatatggacacagtgatctctgactatcatttttactataatcttttaagtggtcttgtcacctttttatgtttcatgtgtatgaccagagccataggccaagacagataatgttaccttatttttgatgttgagtgaattttatgagaattgccaggtacatttggtgttggtgcatgattgtagtcatagcattcaggagactggggcaggggaattttcataagttcagtgtgaccacatgtaacatagcgagactgtttcaagggaaatataaaagtgatatttatggggaaagtattttgtgagattgctttacaaattattaaaattatagttaggaatgacttataaagtatacatttaagttaaaagcaatttaattgaataatattgaaggacttctgaaaagcttttagtcaaatgtacgtgggtactgttagagatgcagtatctgaccacaagctataccttatttatatgtagatcctctttgtatgctttattaccctgataataaaaggcactactctattttgtaacacagtaaatttcctttttcctcaaagttatggagggaccatatttagctgagtttatgaggtttctctattaattcaaaccttttagataatattgacaatgtaagccccccaggctacttttgcttgattgatgaaatattacacgaaacttgaatttactatgatgagactttagaaatactgataagaacaagctctctctgtatagttgtctacattaaacgcttgaatcaacagaaagttagctgtggctacaattaaatgaaatatgtctttgatatttgtttctaatactattgattaagaaaagaaatgactggggcaaaagataatccccaaattcacaaacagtgataaatactgttctcactcttatataactgaaggtttgagagccaaaataccaggaggtattgttcagtattttatcggtcatctgttttgacacttccagcttttatgtgccccttcattttcctctttagagacacttagtgaataaaccttctaaaacttgtagtgagtttactggttggtttttgtcaacttacacaagtcagagtcatctggaaagatagatctcaattgagaacatgccttcttcagattctctgtaaacaaatctatagggcattttcttgattagtgattgacatgggagggcctatcctctgggcagatggtacttagttgtgtaagaaagcaaatttactaagtcatggagagcaagacagtaaacagggtccctccatggtctctgtttctgttcctgccatcaggctctttccttgagttcctatcctgacttcctttgatgactgtacggttgtggtttttgtttgtttgtttgtttgtttttaatcacaactaagatagaaggaaataatgactatatactatggttttcaccaattgcaaggttcattgaatttttatactctgttaagtaaaatactcaccagttcatgcatcccataaattttttggttgtcttttggattacagttaaaataaccttctattgagtctgtatcttgctacatcaattttgttgttttgtcttagaaattgtaaggacaaaccaatgaatgatcctgagccttcagaatgctagaataaaaatgtttactgcaattttaaagcctaaatctctacttcagtgttcggaacattttttttttctttttacaaagggccagagaagaaataaccttcaactgtactgatagtaagcttccatagacaatacagaatagagtgtgtctatgtagtattaaaactgttacccccagagacccctgggactaaaccaccaatcaaagaaaacacatggtggcactcatgactcaagctgcatatgtagcagagaatggcctagtcggtcatcagtgggaggagaggcccttggtcctgtgaaggttctatgccctagtataggggaatgccagtgccaggaagcaggagtgggtaggttatggagcaaggggagcgggggaggataggggattttcagaggggaaactaggaaaggggataacatttgagatgtaaatacagaaaatatctaataaaaaagaaaaagaaaaaatgtgctttctaaaacaggctgcaatatatttcaaaaataagtacagatgtccaacaaacatatgtaaagaagttcagtattactactcatttggaaaatgaaaatgaaagtcacttcacttttaactaaggatgcatacaattaaaaaaactgaaagtagtttttagaaggattcatagaaattggaataaaatatattggcatctttggaatctaaaacttcaagtgtggcagtttgattaagcaaataatcccatgatataaaattttcattcataggtactgccttagttaattttctattgctgtgaagagacactatgaccaaggtaacttacgtgaaggcatttaattgtgggcttgcttacagtttcagagggctagttcaagatcatcacagtggagatcatggcaatggccatttgggcatcttgttggagcagtaacagagcttacattttatctgcaatttagaggcagagaaaacaactgggcttaggcttttaaaaccacaaatccaacttcctatgacatatctcctttagcaatgccacagatcctaatccttcccaaaatagttccaccatcttggaaccaagcattcaaatggtatgatcattagagtatcatttttcattcacaccattgcaggtacatgcccttaaaagctgaaatggctattctttacatacttttataaaaatgttcatagcagtattattcacaatagtcaaagctggaaacgatctaaaagttcactgctgaatgaatagataatcaaattatagcatacccacacaagagcattgtgtggcaaccaaaagaaatgaagaactagtacatattatgacatgggtaaaccttagtactatgccagatgacagaagtcagatgcaaaaggtatgattccatttgtattaaagacccacaataggtaaatccatggagacagcagattcataatttctagggactggtataggatgaggactaagaataaggaatggatgattaataaacacttctttgagaagcgatgaaaatgaattggaattaaatatagatgatgagacggcagaactcctgtcctgttctcttgctttgctctcctcttcagacaatatgagcttcaccaccctctccactaccttctccaccaactaccagtccctgggctctgtgcggactctcagccagtaagtccagcctaccagcagcccagccagtgtctatacaggtgctgggggctccggatctgggatatccctgtcttgctccatctgggatggctctcttggatcttcaggcctcgtgggaatgggctgagagtctcaacggtgctccggactccaacaactccatgcaaactatgaagaggacaactatcagtaaggtcgtggatggtaaaatgatgtccaagaccaattacaccagagttctgaggcactgaggctgagaaggagagagcccctggagactgagggaccaataaaagttgagagctcactggaaaaaggtatagatgatgggtatgcactactgaattactgaagtggacagtttaaagtagttaattccatgttttatgaacttcacctctatacaaaaaatggacagttatgatgattgaccagagtttactgacctctgctctatttggtaagtgagtatcctctatctccttcatttctgaggtttctctgtctctcatatcatgagagctgctagagaatatgcctaaatttgcaggaaaaggtatatggctttaatgcaacccagctaccatgagctggtaaaacatagaacgattctctcagggttttgtcagtacatcatcatcattgttatcatcaacaacaagaacaacaacatcaccatcgataacaataacaacaacaacaacaacatgactatttttgaagcagagtatcactatgtagtccttgttagcctagaaccatgaattcttagagttccatctgtctgccttcaaagtactgggaaagggtcttaaccccataccaaattaaaaaaaatgtttatagaagcagccttgctaagatataatccatacacgcatgcacgcgtacacacacacacacacacacacacacacacacacacacacactagaatctacctatttaagttacatgatttagttacatgatttattttttaaagtcatattctatgaaaggtctaactacttctatatttaactttagaccattttggttgttactatattttagccagtataacaatacacctggggtgttggaaaatgattcagtggtagtacctagatttggatccccagaacctaagttaaagagccaggtgctatggtacatgtttatagtcctagcactggggaggcaaaggtgggaaggttcttgcggttcaccttgcattctatcagtcaagctgaagaaacaacaccagaccaatgagaaacattttcttgtaaaacaagataaatatttcctgagaaacaacactcatttttatcaaactttgccctccacatgcctgcctactcaaatgtgttcacacagacatatgtatacacagaaataatacatctatgaacactcatgtacagatgtttgtgtggacatatgtaatcatttatctctacacctaggggtagaattgctggattatatgacaagtctatgtttaacctaatattatccagtcagcagaaatttgtgaaatttctcatttttttctcaaccttaccagcacacattatttatctgtctgttaataaagatatatttgaaataccacaatattccttcttttacaggttgtctgccactgcttttgcaatacaatcattttggtggttataacaaagatattatattccactataaattacaaagcacccagtagttacttgtagaacttttattgttctactaacttgacttgtgaattaaaagtttgccagctgctgctatacagggattctcattaagttgaagttaattgtgttttttaatgtcttagtgaagtctgataatgaggattcttttttctacattgtttttctttgaatgacactcctaagtggcctgtagtcactttgtgtgtgtgtgtgtggggggggggggaaggcgtatcctagatataaagttttatctatttggtagaaagcctatgatttaaaaagaaaagacaatttgttctcatagtttatcatccaaagcattgacaaagagtacaaatatcaaaagggtaccaataaatgtgctattccagaacttgagttatatagcttggaatatcatagtggagagggtaagattgaattagtaagttaaaaatgaaatgggaagggagtttggcaggtaaagatctgggtataaggcgggtgctaagtcttggaagaagctatagtgctaactttgttcccagaagggcctatagccaagttctatcctgctgtattttccaccaagggagccaaatacaaactggaatggtcagagatatggaaagctgctatcagaacctttcctctttgttgataagaaaaaaggattatatatgaaaatgccactgggatcgagatggtgtaagtgaagaaatagaaaagtgaatcaggcaaaatttgtcatgttcgatctctgaagagctttgattgctattaattgtgttcaggaaacataacattaaatgttccagaagacatacagcagctactaaggaaacttgaacttaatggaagaagaggggttacagagccttgcctagaagttatttttgttttgcgtggtcacacaaatgagtagcctagcaactgaaagcaactgcaaggtacattagtgacgctttgtgtgattatacagtactgcttgttttaagcaggatgtacttcattatggaaggtttttatttctgagacatttgttaattgaaatgtcccagggagagactttgttttgaatatattgaaggaagttacaagtctaagccaaggagcagacaaaatctagtacttgtcttctgtgctgtgagttaactaattaataaaacaaaatggatggagcaggaaagcatcatagtaagtatggtaactcagattcagaaagacaaaacttacatgttctatttcataagtcacccttgtttataaggtgtgtgggggtgggggagagagagagcagggggggagagggacaggggggaagaggagagggagaggagagagagaaagggagagagagagagagagagagagagagagagagagagagagagagagagagagagagaaggggggagtataggaacaaattataaaactagaagggaaaccatgagaagtctaatgagacaatgtgggaacagtgtagggcacatgggacatgaaagaggaagcaatgggtggtagatggaggagtaggtggaggagtggggtcaagagagttgaaaaaaaaaggggagggagaacaacaacaaaaacaaaatttgctttaaaatgcccaaatggaacttaattactgtgtatgttaattcaaacgcttggatataaaaaaatctcttgtgcaaagaaaaatctgttaacacaactaaggacttggaggctgaacttggtaaagctccttctcttcttgtagaaaatgcactaagaccatagcaaagcatccatttccatgcattgttcatgacattaaatgaaaacaccatgttcattgtaatcagactttcactcttatagggataaaatatgatctgtaaaccgggcatggtggcgtacgcctttaatcccagcacttgggaggcagaggcaggcggatttctgagttcaaggccagcctggtctacagagtgagttccaggacagccagggctacacagagaaaccccatctcgaaaaaccaaaaaaaatatatgatcaataaataatatataaggatttatatcattatgtgccataaattatgtccataaaaattaaaaactaatgggactggagatgaattatataggtaaagtggtgaaataaatgtcattcaactaaatgattttctggggagttggaactcatgggatagttttaatgacagaagaaatatttcgtgggctaaagtggtaaatataatctgatcttatttcatgccaaaactaaggtagcagcaaattgaccagataaaaaaatttatgaaattagtatcataaaatgaaggatatcatattccttgaaatataatccaaatgaatgataaaggccagatgtcttcatttcctccacattcactgtcaccattctgttcaaactgttgtctagaagaaagatggcagcagctgcctggacctgcagcagagcatcctggagtttcagagacccaaggaggttccaaggagtgacccgagggcaggagtttgcagggccagcaatagctccagaacaactaaggggaaaaatagacaagtcttatggaaaagtgcttttaaaatgtgaaatcacaaaatcagaaggaaaaatggatgaacagagctggctcagagaatgatgaatttgtacccttcactgccactagtctcagcttcaagaacaaaatatgtttctgatgagcattggtgtataggcaccaaggactgggagatgtgctgccccctggagttcctgcaaaaatccattattgttgaatagggccagcataggtcctaggcacccaacatggaggccctgaagctgcaactccatgcttcctgtcctgctgggacatggaaagtactgagcagcatcactgtacacaggcttcaaaaggtcacgtctggtgagcctcaaggtggcagacattgagggcagggaggtgtgtgactgccagcagctcccacagaacttaccccagcctccatccctccccaaagccccagttattgacaccctgcctagctccaacattatcctggctctgggaaacgaaacaataggatatctgagacaaatctcaacaatggtccaatatttatggtgcaacagaaaccttgatccagaccaccacctcattgcaatgaatatctgcatgcacagctgtctgagacagacagacagacagacatacagagacactgcagtttctaatgctactattatggatgaatatttgatagagaggtgggaaagatagaggactgtagcagtgagcgagtggtggaaaaaggaatgtggtgttgctgagtagggccagcccagtggtgtgcagcagattgaaccttgcaatcttactcagcccccagacatgctgtgcagactcatgatcactctggtccgaagcaatgacaggattccaaggtgaagaacagtacattttctgaattggatctccttgaaatccctctatgatcactgctgcctttggagaccactttagtatctgtggtctgctgctccaggctctattgaagccctagattcaggtagatgtctgtgatcctacagcagctcagagacttgttgatgtctctggcccgacttaccactgaaagctatatggatatccttggtctgggcaaccacctgaggccatcctgatgtctatggactgtacttctacctggatcaatgttgtgagtagcctgggaagccacctgaggccattttgattgatgtctgagtccatcatcctactctatccaggacctgtgttgatgtttgtggcctgtgctaccactaaaggttattcagatgtctgtggtgtatggtaccactggggcaatgtctggatggtcctactgcagcaggggtttgttgatttctgtggatcatgttgccactgaaggctgtgtggatgtccttgctctgtactgcagtctaaacccattaaatggctatgggctatgctgcctccaaggccatgttgatgaaagtagcttggggttgccccttgagaccatgttaaggccttggcctatgttgacacttagggctatggtggtatctgtgacccacagagcagtcacatagagggcatgatgtccatggtctgtagccacaggagaccttttttgttgttgttgttgtttttaaggcatttattattagatattttctttatttacatttcaaatgctaaccccaaagccccctataccctccccctaccctgctccccaacccacccaatcccgcttcctggccctggcattcccctgtactggggcatatgatcttccgaataccaagggcctctcctcccattgacagctgattaggccatcctctgctacatatgcaactagagacacaagctttgcggggggggggggtactggttagttcatattgttgttcctcctatagcattgcagacccctttagctccttgggtactttctctctagctcttccattaggggccctgtgttccatccaatagatgactgtgagcatccacttctgcatttgccaggcactagatagtctcacaagatacagctatgtcagggtcctgtcagcaaaatcttgctggcatatgcaatagtgtctgggtttggtggttgaatatggaatggatccccgggtggggcagtctttggatggtctttccttccatctcagatctgaactttgtctctgtaactccttccatgggtattttgttccccattctaagaaggagcgaagtatccacactttggtcttctttcttcttgagtttcatgtgttttgcaaattgtatcttggatattctaagtttctgggctaatatctacttaacagtgagtgcataccatgtgagttcttttgtgattgggttacctcactcaggatgatatcctccagatgcatccatttgcccaagaatttcatgaattcattgtttttaatagctgagtagtgttccattgtgtaaatgtaccacattttctgtatccattcctctgttcagggacatctgggttctttctagcttctggctattataaataaggctgctatgaacatagtggagcatgtgtcattattacaagttggaacatcttctggatatatgcccaggaatggtattgctggttcttctggtagtactgtgtctaattttctgaggaactgacagacagatttcaggagtggttgtacaagcttgcaatcccaccaacaatggaggagtatccctctttctccacatccttgccagcatctgctgtcacctgaatttttgaccttagccattctgactggtgtgaggtggaatctcagggttgttttgatttacatttccctgatgattaaggatattgaacatttttttcaggtgtttctcagccattcggtattcctcagttgaaaattctttgtttagctttgtaccccatttttaatagggttatttgatccatcttaaaatcagccaccaaaccaagacactattgcatatgccagcaagtttttgatgaagggaccctggtatatctgtctcgtatgaggcaaatacagaagtggatgctcacaatcatctataagatggaacacagggcccccaatggagaatctagagaaagcacccaagtagctgaaggggtctgcaaccctataggtggaacaacaaaatgaactaaccagtactcccagagctcttatctctagttgcataagtagcagaggatggcctagtcggcctacactgggaagagagactccttggtattacaaactttatatgccccaatacaggagaatgccagggccaagatgtgggagtgggtggggaggggagcagggtggaaggatggcatagggaactttcaggatagcatttgaaatgtatataaagaaaatatctaataaaaaataattgatttggaattttgatggggattgcattgaatctgtggattgcttttggcaagatggtcatttttactatatcaatcctgcccatctatgatcatgggagtcctttctatcttctgagatcttcttcaatttctttattcggagatttgaagttcttgtcatatggatctttcacttgcttagagtcacaccaagatatagtattcgtgactattgtgaaaggtgttatttccctaatttctttctcagcctctttatcctttgaatagaggaagaacactgatttgtttgagttaattttatatatagccaacttgttgaagttgtttattatgtttcggagttctctggtggaatttttgggtcacttaagtaaactatcatatcatctgtaaatagtgatattttgacttcttcctttccaatttgtatccatttgaccaccttttgttttctaattgctctgtctagtatttatagtactatattgaactggtagtgagagagtgggagtcttgtctagtccctgattttagtgggattgtttcaagtttctcttcatttaatttggtgttggctattagtttgctttatattgcttttactatgtttagatataggccttgaattcctgatctttccatgactaatatcatgaagaggtgttggattttgtcaaatgcttcctcagcatctaatgaaatgatcatgtgttttttttttcctttgagtttgtttatatagtggattatgattatggattaccatatattgaatcatccctgcatctctaggatgaagcctactcaatcatgatggatgatcattttgatgtgttcttggattcacgttgccagagttttcttgagtatttttgcatcgatattcataagggaaattggtctgaagttctctttctttattgggtctttgtgtagttcaattatcagagtaactgtaggttcatagaatgaattgggtaatgttccttctgtttctattttgtttaacattttgaaaagcattggtattaggtgttctttaaaggtctgatagaactctacaccaaacccatctggtcctgggatttttttggttgggagactattaataactgtttctactctttaggggatatgggactgtttagatggtttatctgatcatcatttaactttggtacttggtatctgtctataaaattgtccatttcatccaggttttccaattttgttgagtataggcttttgtagtaggatctgatccaaaaaggatttcctcaggatctgttgttatgtctcccttttcatttctgattttgttaatttggattctgtctctgtgccctctagttagtctggctaagggtttatctatcttgttgattttctcaaagaaccagttcctggtttggatgattctttgtatagttctttttgtttctacttggttgatttcagccctgagtttgatcattttcttccttctagtcctcttggaactatttgcttctttttgttctagagctttcagttgtactgtcaagctgctcttgcatgctttctccagtttctttttgtaggtactcagagctgtgagttttcctcttagcactgctttcattatgtcccataagtttaggtatgttgtggcttattttcattaaattctaaaaattttctttttttatttcttccttgaccaagttatcattgagtagagtatttctcagcttccacttgtatgtgggatttttattatttctgttgttattgaagaccagccttggtccatcatgcatgagataggatgcatgggattatttcaatcttcttgtatctgttcaggcctgttttgtgaccagttgtatggtcagttttggagaaggtaccatgaggtgctgagaagaaggtatatccttttgttttaggataaaatgttctatagatatctgttaaatctatttgtttcataacttctgtcagtttcactgtgtctccgtttagtttctgtttccaggatctgtccattgatgagagtgggatgttgaagtctcccactattattgcatgcagtgcaatgtgtgctttgagttttactaaagtttcttttatgaatgtgggtgccctagcatttggagcatagatgttcagaattgagacttcatcttggtaaattttacctttgatgagcatgaaatgccctccttgtatttattggcaacttttggtttaaagtcgattttatatgatattagaatggctactccagcttgtttcttgggaccaaattgctttccagccttttactctgaggtagtgtctgtgacatgggtttcctgtatacagcaaaatattgtgtcctgtttacatatccagtctgttagtctatgtctttttattggtgaattgagcccatagatattaaggaaaagtgattgttgttttctgttatttttgttattagagatggagttttatatatatatatatatatatatatatatatatatatatatatatatatgtctatcttccttttggtttgttaaaagtttattttcctgcttttttcccttactgctcttaatattctttctttgttttgtgcatttggtgttttgattattatgtgaagggaagaattacttttatggtccaatctatttggagttctgtaggtttcttgtatattcatgggcatctctttctttaggttaggtaagttttcttctataattttgttgaagatatttactggctgtttaagttgggaatcttcattctcttctatacttattatccttaagtttggttctctcatcatgtcctccttttttgggttatgagctttttgctttttgaattttctttgactgttgtgtcaatgttttctctggtatcttctgtacctgagattctctcttctatcttttgtattctgttggtgatgctcacatctataactcctgatctctttcctaggttttctatctccacagttgtctccctttgtgtttctttattgtttatacttccatttttagatcctggatggttttgttcagttcctttacctgttaagttgtgttttcctgtaattctttaagtgatttttaggtttcctctttaagtgcttctacctgtttacctgtgttctcctgtatttctttaaaagagttattcatgtccttctgaaagacctctatcagcatcatgagatgataattttaaatcccaatcttgcttttctggtgtgttggaatttccaggacttgctattgtgggagatctatgttctgatgatgccctgtagtcttggtttctgttggtaagattcttatgcttgccttttgccatctggttatctctggtgttagttggtcttgctgtctcttccttgagtttgtccctcctgtgggcctgtaagcctgtgtcagcactcctgagtgaccagctctcccctggcaggacctgtgcacagaggggctcctgggtacagctggaggcaggaaggaccctatcccactgcttttggggcctggcctgtgcgctcctggttggtcctgccttagattgtcactggagagaaaatggcaatctcacctccgagtccaggagtcagaacactccctggagatgagctctcccctggcaggacccatgcacagaggactgtggaacagccccagcttctggctgcaatagaggctggaaggaccctgtctcagctgctccactgctcctgcggcctgtgtactcctggctaataagtacagttttataaataaataaatcaaatcatttaagtcacagactggaaagataacatgttaaataaccagcttccaaatgacagggctcagatttgatttcagtaagcctgagatcatatttcaaaaaatctaccctcttaatcactgtcaaatgggcaaaatagataaaatcaatgtggtatctaattaaatgtcagtcagaaattgaagttctattttaggaaatgatacatcaatagagaaatggtatctttattgaaatttaactgatatcatttcaggactatatttgttgtgtaagtcagctttctgtactacatcaaaaaccctgacaatatgagctaaaaggaaaaaaaaaggaaagatttattttggctcaggttgtcacaggttttagtctatgatcacttggccccaatgcctttagtgctgaacaattgccttaacatgatagaagtacttggtggaggaaaatactcaacttatgctagaaatgaagcaaagggggaaaaaggaagggcagcagcagttgagtcccccctcgagcatgtagtatcacttcattttactaggttacagctcctaagtagctcaccatctccatcagcctcatcaaattggaaccatactttgacacaaaaacatttgggagacatttaagttatagaacataacaattgtttcatgacataaaagcatacttccatattgaaaagcaatccttagtgaaggtgttagaaactgtcttatataagttttattttgcactctctatttcatcagtcaatatgattattatcaattaatgtttctttgggtagaagtaacagaaaacccaaccaagtcaaagtgacttttaactgttttattttctccaggaatatgctagtcaaaatcctagaactgagaaattctaagtcacctggtaccaacaaggatctggggtctttcgtcatttgtcttttaccatccttcacacattagctattgcctataatctggacctctaatagctgaacatgttttgctgtaacttaagagcttatatctttataaaattcatatagtaagaattattatgatagtcatatatatgtctattatttattataagaaaatgtataaaaatacattacagtctttttttaaaaaaaaggatataggataatctaaaaataattcaggctctccccagtactttcctacaaatcttctcacagtggagccccagagaacatatttaattctctcaggtattaattgaagcaaactatatgctgaaagcttactagggattcagtatctaggggtttccttgggagatgattatgtaggaaacctctgcctagcacataatcaaattcactctcccgaagggaattaggtattccacatactctacattggttgtacaaacaatcgaggtatagtaatgtaccctcaaggtacacaccagaaactcaaattctctgatgcaaaccaaaggccaacctttctagtgaacttttctatgtataccaactccaggcttgctatgtcatctcttttcttcacagatagtaaagttttcttgcaagcgaaactttctttgaagacaaagtgtcactgccaatactagaacagttgcccatttcccctcttaaacggatagttgaaagaatctagtgttttgcaattttagcctctcatggaagatggatttttataatgaggtaatgaacaagggcttctgaatagagacaactagtaacctcttccaaaacacctttacatgttccttggtttaaaaattcactatttgaacttgctcttgtttcatttaataaccattaaatatttattgaatgcctcttatctagaaactctttaactgcaaaagtgggtgatgaaaaggagagattttagacagaagaaaagagtaccacaaaaaatgtttttttttttttatgtatccaaataactaaaaataaggtatagcaaacacagatagtgcaacaggtgttatttaaaaaaaaaaaaacaagccaggtatgctctataggactatgtcagactctgcaggacgttgttataaggacagggttgtaaggatttgggcctttagcttcattatcaaggagagccattgaaggtttttaaatagtcagtttcacatctaagtttgttaaaagttttttacttgaaaataatttagacacacattgaatttcaaagtagtaaatgagttccagtgttatatttacctgtggaaatcctgtatatggaggttcattttaaataaccatcttaaatgatcttacatgagtatactatagtttatcaaaaccaggaaactaataaagtatcaactgaaatacagacctgagctaatatgttactagttaaatatttttaagcattctcctgtatacagtgtagaaaatcttctccataatacactattgacaattagattcagtagatacataaaccataatgtaacaaaataaggtgagtcatttagtgggatgttcagagaaataatgtcaggaatggtttctaaatttctggtttagaaaacttgatagaagtggtgttatatatgctgagctaaggattatcttggtatgtggtcaggtagagttcaacatgtagagctgttgagtacacagtcgggtgttaaactctggagctcagataaaggactatatgatgctctatagcattgatacatcatgacatgtttatcattttctttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctgtggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttgcctaggaatttcataaattcattctttttaatagctgagtagtactccattgtgtagatgtaccacattttctgtatccattcctctgttgaggggcatctaggttctttccagcttctggctattataaataaggctgctatgaacatagtggagcacgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttattacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttcttttagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcctgtgtggacccttgcgggtgttgggcaagactctgctggcaaggtagcccggggctcgagtcacgagtcttgcggaagggacttgtgccccagatcaggcccgggtagcctgcttccctatgtactgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcaggcctgggtagcctgcttccctatgtaccgcagtctcaagttccgcgcgattggattggggcaggcactgtgatccactcaccagaggtcttagggtcccgtggggagtcctgtgtggacccttgcgggtgttgggcaagactctgctggcaaggtagcccggggctcgagtcacgagtcttgcggaagggacttgtgccccagatcaggcccgggtagcctgcttccctatgtactgcagtctcaagttccgtgcgattggattggggcaggcactgtgatccactcaccagaggtcttagggtcccgtggggagtcccgtgtggacccttgcgggtgttgggcaagactctgttggcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacccttgcgggtgttgggcaagactctgctggcaaggtagcccggggctcgagtctcgattatcattttctattagataccaaaaagaaattttcacttatagtgtgtaatatctgtatttgttgatacatatttctataaatattcattttctcatgataaattctcagaagtgaaatgtctgaataaaagaacatgcatgttttattttaatactaatattggagttaactcctttctctttgatactaatgtaattcctcattaacaatttaagccagactatttgaggtcaaattaaaaatatttgatgaactataataatttttgagcaccaagagataccacaacatgtggtttgctgcctaaatgtacatacactagaatattggtcttcaatatgacaatactaagatttagtgaacgttttttgacaaggtgaggcttagtaggatgttattatgtcattggaagtacttggaaattattaacctggtcttttagtatctcagtctttatctgacttcctgtcttgctgtgagatctttcccactatgatgccatcatccatgatttgacccagtcagcaaggaattgattggatgccaattccatccatggaattttcaaatcttgggttttcagcttcttaaaatatgagctatataaacatccttgctttataaagaacctggccaaaaagcttttggtatcaatgggcagtaaattaagataccagtaaaatggttttgagtttatttgtggaataagtcggttcctaggtatcaaaccaacttaaatagtttacgataagctagaatcttgtgagtaatataattgagaaaatatgcatccgaaaagtaatgtctttattccagtcagctattggtacagtaattgtagtactatcttgatccatgattttccacgtttaaaaattttaaatattactctaatttatatttagctttttaattctttatttacattccaaacattgctccccttcctggtatcccctccaagagttctttaccccataacccctccactttgcctctgagagggtgcttccccaccccttaccctcccaccctcacctcaccccttcatatcccccttccctgggacctcaagtctctacaggattaggtgcatcctctcccactgaggccagacaaggcagtcctctgttagataagtgctggtggccatagaccagccactgtatgctctttgattgatagcttagtccctggaagctcccagtggtccaggatacttgacactgttggtctttctatggggttgccttcccattcagcttcttcaatgcttgcttcccttaactcttccataaaggtcctgatctcaatctaatgcttgtctgtaagtatctgcaactttctcagtcagctgctggtagagcctctcagaaaacagccatgctaggtccttgtctgcaagtacaacatggcattagtaatagtgtcagggtttgtttcccacccatgggattgatccaagttgggccagtcactgggtggcctttcctttccctgtatttcttttagacagaaacaattctaggtcaaatattttgaaggtaggttgatatccccaaccctccactggggtccctatctatctacttgaggtggtttattaaggttccatctccccactgctggacatttcaaggttacgcccattgagtcctgggagcctctcacatcccagatctctgagactttctagatgtctccctcccccaacatgcccctcagctgcatatttccattcattttcctgaccctttgggcttctctcctgattctgtccatgcctgattctgatccccttttccctccccctcccctctcccaccatgattatttattttccccccttctaagtgggattgaagcattctcactttggccttttttcttgttaagcttcttatggtcagtgggttgtatcatgggtattctatacttttgggctaatatccgcttatcagtgtatacatatcatacatgtccttttaggtctaggttaccttactcagaatgatattttctagttccatccatttgcctgcaaaatttatgaagtcctcctttttaataatggaatagtattccattgcataaatgaatcaattttttttctatccattcttcagttaagcgacatctgagttgttttccagcttctggctgttatgaataaggctgctatgaacatagtggagcacatgtccttgtggtatggtggaacatcttttgagtatatgcccaggagcagtatagctgggttttcagatagaattatttccaattttctgaggaattgccagattgatttccagagtgattttacccaccagcaatggaggtgtgttcttctttctccacatcctcaccagcatgtgctgtcacttgagtttttgatcttagccattctgactggtataaggtaaagtctcaaggtaagtttgatttgcatttccctaatgactaaggatggtgaacgtttctttaaagcttcttggccattcgagattcctctgttgccaattctgtttagctctgtacccaagttttggggggttatttggcttttgaaagtctaacttttgggttcttggtatatttttgatattagtcctctgtcagatgtagggttagtgaagacctttccccaatctggaggttgctgtttgtcctttggatgttgtcctttgccttgcaaaagcttttcaggctgggcagtggtggcacatgtatgtaatcccagcacttgggagaggttgtggccagcgtggtctacagagtgagttccaggacagccaggactgcacagaaaaaacctatctcagaaagaaaaaaaatgcttttcagtttcatgagctcccaattgtcattgatcttagagcctgagccactggtgttctgttcaggaaatttttccctgtgccaatgcattcaagggtatttctcactttctcttctattaggttcaatatatctggtcttgtgtggaggtccttgatccacgtggaattgaactttgtacagggagataagaatggatcaatttatattcttctacatgcagacagttagaacagcactatttgttgaagatgctgtcttttttccactttttttttttggcttctttgtcaagggtcaagtgaccataggtgtatcagtttatttctgggtctttaattctattcaattgatccatctgtctgtctctgtaccaatactgtgtggattttatcatcattgctctgtagtacagcttgaggtcaggaacagtgattcctccaggagttcttttattgtcgagaatagttttcacaattctgggtcttttgtttttccatatgaagttgagaattgctctttccatgtctgtgaagaattgatttggaattttgatggggattgcattgaatttgtagattgcttttgataaaatgaccatttctactatgtaaatcctaccaatccatgagcatgggagatctctctatcttctgatgtcttctttgatttccagcttcagggacatgaagttctttttatacagatctttaacttgctggttagagttacaccacaatattttatattatgtgtggctattgtgaagggtgttgtttccctaatttctttctcagcctgtttatcatttgtataaagaaggactgcagatttcttaaagtcaattttatatccatccagtttgctcaagttgtatgttacgtataggagttctctagtagaatttcttggtgtcacttatgtatactatcatactatatttaggtatgtggcatgaatttctgatctgtccaagacttttatcatgaaggggtattggattttgtcaaatgctttctcagcatctaatgaaatgatcatatgtttttttttctttgagtttgtttatattgtggattatgttgatggattttcatatattgaacaatccccgcatccctgggatgaagcctacttgattgtagtgaatgatggttttgatatgtttatggatttggagtgcaagactttattttttttttacttttataagtgtataatcctctttaatatttataattaattcatagatttagagcaaaatgatatcttcacatagtctcctatgtttacataaatatatatatatatatagagagagagatagatatagatattttcttcatttatatttcaaatgctatccagaaagtcccctataccctccccctgccctgctccccagcccatccactcctgcttcctggccctggcattcccctctactgaggcatataatatttgcaagaccaaggacctctcctcccattgatggcctactaggccatcctctgctacatatgcaactagagacacaagctctggggggtactagttagttcatattgttggtcctcctatagggttgcagaccccttcagctccttgggtactttctctagctccttcattgggggccctgtgttccatccaatagatgactgtgggcatccacttctgtatttaccaggcactggcatagcctcacaagagacagctatgtcagggtcctgtcagcaaagtcttgctggcatatgcaatagtgtctgggtttggtggtagtatatgggatggatcccccggtggggcagtctctggatggaccttccttctgtctcagctccgaactttgtctctgtaactccttccattggtattttgctccccattctgagaaggaatgaagtagccacactttggtcttccttcttcttgagtttcatgtgttttgcaaattgtatcttgggtattctgcatttctgggctaatatccacttaacagtgagtgtatatcatgtgtgttcttttgttttgggggttttttctttttttattttcgagacagggtttctctgtgtagccctggctgtcctgaaactcactctgtagaccaggctggcctcaaactcagaaatccccctgcctctgcctcccaagttctgggattaaaggcatgcaccactactacctaacatgtttgttcttttgtgattgcgttacctcactcaggatgatgccctccagatccatccatttgcctaagaatttcataaattcattctttttaatagctgagtagtactccattgtgtaaatgtaccacattttctgtatccattcctctgttgagggacatctgggttttttctagcttctggctattataaataaggctgctatgaacatagtggagcatgtgtccttcttatcggttggaccatcttctggatatatgctcaggagaggtattgctggattttctggtagtactatgtccaattttctgaggaactgtcagactgatttccagagtggttgtacaagcttgcaatcccaccaacaatggaggagtgttcctctttctccacatcctcaccagcatctactgtcacctgaatttttgatcttagccattctgactgatgtgagatggaatcccaggtttgttttgatttgcatttccctgatgattaaagatgttgaacattttttttcaggtgcttctttgccattcggtattcctcaattgagaattctttgtttggctctttaccccatttgtaatagggctatttgattttctggagtccagcttctttaattttttgtatatattggatattagtcccctatcagatttaggattggtaaagatcctttcccaatctgttggtggccatttttgtcttattgacagtggcttttcaggctagggatttttccagggtctactgagctccaacttgaccacttgaggttctgctctttcttaaaacaaagcatatatgtgaagtcattcttacagagacttataaaatatccttgatttctatgatctctgtacattttgtaacgcaaaaaccgtaatttaagaaaactctatttggtacttgcagagtcatgcacaattccaaattacatccaaggactggtttgtttagctacatttatatccctcattagtcagagctggagtggacatctaagtatgaagaacacatttcttgtgtgtggtacattctttaaaatacataatttcagtgtgttgaatacagaaactaagcaaagcttttcaaaatttaggtaaaactttattactttggaatcagtcaaaatttatatataccaggttatctctcagaatattgaaaaatattaatttttatttactaaaacattgcatttctgttcattttaatctaaatatacattaaaggtgaaaatacaaatatgatagatgacatttgtatcacatctaattggcagatgatcattactcagaatttataaagaattcaaataattataaaaagttgttggaataactagttcttagaagagtaaatgattgacttatgaacatgaaaaaattagcattcttattaaaaataaaaaatatgaattaacacagcccggctaacactttatatgtttcaaatttacagaattgtgaagtctgatatttccagttattaactagaaattacagtagtggaactttttttcctgcctaatgggaatgtagatatgcacagctactttgaagaacaacatggcagtatcatttaaagttgaagaagtaaaaattcctacagataaataacattgtgaatagaaactctgttgaactgccaaggcagtcctaaaagggaagtttatagtgatgcacatttacataaaaaaaattaagagagatttcaaataaacagcctaatgtttcaacgctctcaaaaaaataaaaatcagcccatccaaaacccaataaatagcaagaaataataaatattagggaagaaattaatgaaaaagagaataaaagaacaatacccaataatgccagaggcctttcctttattttaacacatttctgagaacactgtgtttaaattgcattgagatctctgggtaccctgatagcttatagagttgtatcaggcctacaaacagaaagctctatgtcagtagttcagaaccttcctaatattgcaactctttaatgcaatcccccatgtgtggtgacccccaactataaagtcatttttttttgctacttcctaactttaattttgccctgacatgaatcgtaatgtaaatatctgatatgtgggatatctgatatgctacctttatggaaaggtaatttgacaccccctgcaaggaggtcacaacctataggttgaaaatcacttctactgcaagacataaagcaaggaaacctatataatcattgaagattcagtagtagctgtttttgccccttaattggttaagatgtttgtgggtggtttaaccagttgtgtacagtgatacagatactacaactttgagatgcatctgtaagaaatgatctgtaaacatcctctgtactgtaatgtatcttgtcctttttagtacctcaaaaagatgattcactgggtggtaatttttgataaaaaacgactttgggaaaatggctcatacatgtcactgagtttttattgtttttaatcatagctaacttaatttatattcaaaaaaggatgtggtctacttcttaatatttctttgacacagagcagataagatttcttattatttttttcaagatatacaactaaaaggagatcaaaatcagtgttgtagactctcagtgtgccaaaaaggctgagagtaaaatttaatcattgtcacacacttatgaaatatcattagtggatccctaccactagccctctttctctttctagagcaaagataaaagaaacaggcttaatatacattgggagtgctagtttacacataggaagaagtacaaaatggtgaggtttattcaacagtagatcagctaagcagaggagacagttggactttactcctgggtaaaggctttatgaaataggacagacaatcatctaatatgattagttagggagaatgatattcatgtaactaaatggcctcacagggtgccttctacactctactctctgtgaaaataattgaattaaaacctgtttccaagacaaaatgtactgctcaagcctataacctggcactgatgcagtcagctcctgagctgtgctcttctcactaccgaaactagagtgctggaccagaacaattattcaaggattttgtgaaactttttgctacataaggaaaattaccctttattcacggggaggcagatattgttattctagatcactatctatttttaaagttgtatataaatcatttaattttttaaaaatgtatgccctcttcttagaaaaatgaaaacaaaataaaactaagccattttctcactagtttccaggtaaaaatttctgcattgatttgcctcttgtggtacagtcaagcttagcacagtaattaacatctactattaaatcagctcaaacataaaacactttaattaagcagccatgtatgtgcccaagaaattaagaatgtgctgattggaatgaagcagctgttgttcctgcttgtgatctaacttggacaatactgagcaaacataactaaagcaggacaaagaacaaataaacaattatgtatattcatgaatttcacttgttatatactctgatatgtcccccatttactaactccctattattagcctagcattatgctctgtgctctctctatatctttccacacatatagccaggagatatacatatagaaaaatagatagatagatagatagatagatagatagatagatagatagatagaaaaatagatagatagatagatagatagatagatagatagatagatagatagatagatagagatagatagatgtgaatgtggatgtggatatggatatagatatagatatagtcttgttcatactaccttttaaaatgtaatagaagaaatagaagcactatataaataatgaaaatacctgtagtgtagattatgtgcagccgtggagaattaattcaattatgctagtctctcttcctctgcaactctctctctctctctctctctctctctctctctctctctctctctctctttccctcccatgagtgagtgtgtgtgagtgtgtgtgtgcatgtgcgtgcgtgtgtgtgtgtgtgtgtgtgtgagagagagagagagagagagagagagaaagagagagagatcctacagcatacctgtggaaataatattttctgaataaatagtcttgactttttctgtgcacagcagagagcatatgacattgggattcttaatgtagatttatattctttatatttaagtaccattatatatttattctttcatcaaatatttgtttaaaagttaaaatatgcaaggtgccaaggagctcagttggattttccacttatatactaaagggtatggttgcagaaaaaatacaccacaaatatatctaaaaatatcaatactgttaacatgctacaaaagggatgctatggtgccaagaaagtttgtaataagatgctaaaagaggttttatgattacctagcagtctgaaggaaaaagtggtaattgcctagattgagaagtagctgagagaattccaagtagaggagaaagtatgtctaatgtcttgtaatgggaagaacgcaaggaattgggacagatgaaaggagtcctgtattacagaaaaaaaaaagaaaagaaatggtagtcaaagagacttaagaaggtcaaattgaactatgctaccatttatacgtcatggaaaagtagtagttgcacaagttttaaagaaaggttttatgagaagagttgactcaatgttatattatattcttgtgtataccaagtgctttttccaactaagttatgtcggcacgtgcatatatatgcagttataattaacaagattatacacaattggaaaaattagtaatgaattacatacaagaatggaaactaggaagacaattctatgtggggacataattggaatgcctagtacacagtatcctaaaagaattcagtctattaagtagacaaaagatatgttttgaatagctaacataggagataataataaataaaggatatcatgaatgagggagagctaaaatgggtagagtgaaaatgtgaacatgttgtgaaggctaggagatgactcagtggataaaatcacaagcctggtgaccctattttagttttgaatcccagaatcagttgtaaaagccatatacaatagcacaagcatgtgtgatgccagctttcctactgtgagatgcagagacagcagcatcttctggagcatgtggtccagtcagcttcacttgtacaatggctgagacctttgtctcaaataaggaccagaggaaaggaccacagccagaggttatcctctgaactctcccttcctccctctttccctttctcccctcctcctctctttatacacacacacacacacacacacacacacacacacacacacacacacacacacacacacagagaagcacacagaacaataaagtggctatgagctagtatagtccagaaaaacaagaggataatttaacttgaatttagttctgaatgctaagtagtgtatcatattatgtctcaaaatctcaaattataaaacttggggatcacaatgaaaaaaaatgttttcttaggcgttgccttgttaatataattcttccattgagtggcctagatataaattatttctgtgtatctatctagcaaccaattctaaagccagattctttcaaagtacaagttcaacagtcatcccaaattttctttctttattaatttatttttcacactccatattttattcccccatccaccctctgactgttatatatcccatacctcctccccactccctgtctccacatgcatctacccatccccaaccccacctgacctctaaactccctggggcctccagtttccttagggttaggtgcatcatctctgaatgaacacagacctggaagtcctctgctgtatgtgtgttgggggcctcatgtcagctggtgtatgctgcctagttggtggtccagtgtttgagagatctcaggaatccagattaactgagactgctggtccttctgcaagattgtcctcctcagcttctttcagcctcccctaattcaacaacaggggtcagctgcttctgtccattggttggttgcaaatatctgcatctgactctttcagctatttgttgggtctttcagagtgcagtcatgataggttcctttttgtgagcattgaatagcctcagtaatagtgtcaggccttgggacctccccttgagctggatcccactttgggcctgtcactggaccttattttcctcaggctcctctccatttccatccctgtaattctttcagacaggaacaattatgggtcagagatgtgactgtgggatggcaaccccatccctgacttgatgccctgtcttcctgctggaagtgggctctacaaattttgtctccctactgtctggcatttcatcaaacttccctccctttgagtcctgagtctctcacctcccaggtctctggtgcatttgggggtcccccaacttcctatttcctgaggttgcttgtttccattctttctgctggccctcggggcttcagtccttttccctcacccagtaccagatcaggttcccctctcccccctcctctgcccaccagatccccacccccacttctgacagctttcttctgtctcccaagtgggactgaggcatcctcacttaggcacttcagcttgttgaactttatgagttctgtggactgtagcttgggtattctgtaattttggggctaatatctactcattagggagtacataccatgcatgtccttttgggtctgagttacctcactcaggatgatattttccagttccatccatttgcctgcaaaactcaggatgtccttgttccaaattttcaaagtccaaaatgctctaaaaatcttaattttttgagtaccagtatgatgtcaaaagttccacacctgatgctagctattttaaataccatcaaatcacactcagacactatgtacaaggtgtacatgaaataatgtatgaatttacataaatgaattttatctttgtaactgagttccaactcaagatatgacattaggtgtatgtatatatttcaaaaagttacaaagctcaaaaatccaaaatgctagtctcaagcatgttggataggagatattcagtatattgatggtattatagacattacatggtaaacttcctttagtatagttagccaacaggttcattttgtatccttgcttgaagtggtcattatcttcttttttgatcacttacaggaaataatcaaaaagctaacattaaaaggaagaaattgtgagtaggaaaagtccagagtgtgtcaatcaatgtaagcatacaaacattagaatccgaatccctaatccaaatccctggcctcctatacacctgaaatgattcacaaagtatctctgaactttaatttctttaagtttaaaataagtctcagaaaagtactttgtttataactgagtatgagaaataataaatggaatgttttgttaaatgctttgcaaattatgaaactttatggcagtgtaaattagtgtcttgatcaaatatataaagccaaattttacgtccaataatagcaactgttaaaaccttttcttatccccttttattaatttgattatttgtatattatatgcttatgtagtatataatttaatacaggaaaagaatacagattataactgaagggaaaggctcaaaatgttaaagcttcctttatcttcagaagaaattattttctaagcatcaatgtatgtcactatacatgaactcttgccaaccaagaaactcacatttcttgacattaaatttgtgattgatgcttgattatatagatatgattgattgaattgttgcccatatacttgaactcagccttgagattaactgattttacatggctcaaaggctctacccatatgatattgttggtctttctgttatgactgatttccaacattaagactctctggtatattctatcctttccatgatgaaagcaatctgaaaatataaggttattcaaagaactaaataataaccaccacaactatgaaacaaaatattgtttagttcttgattggatggagtcagaaattttgacattattcaattttgactatggggatactaatcaggaatgagatgacattaagattgtggcagtccactgctgaatgtcattcattttattactttttttcattggccacactatggccatcatgttcaagaaaaaaacagcaggaagaatggcccttccttcagtgggttttatctaattcttggctattttgttttcatctatattgggccatattaaccatttaaatcctaccacaggtcatgtttatgggtcaccacttgtaacaacttactgggaatatgaaatatttattttattttacttattatcctttagtccagaatatcaatatgtattatgagatattttagatttgcaaatactgtagtgtttgggaatataggcaaggaaataattccaattattaaaataatacagttcaatctgtcctttattttatgtctaggaactccttttgaatttagtatgatgccatggtatacctataatcaaaatcctgatattaattaaaggcatgacaatttgccaattggtacatcttagtaagtgctaaaattaattcagaacctatgtgcctacaagtccaagcaatcatctttcttttctatcacatagtcttatacaatcatacaatttgggtttccaattagagtgttattatagtgttctgctttaggtttgtgttggcaggtcttgcttttcagtgctaaggttgattctggaccttgcacatgctaggcaaggactgcaccacttagctatatcttagcacttctgcttcttattttttaaaagtatttttaattattctgcatatttcaggggggcagaatccttttcccagttcatatttatgtttgtgccaacagagaatcccaactcagtatcatcaagtttaatggtctcccaaatgtgataaattttaatttatttggtttgagaaccctaagcttaagtcaagtttggtttaacaataacactggcaactttgttgaactcagaatcactgttgcttctttttacagttgtccaaaatgagcaagggtctcctctgcacatttatttttttgttttcttttttagatagggtcttgctatgttactcgggcaggtgttaaactcactgtttggatcaatggatcctcctgcctcagcttttccttaatagctgagtctgtaagcataccaccaaacagatctactacaaattaaaaacaaaacaactagacttcaaacattcagagctgccttttatactggtcactgggtgccactggtatctatatgtaaccatgctagtcggaagatttttggagatatagacaatagctgaagcatttcaaagagtactgatgaactatgatatttagaatatgctctaaagtatgctccatagtgatttttctttgtctcattaccaactatgcaatgggctcatacattatagatgatgtgattttttttctaggcactgtataaaatgagggaaagtcctcatttgcatgtataaccaacagttataggataagagccattcccctgagcctagcatcacttgtcttccactacaatcaaggcacctgatttgatctgaaacactcacataggccaacaaactcagtgtagtactactttaaatagagccctaatttcatattcctattcctaaatgtaagtcatcaagacatatgaattagagaagttaaatttataacagaaactcaggcggacttagcaaatgcagtacagcacagcggaacttgatgcaaagtgatatgaaagtaccagcatcattctaatatgccctgtaaaacacacagtgcagagccagttagtatagagggaagaaagaaagctttctgggtaattcacattgacatggtatttaaacttcagttgtcttgtgggggttgctctacaaagagagagagagagatcagcctccaccccaaaatatgatttgaatgctgcccatggactaaaaagagtataagatgatttgttactagcataattagttgtgcttttttttctttttttgagatagaggtggctttcaagccacagatatcttgaatgaagggaagggtgaatagctttgaattttacattggttggtgattcgtcctgtgctgattggttgtgcatgctctctgaatttgcatatgagcagtatagaaaaaagagaaaagcctgaaggagcttgcaaccccattggaagaacaacagtgtcaaccaaccagacaccccagagctcccagggctaaaccaccaaccaaagagtacacatggagtgacccatggctccagccacacatgtagcagaggatggccttatatggcatcaatgggagaagaggcccttggtcctgtgaaggggaatgtgagggtgggaaggcaggagtgggtgggtgggtgggggagcacccatatacaataaataaataaataaataaataaataaataaacgaacaaaaggggaaaaaacagttcccactgctgacagttcttagcagttgtcctaatgtggcacaagggagagaaggaaattgttagaggggaataaaagagaataacaatagcttaatatgatcaaaatatattatgtgcatgtatggaagtgaatttcacaatgaagttcattattatgggaagttaaacatttgaaaataataaaaacctcttaaagggaaataatgaagattatggcttgaaagctgctaacatcaaaatggtagtcaggctctttattaaaaatttgaatctctaaaaataaattccagtgtcaccagttaaagtttgccagataaacaagagctctattaatagtcttagatttattcttaagtttatcagcattctttttgctgttatagtgaaaatgatgatttagtggtaagatccatttcctttcctctatgtgattctggttttagatgctttgatgtgatgctttactttcaaaatatgcccctttatttctaaagacttcttatctgtcttagaataaaactaaatattgtctcaaagaagacaagacctctggcccacatctatgggcttttttctacactgtattctaactgtgctgctttggggaagacatttaagctgttcatcagcttcttcatgttcctttcataagatagacattacaaagggtggtgagtgtaccaacataagtaagttttctccatgtttgtaatatgcttccaataccatagacactggtaattgccaaggcagcagtgtgcgtatgctgctgggaattatctgggtaatattttaactgaattactgggaagggaataaattaagaaaaaccatgttaaactactttgagatatataaagtaaaataagatcacggatgcattttcctaatttatcaattttttgcaattaaatatttagagtgtgtggtattcctaagttatctatttagaaattgggaagatttgggagctgtgttggttgtatttctaagattcatttttagttcctaatggttttattttccagaataaggaactgtgtgttcctcttgccacaatgactaagtgctgctggcacaaataacacaactgtgaaattttttaatattataaaattatggcttccaaagaccccaactgcccctgtagagtacaatttactaatccttcttatgtgttcttaattagtccccttttctgctgacagtggtagctattgcaaactttactgtatcctttctcatcaacatgtttccatacattttctctgactcaaaccactccctttgttccctgtcttcctacatactctgagatacagtatctgtgcctcaaactattaagtgggctatccatgctgccttatagctctctccatttctatagactatttctgactgaatgccaccaccatacaacaaactttactaatcccctttctttccagattcagacaacatatctcaaatttgtgaggccttcttcggcagctgaagtctagttaggtccttccttgttctaccaccaggcatactttctgctagcaaaaaacagcgtatacaacattctcttgtttattttcatatctgtctcttgtaataaactataaaatcctaaagaacaggtaaggtactatttaatttgtctctgagttctctgaacaaatatagtgttggcacaaataactatttattgagattggaaagagaaggaaagagaataaatataagaagtatatacttctttcagaacacaaaccactttctttcaaccttttaaagtaattttcaatggcatacccatttacattttccctcaacctttacaaaactttctttgcatttaatagatacatgctgatatttttaaaaggaacttcaacaaagacagctgtctgacagctgtacaccatctgtgcttttcagcctgagtaaaaacatctggctactcgagaataggagctctgtactaaagaagtttcccaggctggtgattattagtattctaccaatgtgctttgctttgtcccactttgacataataatttatacaacttgtccatctggattatgaagtttccttttgcttacacacctcgacaaaggtaaatgtaaaacaaacaaaaaattaaacagaaactgtagcatgttgctttatttcttccatgagtatcttttatagtaaaagttaatatcatagaaaatatctacatgtacatgtaaacttgtacatttgtgctttgggtcaataatctccatggattatgaatctccagttaaacaaagttagttaaattttaaatgtctttttctttctttccttgatttggaactacttcaggggctgtgtccaacaggacaaaggagagatcttaatttgagagcaatggaattgagatgtcatgaaaaaagaacagagaactatttggtgagaggaagggaaccagcaagagtggaacagaagggttggaggagtgacatagaggagaaggatggatgaaaacaaagtatggtggcatatgcataagagagagagagagagagagagagagagagagagagagagaggagagagagagagagaaagagagggagcataacttcatatgcttattctcaaaaattaagaaaaaagaaaatgtaaaagaaaaaacaatccctaggtggggcagtctctggatggcctttccttctctgttctgctttgtccctgtatttcctttagacaggagcagttctggattaatatttttgagatggggaggtggccccatccctcaactgggggccatgcctgacctctggatatggtctctatatgttctatctccctttttttgagtacttgagctaatctcatccccattgggtcctgggagcctcttgctttcctggcatctgggactttctggtagctatccccagttccccatcctccattgctacaaacctctgttcgatttcctgaccctctgtacttcatccctatctcctcctgtatctgaacgggccccccttttccctctccctcctatctccctcctagatccctctcaccttctgcttcctgatataattttcttcccccttctgagtaggactgtatatagtactgtagccttcacactttggtgtggtcttctttcttcttgggtttcatatggtctgtgagttgtatcgtgggtattctgtgcttctttttagctaatatcacttatcattgagtataaccatgtgtcttcttttgtgactgggttaaatcactcaggataatattttcaagttcaacccatttgcctgcgaatttaatgaaacagaggactgccttattaggcatcagtgggaggggagtgcattggtcctgtggaggctcaatgacccaaggtaggggaatgctagggctctgaggctagagtggatggacaagtggggaaacaccctcctagaggcagagggagggagaaggggatagggggtttgtcgaggggtaactgagttcgaggccagcctggtctacaaagtgagctccagaacagccaggactatacagagaaaccctatctcaaaaaaaaaaaaaaaacaaaacaaaaaaaaacaaaaaaaaacaaaaaaaaacaaaaaaaaacaaaacaaaaaacaaacaaaaaaaatgaacttataatagcagttgggactaacccatttacaacacagtttttactgctgagttcccgttgatgttttcagtaatacatactttatatatagatgtatgttgtagtctgcatttgtgtgcatgttcatgtgtttgtaggcacatgtgtatgtgtgtgcatgctaatagaggccagagggcaacctcagctgacagtcaagttctgtccactgttttgttggtttgtttgtttgtttgtttgttttaaaagatagagtctctcgatagcctagtcagggtaggtagccagtgatcctgagggatattcttgtctctgactccttagtgccccgcgggattacagaccgacaaagaaacccagcttttaatgtaggttctggggatctaatctaggccttcctacttgctaggaaaccactttactgacagccatcaccccatctccttttcaatatatttctctagcatatctttattgtacaaagtcgcttgtatcatagccacattctggaatagcagtattattgtgataaaatatatgcaacacaaaagatttcaaccatgtgaagtattaatattatttaggaatccatattgtaaatcatgaccactgcttatctttattactttttgtcttacaaaataaattatttgaacatacttgacaagtctgctattatatgattgtattattttaaaactggaaactttaagtttttatttccagaggtagtttggttttaagtagctcactaagacactgtgttgtatctgaaaatacatagcttctagatggtctacaagacctaaataatggttgaaggacttggacttagaaaacaatagtgaatagcaatatattatttagttttgaaaggatagaactagagtcaattattgagaattcctgaacaccatgtttgggttatagtaagaagatgttttctagcatctgggacatttcagagtgtagtgtaatgccttaaacactgaatgtatttaagcaatgattaccactgggggggttatatattgtatgagagattagattaagttctatcatccttcgaattatattaaaggttagacaggcattgaatggtagtcatgtttcctgttgtatcagatgtcatatttgcctatcaactaaatacttaaagcattttgtctgtccattggttaccaatatagtgtttgctatttttgtttgttgcacccagaaattactttccttagatctacaaacaatagcattacttttatcactcagagtataaatgtatcacttcagatatgccttctttcaccattttatttaaaataatccacccctatcccaccattgccgtctctaattaccttctagcatattgctctgtttatttccaccagagaagtaatcagtctgtaattttcttgtttgctttttcccgtcttcttctacaaaaagggaacctaactttggcttactcaaaagtaaattcatattttccagaccagtggcatgcatgaaataagaatttggtaagcatttgttaaatgaagaaatagagacctctccatgggttaaggtttctattatgttaaagcactctgtagaagatgcttgctcagagacattttgcatttctccataacacaaaatcaggtatttggatgtccaagggtgataatttttcagtttttcttatctttccaaaaatttccttctgttagctattttcaatgaaactaggttttatgaattataaatataagaactggggcattcatgagaaaatattgtaattgaattttgtgggtatttaagagtaaatgatgaccatcacagatggccatttgcaaacatatatatgagtgcttagttgcttggacttcatccagtgatttgttataacttaattacttaactgatagatcagaaatcgagacacctgggacatgataacatctgcttctgaaaccataatgaaagtgtgctttataacattctcatctccaagatccattgaagctacttacatgcttcccttggcttgcttttctttaatgctcactagttgtgtttcattttcttgcttcctaatattaatagtttaaacagctcatttgtcagttttatgtgggtgttaatattaaaccacctttttctttttataaattccataagagcacatatcctttaccaaaccttttcatttgcaatgaccctgtggtagtttcccattactttcttttttctatattcaacagtattgcataatgtattttggacaggctgtttgatcagatttttttttccaggcaagtatttctagtaagatttggcttccttctcattttatcactatattctttcttgtttagccctgccttttcatctttcttcttcccaagtcacttttttctattatcttaaattgttttctggtgtgatgaattaatagtgataaaatggtttatatcaataaatggcttcttggatttactgaaatttttaaatggtttcttttcttttataaagacaaaaaaaaaaaagctgttcattatccatatcagatcatgtaagctccagattccaggtcctgtggaaaccatgaaagagtagtcagcatttttaaaagttatttgtgcacaccagaatacagtcttattataaagtatttacttgttgaacacgttatacataatcgtgtatgttatcatgtcaacggaagatccaagaataaggaattctacaactcaggtttggcagggttgggtaggagaaagcaaccaattctacataaatctcaaaatattgaacttccacaaacattattttcataggtattatgtgagacagggacttcttatgggccctagactggtctcaaatttaaggcactcttttcctgaaagaaaagtaggaagagaatgtggtaagggaaggaaggagaggggagagagagagagagagagagagagagagagagagagagagagagagagagagagaaaggagaagaggaagaggaagaggaacagagaactaaaggcagaagacagcacttgagaacctgctctcccctttcaccatgagtcttgggtccttgaggtcacccagttctcagtctcgttggcccccttacctactaagcccccgcactggctcagaatatttttttagatatgttgtgaaaatgctataaagtgagtagagcaatgtttgatatgaagtgaacttttagaaatgaccaggctaggtactgcaccagagtgtttctcaaatgcatcagttaaggtcttgaatttctatatcatggcaacttttaccaaactttactctttggaaccctagcataagaaaatatttcaatagttttatttgagggaaacaagcaatttcataactagcagcttgggaattgctgcatactttatgtattttgagacagggtctctctatgtaacctgactgtcctttagctcattatctaggcccagctagcttgaattcatagagatctgtctgcctctgtctcccaagtgctgtaattaaaggcatgtgccaccacattcagctcattcatactttttttcacttagatcattatacatcatcacactaatggcagtaaaaatatgcatggtttacacttactttagccattgctttcaaagttgagaaatccttttactatggatcatacattagtatgttaccagacattagtttggggaagcacaattttgagaaacaaatagggcactccccttgtctttagctggacaaatcattctttttaacttacaattgcataatgaggggagtagagaaatggtttagtgattatggtcttatgctgcccttgcagaggacctgagtttgggccccagaactcctctcaggcaactcacaaacacctgtgactccagcttcacagtgttccaaagcctctgccctagggagacactggcaatcctatgtacatatccacacagacagacagatagacacatatccacacagacagacagaggcagacagagagactgtcagataaagacacaaacacacacacaaatttaaaaatataagaaaattaaaaatttaagaacctggataaagtctgctatacctcattggcaaattggaaaaccaaactaacatttagtgttgttgcctagtgacattctctagtctttattcctacaattacaattattccttgatattgccacacaactactgtgctactgcttatcctggcttttactttggtttgtttgtttgtttgtttggtataatcatcccatgagattatacaacattttgttgtattaaagactagtgcttgcctggcactatgtaagagactcataaaccattactaaaagttcatagaaacaataaaaaatggagttttaacagctttgtatagtcattgcacatttttaatattgattatgtttttattctcatttccacttactctctataccatgctatagaaagctttctatgtgataagtgacttaggtgaaagtcaatatctgcaattagaagtgtctgttttgcaatttatttgtcttagtgataccaggaaatgcaaatcttttcaaacaaagaggccatccaaaggcactgatgatgtagagagtcaattctttccattaccacacctttgaaaggctcaattgtaagacctagtactgagggaaatccagttgttcttctaattaaactctcaaagatacccagagacataagaaaccgatcctaatatgctcactatttttcttccttccttccttccttccttccttccttccttccttcctttctgtctgtctgtctgtctgtctgtctttcttccttccttccttccttccttccttccttccttccttcctttctttctttcaggtcaatactgtactttaaaaaaaaattaatatgtagttaaatcattttcccctcccttccctccctccagcccctccctatcaaattcatgacctcttatttttaattattatcacatatgtatatataaaagtgaataaatatataaacataacctgtcgagtccatttagaatagtttgtatgtttatttctttattgctgaccacatggtattggataaccatttaaaggattcacccctggggaaagactaaactaaatctcctctcggtagttgttcattgcctagagctcttcatccagggttgaggccccataagatttcccccattcatcttggcatgtcagttgatgctttcatcgtttaggtcctgtttaggcaaccatattattgatattttatgggtgtgacttacctgacatatatggtagacacaatcttgcagcagacttcctgatcttctggcctttacaatctctttatgctccctcttctattatcttccctaagccttaagttgtaaagcagggattctcaacctgtgagtcatgacccctacagagattttatatctgaaatcttgcatatcaaatatttacactatgattcataacagtagcaaagttacagtcatgaagtagcaacaagaataactttatggttggggtcaccacaacatgaggaactgtattaaagagtcagtattaggaaggttaagaaccattgttgtagagactatgctgtaggtgtctcaatagggcaaagattgagagtgaggtaggacaacaggagatatggtggaggagattgtagagattaccatagaaagcagaacctcttatccccacatgatttcattggaccaagggaatatgcttaaatatcaccccccataccaacttggaagaagtgggtttgatataaatgacacatagaaggtcacacacactctgcagtcaggtgagaggccagtctgacacaccaccaaattctttatatctctctattaataaattacctccttaaccatccccttgctctgtacaagataaaatccagaaacaaggaatgttagatttacgaaataaatgtcatcgagaacactggacagagtagaatggaaggaaaagaattccccttcccacactatgggctaccacaagcaaaagaaaggaggaatgtctctgaagcaaactgtctaaaaaccaaactctgaaaaagagatctgcacaaggcccagcagtagtcacttagagggtacttgcccagagctgtgcctccccttcctccaaagctgggacaaaagaggaagctgttcttgaggccttgctatcaaactgctctgtcagaaagagtagaaaatctggcactataaaatctccaacccctagtaccctttccactatttaggccagcaatgaccctgacaactaggaacaaaagaaatgagctgaacctgacatagactcatgaatgcaaacatattcaggcaaaggctgtgggtcacaggtttggaaaagttgtctggggtcctagagcgaggaaaacccagaggcaaaggtaaatacaagaatgggtgccacccctcccacacattcaccataaaagccttagatagtgacaaccatgcatagaaaacaatgtgatcactcagcacagcagagagcaggcagtaactggtaggggcacatggaggactaggaaattcctaccaagggccagggtggagggctgattcttgtgcagcagagacattctggtttaactagttttgaactgcatagaatttagcaaccttcttcctacctgcagagtcagctacaaaagacaacctatagggtaggagaaactatattcaccatacaagtaagaaatatagattggttggttggttggttggttggttggctggttggtttgtttgtttttagctttatttttcatacatttcacatttgtatgttggttttgggggttggggtttatttgtttttagctttttcttgcttgaataaaatcttataactgacctttctttttctacacctaacctatagtaatttcgctcataccttcatctctattttactattttactcctgtttccctcttccccgttcccttctccttttgcttcttaattattaatattgaatatccttaaaaatacactacatttatcctaatggtgttttagttccattttctaatcttattggggatataattgaagtacacaaataatttttactgtatttaagtacagccttgctgtcaaatcactgtttcagttacagctgcctgttccacacactaaatggcagtaggactcattacctcaactaaagactatacataaaaaaagacataaagtaaagggaataatgaatgcacagaggaactcagaatgtaactcagtggtagatttcattcctagcatgtgcaagccagtggtcaattatcaatagtgaacaaaaaagtgtaaatgtaataataaaaataacagctggagaacatatccttctcaatagatacacaaatcacaacaaagagacagaaaatatatgagaaaacagtacttctaaaagtccacaagacctcaataatagagaacaaagataatgaaatagccatcatgctagaaaaaatagtttagaatactgctttttaaaatgttccatgatcacatagcagacaaaaacaagaagatgaatgaaatatggaaatcaattcaggacctagataagaaagttagcaaagtagatgaaatatagctttttattgttttgaaatttcctacaaaggcagacacatcacagtaatatcacagccttcatcagcaaccctaaaggccaggaaagcatgcaacgatatatttcaaattttgacaataatcaacttccagctaagattgctatatacagcaaagctatcttttaaagttggcagcaagatacagtcatattaagccaagcacatgaaacaatgttgaactgaaatttaaaaaaaaaaaaacttggagaaaaaaaattgagcaaggtgattgaaattttgggaaaaaaaaaaaaaccaaatgctagaaatgaaagctaatcaatcaaataaaaaggacatgataaaaccttaacccacaagattaatgagggggaaaaagaacaccaaggatggaaacaatgtcaaggtaatatttcgttcaaatatcaataaataaaaagaagtatatacagccacaacacctaagaactcagctgttggatcaagagaccaaacttaagaatctatatgacatgaagaggaactgagattaaaacaaaaacacagaaatatgtttcattgaaattatatcagaaaatttctcaatcataaagaaatgaatatccaaatacaagaggcatttaaaactacaaatagacacaactagagaagaaccttcccacaatgcaggcaaggtgacatctgtagtggtgacaaagaaaaaaaaccacatacctacaaagctataaaggcaaatctatcagaatagcaccaggcttctcagcaacccaaagccaggaaaagaacatactgatgtattttgagtcctgaaagtaaataactgccaaccaaggttgctatttccagcaaagcttatttaacattgaaggaaagatagggagatttcaagacaaatgcaaactggagtaattcatgaccaccaggatagcactacagaagatgtttgatggaatcctaaacacacaggagaaatacagtcttcatcatagagtacaggaaagaataaattttataaaagaaatggataaataaaggagaacaaggaaataattcatcaagccaaacagaaccctaatcctagtagaggaaaaaaggaacaaacaaaaatttaaccaaccagaaagacaacgaacacaattggaaaaactagacacatctctttcagtaattgaatataaatggcctcaaatctccaattaaaatatgtggaccaggtgactgaatccaaaaacaagatcaagctatctgttgtctccaaatcatgtgccttgctgtcaaggatacttaaagattgtcagaggatcgaaataaatttatcaaacaaattgaagcggaaaaatatctgtttttgatattcaaagaaataaacctcaaacaaaaattaaacagaagaaaagaaacacctcatctcttaaagatacagcaattataattgcacattaggactactagttttatttaaaaggtgaaaataaaatgtaacacaaatcttgattaaaatgatagtaatttcaatatccacttcttatctgtagataggtcatccaaactaaactcagaattaaactacaacatatcaagtgagcataacaagtatctcctggtttgtgtattcagcagaatcagaatgcatattagtattagttacttttctgttgctgtgatttaaaaaaaaaaacaagttggtaaggaaggggtttatttggtcacaaatccatgtcacagttcatcattaaagcatgacagcaaaaattcaaggcaggaaccacaaagaagtgtagagttagggtatatgctttgagttagagtttaatatggtagtttatcccatagctaggattgacaggtctagtgacccataaggaaagtttttacttattatccctgggatcttatgctctagactagaagttttggttccagagtaacaaccacttctgccaagagatactggcagactaatcacatggaagctagaactatctcccagctatttgggctcttgatacccataagtcaatgggataaaaagggaatagtattgttaggacaggtgattcgagactttcagtaattagtttgtttttttcacagtgaagataaggaagattatgtctagagaacagtagattctttagggtttctcttggtgttaccatgtcttgtgataaaaataaaaaataaataaactggaaactataaaaatccaatccagacaggatgacaaaggggctagaccattcagtgatgaaggtataggtcatccttccagggaaagaaccatgacctccctacataggagcttgctgaaagtagaggaaatatagaatggatagtagagcaaggcagataaataccagataaagccacatgatcggttgcagaaacaaggattataattgacatgagtatttttctaagaacatgtttgtgcagatatacacatatattaaggtgacatttgcatttccctctttttctttatcatgtaatgtaacataaattgagataatatcagtagttaagtgttgtaagtctatagtatcatatttaggttatgagacactgaaagacaagtattcctcaatggactttgcaacctagtctaaaaatatatagtgtgttggcactttcacatgcgatagttataacatcataattggaattatgaccttatttttttccatttaaaaatgaagcatgacataaaaaatgtgattggaggctgttagtggtggctcatgcctttaatcccagcactcaggacagaggcaggtagatctctctctttctctctcttttttaattagatctttatttacatttcaaatgttatcccctttcctggtttcccctctgaaaacccccctatcccctccccctccccctgctcaccaacccactcctgcctccggaccctggcatcccctacactggggcctagaaccttcacaggcctcctctcccattgatgacctacaaggccatcctctgctacacatgcagctagagccatgagtccctccatgtgttttctttggttggtggtttagtccctgggagctctgggggtactgggttagttcatgttgttcctcctaaggggctgcaaaccccttcagctccttgggtggcaggtagatctctgagttctgttacacacacacacatacacacacacacacacacacacacacacacacacacacacaaatgtgattgggcgtcatgttgataaaggatggacttgtggtggatattcttagttgtcaacttgactggttctagaatctactgaaatataagaagctggcactccttttaaggaactttcttgatcagatttttttttttttttgaagaagggagatccatcctaaagtgggtgacaccttctggtggcaaccaagataaaaggacataaaagaaaactttggcttttttcttgcttgccttcacactcactggcaagttctcctatcttgttttagtggcattcattcactaatatcagaacctgcttattcaaactttcattgtttcctgaagaccaacaaccctcctaaactgcattctgaaagccaatctaaacagcaatttttaactacttacaaaatcttcctttaaaagaactcattctaggccagaaaccaagctctaatgaatacaaaagaaacaaataatttcttatatcttatcaaagcatagtaaaacaaaaccagagatcaatagcatggaagaaatgaggacactatataaacaagtggagaataaaaagtatacatttgagtgactagtgtgtcattgaaggaaataatttttttaattcctaaaatcaactaaaactgaaagaacaatttatcagaccctttgggatatagcaaacgcagtcataggaaagctcataggtgtagatattcacattaaaagaattaaagtcatctcaattaaagaacttaatcatgaacctcaaactcttaaaaaagaaagaagccaaactaaaacctagtagatggaaaagaataatgaagatgagggtgggtattaatgaaatgaagactaaaaaatcagtacaggggattaataaaagaagaaataatgtccttgaaaagtaaacaagactgacaaagccccagctaaactaaccaaagaacaaaaaaatcccaggttaataaaattatagataaacatgataacattacaacaaattctcgtgagatccagagggtcattgaaaactactgtcctgaaaaactgaaaaatcaagaaatggataatttcctagatacaaacctaacaaaatgaacttaagagtatataagacattcaagcagatctttactaaacattggaaatgaagcagtaatattctctcaacaaataaaaattcagagacacacaggtttactgcttttttacatatcatcatcgttgttgttgttgttgttgttgttgttgttattattattattatatttgcatcccaaatgtttcccccttcttgtcccctccttcagatcattctccctaaccccgagcccctttgccttctagagggttgggacaagaaggggtaaacctttgggtatcctcccaccctctggcatcaaggctctacaggattaggtacatcctctcccactgatcgcagtgccagggacttgggagcagcccttttggttggtggctccactctgggagctataaggggtccaggttagctgacactgttgctcttcctatggggttgtcatccctttcagcttcttcaatctttcccctaactcttccataggggtcccaacctcagtccaacgttaagctgttaagtatctgcatctgtctcagtcagctgctggtaaagcctctcagaggacagccacgtctgcaagctcatctatcttggcatcagtaatagtgtcagggtttggtctctgcacatggaatggatcccaagttgggccagtcacagagtggccttttcttcaatctctgttctactttatccctgcattttcattagacaggaacaattttgggttgaaatttttgaaggtgggttggtgtacccatccctccactgggggccctgaattctgctttaaaaaaaaaaaacatttatttttttattgttactgtttttggtggtggtggtggtggtgatggtgtgtgtgtgtgtgtgtgtgtgtgtgtgtgtgtgtgtgtgtgtgtgtgtgttaggggtaggggaggcaatgtctataaacatgcgtataggtgtgtagacaggtgccaggcacagagtgcctgtagaggtcaaaggacaacatccatgagttaattgttttccctcattgtggggattccagagatggaattcaaggactgtcatcgggcttttgattaaaaacattaaataaacagaagtatatggtttctctttttaaaaaaaaaaacaatggtggaattttcttaatccattgcagcagttctttagcacttccaatttgttaattggacccttgtagatacttaaatattagcagattgtctttaaaatgtatttcatttatcttaaataaaagttgttggaaagtttttggtgccaatgaagatctaattgcactaggtttggagttaagaggtcagactcattgtctttttttctatttgctggctgtgtcactcatctgagaatgataagagttgcacttcttcccttgtataagacaggtgctttgtaaattatgaagttccatacatgcggtgggatcagaagaaagtcattaaatttatagaatttaaataccacccctttgagaaaaaagaaaagcaagagttagagacataatgaaaaataaatacagattgtcctaaatattatcctaatttttggttcatatgcactaagaacagatccatggtctaattttgactcaattaagggggagagtttcaagggttgaggaaatgttgaatagtctcatatctgttgaaaatagactgttcaaaatatgtattgattgctatcactattttctgagttctgaaaggtacaaatggacttttaattagcccatgttacagcactgatgggatatgagctttcccactgctgctgttgtattatcatgatcaagctgtttgtgtacttgttgcaatttcatgttcacaagcatgttgggaattttgtgcattagcagagccactcagcactcctgggcattgtaaccctgttcctcaaacttcatctttgaacagtattgaaatataataaattaatccataagattcccataagcctaaaggttctagaagaggtcctagaagaatgtccattacacgtccccatcctttaactatttgaggttggatttctgaccagcactgtcttagagtttctattgctgtgtaacactatcaccaaaagcaacttggtggggggggtattttattacacttccatgtcattgttcattatggaaggaagtcagttgggacaggaactcaaacaggccagcaacttggaggcaggaactgatgcaaaagccatggaggggtgaggcttaatggcttgcttcacaagacttgttcagcctgctttccttataacatccagaacactagcccagagatgacccaacccacaatggactgagccctcctccatcaatcactaattaagaaaatgcctgacagctggatcttatggaagcattttcttaattaagattctctgctttcagatacctctagtttgtgtgtcaagttgacataagactagccagcaccaccacttattttttctatataagaatatttgtttagctagaacatccccatatgtgcttgtgtctccaaagtttagcaagcacattttattcgatcctatataaaactggcaggaaatgataataaaacctactgtaataataaccagtgatttttgcccaccaccacctgacattattgacatgtgctacagtccagctccatccattctttcccagaagtggcctcagaagaagtacatttgtcctcttcaggcttagatgtgtttcttctgaaatatgtaattgaagtcttgatgatttgagaaggaaatgagggatgtgaaaataaataattaccaccagttggtaacctcataaaacttagcttttcatggaacccataaaatagcatgcaaagtgtattcaacaatagatactctcttaaaaatctccagacatcttcaaacacattcatgtattggggtaactttagttcaaacatagtttaacatgaataaaatttcagtaggcatctttaattggaaacagaaacgttgcttctgtggcagtttgtggagaaccattcacaactagttttgttacagttcattttagtgatttttctgtatatggcagcagagatcaaatcaaggctttgtacattctaggtaagcactcaatcacctatgctatagcttttaaaaatacttcctttatttttgaagattatagtcatatcatttcccccttacctttcttccttctaagccctcttatatactccttcttgttctctttcaaatccataacctttttaaaattaatttttgatattgttgttattgttgttgttgttcttatatgtgtgtgaaaaactgaagtagcccgttcagatgatgataacagtggaaattgtgcctgttttattggttgactgatgagttgaagttttcattaaaggcacaaagcttatgaatgggttttatgaaaaagagagtaccgtgataaggattattcatgtttactaagatatctaacccaaggctggggagatggctcactagttaagagttcttattgtgcaagcaagaaaaccttagttcaaatccccgaacctacagaaaaagccaagcataatcaagtgcatgcctataactatagccctgaagagggcggagacaaggagattcttgaggcttgctggccttcagtctaactataccttgaatgagaggtactgcctcaagggagtaaggtggagcatgacagagcaggtgccctcctttgacctctttgtgggaatgtgcacacataacacacatgcacatacaacacacaagcacacgaagaattccaagccagaaatagagaaaaatgcacattaacatcaatgaacaaagttttaaatattgccagcctgttcgtagattatgctatacatatatgtttagacaagtgttatttataaaatactgggagaactaaaaaaaatcaacatctgatttttgattaacatggaataaaataaggtttgctaaggggcgtttcatgccttaataaagtttaatttatatatagattaatttaactacagcactaatcacttctaccccctccaaaaaaactgtttcatcctacctgcttatactcatattaccttgacttcccttcccatggctaacctcttctccattgttttcttttcaaaatatagaaatatgtacaactgtataaacacagcttgtaatgtttaagtctgcactagttactttttggttgttgtgacaaaacaccatgaccaagacaatttataaaagaaagctcttaattaggattacagtttcatagtgtgagagtccatgatggtttgtgtgttggcatgattgtaggaatagctgagagcttatatctcaaactctaagcaggagacaacaaccgggaatggcgcaacacttttgaaatcccaaagctcaaccccaatgacacccgtacacacaaagcttcacctctttatcctttacaaatagtttaggcaacaggggaccaagtatttaaacatatgacccatgggagccattctccttcaaatcaccacagagatgactgtcatgaagcataatacctttgagatttctctaaacttttgcaactaacacactggaggatatctagggatttttttccagctttgggtaattatgaatagaattataaaacattcaagtgtatttatgtattttcacttctctgggataaatgcctaggagtagaatttctggcttataaggtaagtgtatgtttaatttcaaaagaaactgccaaactattttccagaggagtcatttttcattaacactggtagtacaggagaatggcaattgtttcatacttttccaaatatttgatattctcaatatttttcctttaattttagccattgtagtgggtagttaatgatttgattttaatttaattttgcatttaatggctaatgatattgaccagttcttcttatattaaattacttacttttactttgtaagctaagaggaaaatttaaattttgatataaataggaatttagaaaaattttggttggacagcttcatgtatttatgtaataaattttagtcattttaaaaatctttcacccctctcctgctggaacccttgacaacaagtcccatactacttccatgtcttttgtttgtgagtcactgtgcttaattagtttttgttgttgttgttgttgttgttgttgtttgtttgttttctcagaacatgcctgggaagttatttattggagtaacttattatcagtggttataatactgagaaaaaatggcacccctctcccaacaactattaattgccaatagtacctcagggaaagtagggcatcaccaatccctccatgaatgggcatttttaacatcaaaaaagtaaatagaatcataatggtgatttctaaaattagagagaaagagaagagatggaggatgggtagaagattctaaaataaagtttgacatgaagaatggagtctagtattctaaagtacattaaggtaaatatagatttcaatatcttatgtattatatgcataaagccttaaagataggatttttgtagagtcagaatataaagaaacattaaatattaaagaaatggaaatgctgactaccctttgatcattacatattatacatgtatccaagtatcacactgtatttcataaatatatacaattttgtgtcaatggcatttttttttaaaaaatgtaataaataaatgtgccttcatcaaaggttcagggcatcatgttgactattctcattttaccccaggctaattgaaatttgattgtgaatcaacactgatctactgacaagactttagaaacccaactgttcagtaccaggttttgttttgttttttttttgttttgttttgttttgttttgttttcttttttacattaaccttattgctatcagaaaatttagtgaatcccaccagagttaccacatgttgccaggaaatttagggtccttccccaccgccaacttcttaatttcatgaaggaaataatttaaaatggactgaaatgaaaatgaaaatgaaaaagacaatattattattattagagtttaaatgaaaatccccccaagtggatcttggcagttgcccaaggagggaaatggagaataagaagagtgaaatccatgctgtttttaagcagccacattgcagacaaacaggtacaaggcagaaaggaggacttcaaagaaagaggaaaaaccccaaagaaccaaagaaagcagacttgggctgtgaaagagaccaaagagagaaaaaaggaaatgttatatctttctgaaaagtgaacaggcttaacacactctcatggtgactctatagcagctacacccagaacagtgtttctaggaaggacatgtctatttttcctgtccgtttagcatggcttcaaagtgaacgtggcttcctgatgggtcatgcctttgccaggaactgactggtaactggattaactcttaagagagaaaacagtagactgcttctacccagagatagacgccattctttttatacagaaagaccctcataggtcttcagtactactgtaacaatgggtcaacacagttaattcagttttactttattggctctgtgcaatttaccagagtcatatgcaaactttctaccatgatggctgaagtactttataatttttctttctattctttctatataaaaatttccttcccttttgagatacttgggagggggaggcaaaaggatcagaagttcaaggtcatactctttctacatatgtggcttgtggatagcttgggatataggagactctgtctcaaaacaaagaaaataaaccaacaagaaataaataaatggatactaagtctgaggaaggaattcagatccttctggccttcttacctgcaacatatccccacatagtaccccctattattctctcagccacatacctcaggactgtacacaagacctaaaaatcagtagacaagtgtcctcccagtgtactatatctgcattttcccttctgaaacagattcttgctatgttgtccaggttggccttccactcataatcctatctcaacctcccacctgctggaatcccaaatccgtgccaccacttctgactctaccttacttactttactgtctctatgtaatcccagcttcatctgtcgtttggaatgttcagcaaacctgcttatatcttactttgttaaactgttagtgattcacacagtatattctaaggagcacttgcattggaatatagtggaatttctaagtgtatgggctcctgtgccttgctatattgaagtgctcaattagatttttcagaaatgggtctcataatgtacatttttattggatattttctttatttacatttccaatgttatcccccttgccctgtttcccccagggaaaccccaacaatcccctacccttaattccatgagggtgttccccccccactcacctgccccactcctgccattccaccctggcattcccctacactggagcatcaagccttcataggaccaagggcctctcctcccattgatgcccatcaaggccatcctctgctacatgcccatcaaggccatcctctgctacatatgtggctagagctatgactccctccatgtgtactcattggttggtggtttagtttctgggagctttgggggctctagttggttgatattgttgttcttcctatggggctgcaaaccccttcagctccttcagtcctttttctaactcctccattgtggaccccgtgctcagtccaaggttggctgcgaggatccacctctgtatttatttgtcaggctttggcagaacctctcaggagacagctatgtcaggatcctgtcaccaagcatttcttggcatccaacatagtgtctgggtttggtaactgtatatggggatggaaccccaggtcgggcagtctctggatggcctttgtttcagtttctgctccacattttctctccatatttcctcgtgtgagtattttgttcccccttctaagaagggctgaagcatccacactttggtcttccttgttaggtttcatgtggtctgtgaattttatcttgactattccgagcttttggtctaatatccacttattagtgagtatatatcatgtgtgatcttttgtgattgggttattttactcaggactatattttctagtttcatccatttgcctaagaatttcatgaaaatgtttttaatagctgatttaaaacattgtgtaaattgtccattgtgtaaattcctctgttgaaggacatctgaggttgaccacgctcctgtggtcattgccctactgcaactgaggcggcacaaactggactcagtaggttatagaaaaaaaaaggatgtaaagttgggaggtggacagtatatttgggaagagttaggggtaaatatgatcaaaatatattgtatgaaagtctcctacatttagtaaagtattggtatttaactactgtaaaaaaaaaaaaaagaagaaggacatctgggttgtttccagcttctggctattataaataaggctgatatgaacataatggggcatgtgtccttgttatttgttggagcatcttttaggtatattcccaggaggggtatagctgggtcctcgggtaagactacatccaattttctgaggaatcctcagactgatttttagagtggttgtaccaccttgcaatcccaccaacaatggaggagtgttttctctttctccacattctcaccagcatctgctgtcacctgagtttttaatcttagccattctgactggtgtgaggtagaatctcagggttgttttgatttgtatttccctaatgactaaggatgttgaacatttctttaggtgcttctcagccatttgatattcctcagttgagaattctttgtttagctctgtacacccgtttttaatagggttatttgattctccggagtctaacttcttgggtcctttgtatatattggatattagctctctatcagatgtagggttggtaaagatcttttcccaatctgttggttgtcgttttgtcctattgacagtgttctttgccttacagaagctttgcaattttatgaggtcccatttgtctattgttgatcttataaaataagccattggtattctgttcagaaaattttcctctgtgcccattggatttgaggctctacccctctttctcttctattcgtttcgatgtatctggttttatgtggcggttctttattcacttggacttgagctatgtacaaggagataagaatggatccattcgcattcttctacatgataaccaccagttgagccagcaccatttgttgaaaatgctgtcgttttaccactggatggttttagctcctttgtcaaagaccaattgaccataggtgtgtgggttcatttctgggtctccaattctatccattgatctacctgcctgtcactgtaccaataccatacatttttatcgctattgctctgtaatacagcttgaagtcagtgatggtgatttcccttaaaagttcttttattgttgagaatagtttccggtatcgtgggtttttgtttatttgttatttcaaatgaatttgcaaaatgctctttataactctatgaagaatttaattggaattttgatggggattgcattgactgtgtagattgcttttggcaacatggccatttttactatgttaatcctgccaatccatgagcatgggagatctttccatcttctgagatcttcaatttctttcttcagaaacttgaagatcttgtcatataggtctttcacttgcctggttagagtcacaccaaggtatatcatattatttgtgactgttgtgaagggtgtcatttccctaatttctttctcagcccaattaccctttgagtagaggaataatcctttgagttaattttatatccagccactttgctgaagttgttcatcaggtttaggagttccctggtggaatttttggggtcacttaagtatactattatatcatttgcaaacaacgatattttgacttcttcctttccaaattgtatccccttgacctccttttgttttctaattgctctggctaggacttcgagtactatattgtataggtagggagagagtgggcagccttgtcttgtccccgattttagtggaattgcttcaagtgtctctccatttagtctaatgttggctacttgtttgctgtatattgcttttactatgtttagatatgggacttgaattcctgatctttccaagagttttaccatgtaggagtgttgaattttgtcgcatgcttcctcaacatccaatgagatgatcatatggtttttacaagtgacacatatatgatcattagacacaactgaatataaaattccatgaatctagatgtacatcatgtatgactctcagtcacaacaatttctcctttctatgaacaatcaaagtctcttttttatttacacatgtcagtaatcttgtttggtcatttcatctgttgtattgttttacaatttaaatgttaggtgtgacttaatttataagccactgaaatacagggattctcttcatatcttgtttattatgttgcttaatatagtgtacataatgtgtatatatattaaaaatttcatatatacacataaaatagtgtgtgtgtgtgtatatataaactttgtacacatttcagtagtggagttatgagatttaaggagaacaattgtttttaatcatttttcaaaggcatagttactctgtgaacaatggtgatgtaaagctttgagaattttgcctttgattcaagatagtttgtactccaagtgctaaattgatttacgcctttgaatattgcattgacacttcaaaatatcttaaatatttgtgatatgaaggggtgatggtgtaccatattcgttccacttgttctttgctatttcaatcataccatcaacattaccatccaccctcccttgctggcccatgcttttcccattatacaagtcccacagcagtttccatctcctctgacttattgttaccacttaggcccacaatccacatgattccccttaccagtgaatctctaatatttcctgttggtggttctgttttgacacctaacatactggttggtaacttgctgacttttcctcctactcattcattgtgaaactctccacaaattaatagcatgatgtgcaagctaacacaggttcctggctgctaaaggttagaaactacttttttaatgctaaagaaattaactaaacttgagataattgttgatgggtagatagcaaaagatgccgcaattcaagttttcaaagaggaaaccaccatggaaatattaaacataggcaatctactggggcattgctacatctacatgcacttacaataagattcttaatttgtactttataatgaataatgatatgagggtgtgattgaagtaatatctttttgttttttggtttttttttctgaatggtaatctatactaggcatagtcaaactgttcatttctggcatcttggtatttaggaatagtttttgtatccaaatccatcatgtgatgagtctcattggttactaatacaatcctgaaaaacagatggcttttgctttggcctgctggtcacaaatttggaggtgtggcttcatattctgaaggacaagatgatcataaatagtatcactgtggcttgttagtagaggtgatttgactcagattatatataaaattataatattatatattatgtatatgctatttttcaaggtacaatggaataggaatggtgtgagcctctgtcacttcaaattttctttaggttagaggatactttatccaacccacaaatctaggaatcacatttagtagttcctttctctggttcatttactctaattacatctaataaagtcctgtgctgtctaactccataccatctcttaattctgtgctctgttcccatatacccttactgctactttcttacttcatggttttctatttcaccaagattggctacttttcagctcttggattgatagaataaaatttgggcaaaagaatacaatggctttctgcttaagcatagtagatggacttcctgcttctgccatttactagaagtttaaaatagaaataaatggataaaaattcctaagaataaagagatgagaagaaactgattcacaaagaaaatataaggaagatggaagagagcaagtattaactacctgttatagaaaacaatacttcaaaacttagtgatttaaaatggcacaatatttagagctctttcctctgaatattgaatttcatatgaatcatttattttcctactatataggaaatggaaaatagatagtatttgacagtcaggaatctgatagttgtttagtctggcacttcagactgaagattgtgcacaggaatatagtgagaatagctatagtcatagataaagctggagaatctacttctaggttccatcataagcttctttgcaggaagcctcagttcctcaccacatgtgtctaatagacagtcagcttgggtcatcttacaacatgacacctggcttctaacagagtaagtgatggaaaagacaaacaaggatgaagccagagtactcttcaaacctcacctttaaacttaacagcatcatgtccgctttattctgtttattagaagaaagtgattaaatccaactcacacatgagaaacatcaagtttcacatactgaatgaaggaatataaacactcgtgggcatacattcaaaccaccacatagtggcaactaagttagcagaatataataactataatatagatgagttcacaatgggtacttattaaaaggagccaatttttccctgagagatttttttcaagcattagcttctacaatttagagtgatgttcaaggctgaaaataaagcattgcttgaaatccacgtatgagagagctgatctctcatgtctcttcacctccacacaaaccacatcaccactagcaccattaggaaggagaatggagctttagtctctaaaacaattaggtaaaaatctccatgttaagagatgacaaactggatgctagtcttctcttaaaatgctgtgcattaaattatattccttaaacctcttttccatttcctatgtagtaggaaaagaaatgaatcgtaagaaattcaatattcagagaaaagagctctaaatactggtatatatacccccaatcaaataaatgtcagtttattcctaatactcccacagaatgataatccatcggcagttccaaccgtgcacacaaggcatataaccaaggattagcagatagttaaggaatccttaaatcctaaaaataggctaaatatcactgaaacagaacaaaacagttgttggatggtacaggaaattgcaaaagctattacacatgtgtatatatctctacaacacacatatgtatatgtataaataagataattgtgtaatatatttaatattggattaatatgtatttggggatgataaaaatggaattagctggctgtgatggcacatgcttataatcaaggcacttgggcattggaggcaggaggattgggagttcaaggacagcatgggctacatagtgaaaccctgttttacaaagtcaaaaactaagggaccaagctctaaaatttggataatcctaatatatcattgcaacaactgacagctgcatttatgttgtacaacactatcattctacttgattgtcttaaacaactaatggattgacctgacatttctgctctgttctgttgtgttctggaactagcttattaaaactaaatttaaataatatattttgattatattgttttccatcccccaacttttttccatctacatattcacccaatttcgtgttctttctctctggacaatgtgcagagcttggaagactttggaacattcagttctaagtgagctctttatcacacccttcccctcaaggctcaggaatctatgtgaaaaaggaggcagaaagattataagagtcagaggtagtggatgtatccaaggaaacagcatcatttagacacagagggactgagcccatatgaactcatggagactgtgggagcatgcataagacctgcacagattcaaaccagacaaaaatctcagcacagaaaaagaaggggaagtcaacacaaagttgcaaccctggccaagaagctttttctgttctttatttacagtatttaaagaaaaatcttcgtgtgtttctacgcactaatgtaagaaatggtttctaggaaggagctaatttaattgatctttatttcactgttatctttaatgcctactttattgggataatttatatacagacatttagctttttaattgtacagttttgatatttgaacaactcatagagccatgtaatcagccttgcaatagttgtataaaattaccccatcacccataagttttgtcaagacccttttatagacagcttttacacctatcatcagttctttataaacacttatccttttacctctaggttcaccttttccagaccatcttaaaagcacacacatagtgtatactgttttatgcatctggctttttcatgtagcataattcatttgaggtccatccatgtaattgtgtactttaactattcatcatttttgttattgtatgagattccactttatgcatacaatgcattgattatcagttcaaggatatttagactgtttccaattttttggggagtgtgtgtgtgtgtgtgtgtgtgtgtgtgtgtgtgtgtgtaggtaggtagatatttgtgcatctttctgtatgaaagctaaagaacaatgttgggtgttttcctcagtcaagtaaactagactgtctggccccaggaagcctcctgtctgcacatacctagcactgggattacaagtgtacatcgccatattaggacaaacgctttactgcctgagccatcttcctagccccaagctgtttccaactgtcaatgattataagtacagcttttataagcaaccatgtatgagattttgtaagcataatttgtcatttctcttgtaaatacataggagtagcattactagattgtatgaaaaatgtgtgcttaattttagaaggaaatatcagctattttccaaaatgaaaataccacttatgtatctatgaagaaatgcataagagatactattgctctttattgtttccagcactaaattcttagctttttgttgagcattattattagtacaataccattcaaaaattcctacttcatgaatcataacctcaaacattttaaaatctacttgtatttctattgcccatttttaatatttaggtttgtttatactgagttttgagagtccattgtttgttttcttttcttctgcttttctagatagaaacaaaccctttaaaagacatatgatgtgtaaatattttgtttaagaaaactcttgttttcttagaagtgactttagaacaatgggattatataatagttttgttggtacggtgtctcactctgtagcccaggctgaccttaaactcctagcaatagtcctacttctgcccattaactgtgaattatatgaaccaccacctggtttgtcatagtaagaattttgttgaaatcagttttatcaagttgaatctcttagagattgcattttggatattgtatcagttttggtgtgtggtgtgatgtgtgtgtgtgtgtgtgtgtgtgtgtggtgtgtgtgtgtgtgtgtgtgtgtgtgtgtgtgtgtgtgtgcgtgcgtgcacgggcaggcattcagaggccagaaccaagtctcatgtattgttccccaggaaatgtgcacttagtttttgttttgtttttaaatcggatcttctagaacctagagcttaccaaatagtctaggctggctggctagtgagccccagaggtgagtgtgtctctaatccccagtggtaagatgataagtgcaaaataccacacccagctttttctgtgggggctggggatcatacgcaagtgctaatgtttgcacagcaaatactttacctactgagttctctctcagccactatgtgccaaatgaggactacacagattttctttttagttatctatttatatctttatttgatacttctttattttaatgtaaatataattgcttcattttctctcttccctgtcctctctccaatgtcttctattcccactttcccccaactccctgtcaaaaatttaattctgcttatttttttgttattaacacacacacacacacacacacacacacacactggtggaatgagatttcaccaatgagagagagagagacacagagagagagagagagagagagagagagagagagagagagagagaatataaatatgtatattgtgcctggttatgagaatgggaccagctaagctacaacaaatggaatataaaccaaattctttgtcctattgagttaatataggaaacacatatgtattgtcattaatctttttagacaaaagaatgtttttgctagtcccttgacctaatcaccctgtactttggaaagcttggctctcttacacgtaggataagtgaaggaccatattgagataagaaatatctcatccttgtcctgggtaggtgatataaaaaggggggagggtatctccaacaacaactgggtatagcctgtaaattcctggtgaggaaaccagtgttgaaaaagccacccccatgctggcagtagtgtgctaaaggagatgggacatgaacttgctctctgtgcatcagaaaatcctcaaggtgtggtataaggcaggagtgactttctgcctcaatgactgaattctatcatttgtggtgacttgcctgataagaaactaaaccaatggatatcctatccatgaagacctagagtggcaggcttagaaatcagtatatatggctataaataaaccagagggaaagatgggtttatactagaaaattgcagagaaaattagacagaaatgaatagaagttttgaaaatttattttgcattgagccagactcctttcaaagaggaaggtttctggtagcgtctagagccatggttctcaaccttcctaatgctgtgacccttaaatacagttcatgttgtggtgactcctaaccataaaattattttcattgcacttcataactgtaatttggcgactgttatgaatattaatgtaaacagggtttttttttttttttggagatactggtttgccaaaggggtcatgacccaccagttgagaagcactgatctaagagtctgttctcttcagcattacctctgccccctactgtggcatgtttagtatacttggatgaaggatcttcactcttcattcactgcttgaagcaccaatactatatgcagggaccctcttggtgctcactatttcagtttagcagcctttacaaacagtgatttttgactgctctatcaggctcctgtcagcaaaatcttgctgctgcttcttcttcttcttcttcttcttcttcttcttcttcttcttcttcttcttcttcttcttcttcttcttcttcttctcttctctctctctctctctctctctctccctctctctctctctctctttcaagacagtatttctctgtgtagacctggctgtcctggaactcactttgcagaccaggctggcctcaaactcataaacccacctggctctggctctggctctgcctcccaagtgctgggattaaaggagtgtgcctccacaccaggccttgctctttcaattagatattttctttatttacatttcaaaagttatctcctttcctagtttcctctctgaaactcccctatcccctccctgctccccctgctctccaacccactcactcctccttcctggccctggcattcccctacactggggcatagaatcttcgcgagaccaaggaactctcctcccattgatggctgattaggccatcctctgctacatatgcagctagagacatgagtctgaccatgtgttttctttgattggtggtttagtcccagggagctctgggggtactggttagatcatattgttgatcctcctatagggctgcaacccccttcagctccttgggtactttctctagctccttcattagggaccctatgttccatccaatggatgactgtgagcatcaacttctgtatttgccatgtactgtcagagcctctcaggagacagctatatcaggatcctgtcagcaagcacttgttggcatctgcaacaatttctgggattggtgattatatatgggatggatccccaagtggggtagtctctggatagtcattccttcagtctctgctccgaactttgtctctgtaactccttccatgggtattttgttcccccttctaagaaggaacaaagtatccacactttggtcttccttcttcttgagtttcacaaacagtgattttttttttttgattccagaagtaccaggagaaaatggattgtttacattggagaaaacagttaaatattccccatttgtcattacattccttttcagtggagggcaatgactgatattaatctggtggtttagaacagacaaatgcctctgttaaggggtaagtctgtctttaagacttaaatttagggatgctttttgttaatctgtttgtactgacaagtctcctggtgtacctagtttacaacagaaatagtgatgtgaggatagataggttactggtttcacctgtttatgaggtcttggcgaagagatgccatttcactggcttcaatcctgctcaatttatgtaaagatcataatcttgctttccttgaagaaatctctctgtatacaaaacataacaacagccaagtacaatgtcatgttagttctccaaagagcctttgagttctagggtttgcttctttgctattattcaactactaaatatgtagtagttaagctttcatcaataaaataagcatatttgggcaactttaactttctcatccatctgttgaaaaatcttagcctctcaagggagagcaagtggagatggtaacaaagcccagccattgcgacaccctctactaaacaaaatgtcatggcaccacagaaaaataactaattattaaaaagacacttaacatctgatttggctgcactcttgcagctagatagattctttttgtcctgaaaaatctttaaagactagctcttagaggctgatcctgagaagttgttgcaggggagggagttccttcccagtaccccattttcactccatatccacctgtcccttactagataccgcctttcattaaaaaaagggaaaatgcctcaggccttgcatgcggggtgatagtgatccttccaaggtcactgacagcaatcatgatcttgttattttctttaatattaaaacttagagtcttagaagagatttagccattagttctatccctactagtacatcaaggctctgtcctcagcctggttgccacagttgcttagctagatttcagatccctggcattatattcttctttcatccacccaaatcaatttttctgttctttgccccagctctctttactataatcacaatgcctaaggatctttacttgaagggaggagatttgtgttattatttctctttaaagttaattcagcattgattccatttttaaaaggctgtatacgttgccattggaagatctctcgaatagtgtagttccttatgcaatgcatattccacagattaaggcaagtatcctagattccaaagcaaaaccagttctcccatcaggagcagagcataactgcttatctgtactgcctgagaatacaagggttggccagttgctatatacacttaggtctctcattccaaactgctgtataatggtgaatagaggatacaagcaacaagtgtgtgttcaagactgtttaaatttgtattctgctgctattttacatatgtctgagggtaaatatggtctaagggtgtacaagttgagcgctggattagcctccagttaaagttttattttcattttggtatagagattacaattttcagtagaaatgctgattgacttttctcagtgaactcttaagtacctagcaaaagcctgtgcccattagagaaaagaagcatctatcatctctacagtggtttccaacttgatttggtggaaatgaacactagcagtgcatgttccctgccttgctataaagctcaggctgacctcatacttcctatgtagtctaggctgtctcaaactcatgctcctcctctacatataccatcatccttataaccactttaatgttttttaatatttctttatttgtgtgtgagagatacaaagagggagagagagacagagagagaacacacttgtcttgtctgccatggcacatgtgtagaggtcagaagacaatcatgaatgagttctttattttaccatgtgggtcctgggatttgaactgaagttgctagtttttataacaagtacctttacctgctaagccatctcaccagccctgataacaagttgtaatattagaaataaacaatattggtaatgttttgttaaactggttactgaagggtataaggttaaggttttatataatagtataatctttttcctctccctatgagcaggaattgtttacatttctcaaatgattgcctagaaaatatttccacaaaggaatatggtatttcttctatttcgcccaaccccacatggctcttatgtacttatcacctctcctgtgttttgaaaatgattagggagccagaataactggccattccatctgaattgcccacatggacaataggccatgttagtcagagaaaactcctctctgcacctcacagtccattagcttgcagcctttcccataagttaatagaaaccaaactgtgttccctttcatttgtacttgttctctctctctctctctctctctctctctctctctctctctctctctctctctctctgtgtgtgtgtgtgtgtgtgtgtgtgtgtgtgtgtagggttgatgctttttccaaattaaaaaaagcaaggtctcttctaagtgcttgtagaattataagcagaattttagataacatatttagaagtataaataacattcttaggtgtctttgatcagaaaagcagtcttacaactaagcttttcctaaatcatattgcaggtaactgagtgaaaaactgtaggcttctgcattgtatttaaaataaaaagtacattccccgtgtagcaaatagtagtaatagctcatctagtctctcaaaatggaacccagaaacataccccagtacctgtctgtagatcaactttcaaagtaaaagtgaacccataatccatatatttacaatttaattcccaagcttaatgttactaagagatctccattctgtgacaagttgcttttgtcattttcttctttcactcccacacccacctttctggagtcctcaggagcttcacagtctcagagcagaggattctgcatagggtataatgcacagacaccaaaagtgccagaaaacgatagctgccttgaattttcccagcccagtttcagaatggattctacattttcagtatcttctttataagtatcagaccaaagcccagaccaactgctacactgaaagctttcttttcttttcttttcttttcttttcttttcttttctttttttttttttgtaagaggaagcttattgttcttttaagaatgtctcaggaaagttgagccattgcttttggtgggtaagtgtgcttgcagattagtgcatgtgattgcatgtgtgggcatatgtttgtgcttcagctgtgtgcatttcacttttagacaaactcatagcccaggctgctggggaccagatgttcctaaggattcttagaagtaaacagtgacaagtgagcttctcaactcagtattggagtctggctcgaggaatgaggcccctctgtaaatcagagaggagagcaacagcagaaaagatggatatgaaaccacagatattgtaatctcctcagtgaaaaaagttgatccagcaattcccactggatccatacatgttgtaatttattattttatgactttatcttttcctttaacctttgcccattgtacttttgaaaaaatgttgggatactgattataatttttaaaaactgcaaaatatatgaatcagccccttgagtcatttttaaatgttatatgactataattagaggtttttgttatttgccttttgaagacaggtattattattttataaactccagcacaggttagaaagttcactatgaaattaactttatagcatcctattttgtgggaatttgcatgtgagatttttagagttctgagaattttatacatgagcataatatatttacatatccaaccctccctctctccccatatttctctcagagtaccttctgcatgtctatctttcaaattcatgtcctcttgttctataaatgttattaaatctacttagtgttatccatatgtacatgagtttagggataactactttggcatggactcatcaagaggctcatccctgaagaaacctgactgtccttccctcgaaagctgttggtttcctgtggatcttcaagccagaagtagggtcttttgaatctttacttcatccatgtttgaatgtctctcagtatagtctcatgctgatcttgcgcagacaagacactatttagagttcatggatgtggcatctccttcaggtccctctggctcatactatcatttttaatccgtttccattggtaataggtgaagggattatattacaaatctactgatttgggatgcacaccccaccatgacttattctctacattggatgaattacagatcactaaagaagcccgtgtctgctacaaaatgaagcttctttgggaagtgacatacatgaagcctgtgtttatgtatggatttaaggataagtatttagaacggagttagatactctatcagtttagcaaaatgatagtaataggttctcttctagtgtctatgactactccaaccacaggttcttgactaggtttatagtatcagccatgagtctcctattattgagtagaacttaacccatatcagtgagatgctggttaccccaagatattagtgctactattgcactactgaggatatcttgctagttgttactgtagttcacagaatttacaactgagtagaatcagtgatatttttttctcttctgccagcttgcatactaagtaccttaaagtaatcataggaggcttgcaggtccatcccagctctatttatccaactcctgtgaccagtgtgctatcttcagcaagagggtttgactcttttaagtactagcaggcaaccaaaactaacagcaatagcctgtattgttgagggaagtctttagtggcctgtggctaacaacttgcaaggcactgggcttaaaaccagaattcctgcgtcaagtgtatgtgagaatggttcttctgagtgagagaattggattcaattcgaatcaattcccatgcagaggaataaccttctttgaagagaatggaaaatgtgttctatgctgtctcagagaagcccacttcccaggcaccatggctaacccaaaggtcatctttaaatctaattctccaattgaggaggaaattgttgcacctccatgcttttgggcatgtaaaataaaatttcttcacataaaaaaatagaactaggtaactttgggagtcttcccattttgcacctgtagcccatttttggagttggacttgccttgaattcagagtgatgccagaagaaacatttaaaagttacctctagtttgatgatacttggaactctggacttcttgtgtttttctgataccctttatttcttacagtcttcaaatagctgcttaattttattctgtgtaattttacattggcatttagtagaaaggacaggatactatatagtaaccccaccctatgtgaaaccaggacccacctacagatgctttagacaggaaatggtattctgtaacatttttaaaggaattaaattgcaaccattttaaaacattttccagagaacatttctttgtttagacccaggcttctgtctaagattttttttctccatgaagaaatcccttctatatttattgaaatgcaggttttctgatatgacttctgttggtccttatctgaacaaaagtattgtttgatttttattttgaaagatagttttggtagggtggaaagttctgatttgattttttgttgtgttttctgctcccatgccatatggagtgtcactccatgatcggacatagtttctaacaatatgtgctataatcacctttgttttcccataggattatattttctattcctttaggtattgtcaagattttatctgtaattttaaacaatttgatatgtctatatgtttttaaatgatgtttatcctttttggcattttctaaacatcttgcatgtatgttttagagtctttcattgattttgtaaaagttttaaaaaattatttaatattaaattcttttttaattcttttgttactctacatacatatatgttaggtcttttaatatggttcctcagcaattggattttctattttgcttacttattttctgctcttactattcaagtttgtacaaccttcattggtttatctccaaattacctgaggtaattaaaggcattctttgttattttattgattacttttcttgttgctgacaagaagcaacttaaagaaagtaaagtttatttccagatcacagttttgagttgagggagcccaatctggcaacgacctgtggcagtagctccctccaaagtggctggaccatgagcctggaatggtggaggtagaactaagagttctacatctgaaagtgctaggagaagactggcttccaggcaactaggataagcctatacccagagtgacacacttcctcctataaggccacacctcctaatagtgccactccctgggccaggtatattcaaaccaacacaagtcccttcagttttgatcattgaactcccactacaatcactcattaatctctgattatggcattctaggggttctctagccccagttccaaactcttctgcattccacttctaaacttattccaaaggcctatgtagcacatagcaggtttaccacagcagtaactccactttgatactagttttctataacatttgcttttctcatcactgtgacccaaagcctaaaaagaagcaacttaaggggggggatcattttattttggatcatgatttgagaagatatcagcatcataatgaggaaggcatggtggcagacatctctaaaacagcaggagcatgaaactcagaattatcatattttcacttcattgcacagtaactagatatagaatagaaaaactaaggataggctataaaaccccaaggtctgctctccagagatccacttcctgcaactaataccacattccaaagattctacaacattcctaaatgatgtcaccatctggggactaaatgttcaaacacatgaatctatgggggggggcattttatatccaagctgtaacaattattctgtttcaattttttctggtgtgctgcccacctttttcattaatgcctataataatattatgaaaattacttaaattttactttcttgtatattatttcccaaatcaacataattcaattgtttaatattctctctctctctctctctctctctctctctctctctctccatatatatatggaatatggactgcatcaaagtgtttggtggtagttttttttttgtatagagcaatggagattgttataaacaataattgttttaaaggcagatggccatccaatatttgacaaaggcatcaaaacatagactgtggagggaggagacatcctattcaacacatgttgctgacaaaattggatatccaactacagaagaatgattatgtcctgacttttcaccatgcagaaaattcaattaaactaagccaaagaccttaatttaaatcccgcagctgttaaaagaaaacagggaatatatttcaagttatagggatagttcaaacctttctgaaaaggctctaatagaaaagaaaacaggaaatagtcctcaatgttaacaaatggaaatacataaaaccaaaaagtttctacatagcaaaagcagctatcatccaagtgaacagacaacctgcacaatggaagaaaaacctttctgagctatacctcaggtagagtgttgacatctatataaaaaccataaaaagtaaacacacactctcaaaacaacaaaactaccaatcagtaaatgggctaatgaagtaggcagttttcaaaaaaagaaacaaatagccaataagtattgttttaaatgtttaatactcttagtcatcaagaaaatgaaatttgaatgcactttgaaattacatctttcttctcaattagaatagctattataaaaatatgaaggagagtgcaatactgtgtatgaaagtagcatcatcactaaaataactatcattttgagaaataccatgaggacaaaacctaatgacttcatggttcttattgattacttttctaaggaacatgcttcattatttatatttaagagttttacctaaattgatgtgtaaaaattatttttcactgattacatatatactgctgatataagggtatgtggaaagaaaaactgttttcactgctggtgaggatataagctaatacaaccattatgggaataagtaagagtcttctctacctctgggcaagtgcccaaaggactgaatgtccctactacaaagatacatgtttatttctgctctgttcacagtaacaaggaaatggaaccagcctaggtgtccattaactaattttaaaagtttcataattccaatgagaaagcccatgcctatgagtagtcctttccagcttccagcccctgtgtccagcccttagtaaccaaacatattttctatctctatatttacctctttggaatgcttcatataaataggattgtataaaattatgatcatttgtgactgatataaaaatgaaagaaactattttccatctttatctaggaagtaaatagcattatcagcaccccattgtttcttaatgctgaacaacagtcctttgtatgcttaaaccgattttgtgtgttcatcagatggacattggagttgtttctaccttttgactattgtaagtagtataaaatagtctcatgttttggttaaatttttggttaaatacctagttcagttcatttggacacgtacaaacaattggaattacctgattatctatatttaacttttcagagaattcttctttgtgaaatggctgcaacattttgtgtttctgctattaacaatagaaggttttaagttctccaacaccagtatttattattgcctctattttccattatggtcaggctagtgggtacgaagtgatatctctggagtttaactcaaagtttctttatgtctagtgatattaagaatatctgtgtgctttttgattattgtgttatcttctccaaagaagcatccactcaaatccttgtcctaatttctaattgtttttcttttttgccatttatcttgtagcaaatataaacaacataaaatttaccattaagcatagttttgtggcattattttggaaccatctcttctatccatttctaagaactacttcatcattccatgctaaaactctaaccctcatacaccccaccctctgacagccatcattttcttttctctacagttttatataggttaacacatataaatagaatattacaatagctatccttttgtggctggcttatttaatttagcagagtatcttcaatgttcatccatgatgaggaatgaatcagaattttattcctttttaaggcagagcaggagagccgtatcagccatatgacagtatacttccccagcaacagaaatttatacccaactacaattaaaattactttggggatccttagaattcagttaagggtttgaactttggtggaaagcttattttaagagggtgtcagatttgccaacctttgtcctatttcctgaggctccatattctaataagctgagctacaagtctacttagtattggtattgctactaaaaccatctgatgggtttcttttgaaggagttacatatacctgtacctcaaaggataagcctgcacacattaaacctcacctgtccactggaaatatcaaacattctttgccgtagtccaaggtcaattgtgtgtgtacaagtattcaaagagaggtatacccctggattttggaatcagccccttccctgcctctacagaaattcagagacaagcatgtttatctgtatgtaatcttataaccagggagttctcatggaatatcccaaaatggacctgaaatatatttttagctcctctcaaccttgatttgaaaacagtctaccactcagagactttgcacactggaactgtccacacagcaagggacactatcatgctctagtaggtggagccaactttcttaccactatgaatcttgaaactgtattagtaatcagctctagctcctctcagctatggtctgtgagtagatcttcttgcttatctagggaatagtcaatagcctttttcatccatgagtacagagtaaaattcctatagatcccaggtcttagtctcagctgatgattctaaacctcccagttccagcagtccagaaaatgtacagatagctttaacctgttaaaatcagtctagaaaaattcaaagagtcaggtcacgtggtgcagaatactgaagtagaaggatcagaaattcaagccctgcctggtctacaaaggaaattccaggccaacccttgcaatggtgacagacgtaggtactgtctgactacaatgtgttgaaatatatatttcacatttccagaaagtaattaactgcccaaattcagttataagatgcatgcacacttcttgaataaccacttgtaaatgttggaatgtaaaaaaaattaactgggattatggatgctttttctgcagaacaggttagttttaggtataaatgccctccctttgttagatatgaaacaatattcagttctctttcaccttcaaaagactgacagtaggtggaaacgttgcacatgcagaatgtccttcctgagttttagtttagtagtaaacgtttcaaattccctcaaaagaaattggagaaacaaatatgtcacctgtgacccatgtcacagcactgagaggaggatgaagaagcatcagtatttattgcataacaaattgccaggcagcctacaaaacatagtgagacaaatacagacacagacacacatacacacactataactgtatgcatgggagggaggtaaaatgggagagcaataagagaaggtgtggaggagagagttgtcagaatacattataaaatgtataaaattgccagaaacaaaactaattagaaaactatatggcatggcttctcttttagaaatgaactaacaaaactatcacatttatactatgactacaggtactattgtcccaacaaagctggaaaccagtctcccacttataaagacgtaatttaatgctaggattaatgaatttaaaactgaagataaaactcattgagaaatgtagagatcatgtagaatttgacccatcaatttttaatatcaaacattgaaattaggttccccatttttatatgaagagatttcaaataaacgattaaattgtcagctcttcttggaagccagacattgtggcaatgcttgactgcttggctgctgaggagtgtgcagatcattgttcactgtgttgtatgtgatgctaaggtgcttgtctcctacctatcaatcattacagttacacttgtgttacatgtagcagtcaatttcattcatttatgttaccttcctggagccttaatcacatgtaatccagttctcatccccttatgttctctgtatttcctaagaatgccataaaagttactatgaacttggttgctcaaaatacatatatatgtatatgtgtgtatgtggtgtatgtatatatgtgtgtgtgtgtatatatatatatatatatatatatatatatatatatatacatacatacatatgtgtgtatgtgtgtatatatatatttaatatttgtttatacttatactactggaggtcagaagtccaaaatcaaagactattcaaagctgtctatgtcctttttctgtggcttagttgctgaggtctgctagcaaccttaggtatctgttgatttgtctttgttctcacaccatctcctcatgtgtgtctatacggcttaagttctcctttgcctatttcttataaggacacctggatttggatttggatttggatttggatttggatttggatttggaacttacactaaatgcagcataatatatcttaagttcgtgaacttatatctgcaaggaccatttctctaaacaagaccacatttacaggcaataaagttgtagtataggcatagttttttgtaattactattcaacccatcacaaccccatttacaaataatactgaaagcaaagtaggtttatgcatgcctgccaaatatacaagtatttgtgatagttcattcaagaatcttgatttctgccgggcgtggtggcgcacacctttaatcccagcactcaggaggcagaggcaggcggatttctgagttcgaggccagcctggtctacaaagtgagttccaggacagccagggctacacagagaaaccctgtttcaaaaaacaccaaaaaaaaaataatcttgatttcctgacactcagagtttccttttcattgatttatgcctgtattcacccctgatcaactcatgttctaaataaaatataaaacagaaacaataaatttcctttacctttgctattttgcctgtagaaatatttaagggtacagttccttttaaactttgtgtaatgctctttaagaacatgagaaataactgggtgtggtaacataaacctgtaatttttacttaggagatagaggcaggaggatttcagtcgagcatagatcacacagtaagaccttatctcaatccctgttctccccctaaaacaaaacaaaacaccatgatggagtaataagaaacaaattatatgttaattaaaatttccctgaaaaattttaagttcaaaacctagctctgtgactaacctgctgtgtaaccttgggcaggctccatcttttggggacttcagtttctgaactgtgaaacaaggagcatagacctgatgatgtctaagcttcctctacctgtaactctctggaatcccacttgtacagaattatcctcaatggggttatatagccattgtcgaggtactgtttattgcccagcttagcttttaaaaataatagtctctagcagagataatctgttccaccactagctctagtttagtgatgttacttaaatgtaatttccagtgttaggaatgagtttgtcttgaactgtagtttcaagaaatgtaatttccagtgtaggaatgagtttgtcttgattcctctcccatacccgatctttgtaaccttcttatacacacacacacatattactgtacagtagttaatgcatacaccctcatgatcatcttctgatctaggatatatgatagattgatatgtcaagccaactggcagaccaagatatcagccctgactttagatgtaatcttaaatttggtgctgatatactctgcctacctggctgctttttgctgaatttctgtgtttcagtccccttgactgaagcacatatcacgaagcctacacatgctgaaatgaagagccacaaaaattgatcttctatcaaaatcaccatgagcacagtttatgatatgatgtaaaaaaaaaaaaagtcaaagaatcttttggttttacacaaagagtatatgctgttcattggctaaggctatgtgggaaattaccacaaaacaatcttacaatcctaaaggctaatggctgagatgaagatagcagtaaggttagtttcttctgaggtttcccttattggtttgcagatggttaccttgttccattttcatgtgatctttcttttttgagtgaatactccttatgtttgtgtttctgagaacacatgccatactgaatttaggtccacattatcagccctgacacactgcttggtactaaggcttaaccctttaatatatacgaattaaggcagacaattcagcctgcaaaatgcattacactatgaaatattggagctagactttagagtttgcttacttttattttacaagccataaagattaaggtggaggacagttaagacctatcctaaggcaagtcagatgaaattagtggtagaggcaggcccagaaatcagatctctaagttcttgtccttcccagcataccatgctggcacatcatttcatctcacttattcacaccttaaatatcccacgcacttgcccttgcttgttcaccactgactattcggaataactttggcaaaagtaggaactcatatgcttttaaaactatgtttaatttttcttatacttatttagcttcaccacttatattttaaaagaaaaaattgaggttttcaacttaattgctttccctctttcttttaatacatatttttttcattgaaaataatagcaattttttccgaaggtgaatgaactcgactttgtcaaaactgacagtggattaaaagagaagcaacctcagcttttaaaaaaataaatcacctttcagatctgaagtagcaaaatatgattaggacaaacctttgccccccaccttcccctgtcttctttccgtagagcaggaattcagagcttctagaaaccttgatgtgcactcttccacctacagacagtaaatatcaggatggaactggtggggtaaaatggcctgtctttggccagaggtatttaagctcagaccttggaatctaaaaggaaattcaaaatgcaaatgcttcctgtcttcacttgtaaatcttctgtactttttttttaaaaaaaaaactgaaatatcaagagagaaaaatgaaaaaaaattgagttatacagacaggtaaaaggtctgatagttcaaaagatttatcaaaatcaagtgtactcttccatttaatcctcgaggagtttgcttttacttaactactggcagagctatttcttctcaacagcagttagttactgcagtggaccatagaatgcttaattcgatcatccctaaatcctcacttatttgcatcttgagagggagaggggtgtttaatgacaaaaagcttttcttcagctgagttcctgagtaacatggccccaaggctgccctctcaggttgtcatccactgtggagattagagagagacacatttgtacctcctgtgtattgtgtcagagccccacccttactcaggtcagtcagcaaccctaggaagtacaaaaatatatacagctgtgcctttgaggtagaaaagacattcaaaattcaaaacacttctatcaagcagactctcaataattttcactccatatgagatacaaatatagattaaattagactgatatgattttatactggtcttgaacaggggggaaaaatcagtacagaatcatataattctatttgaagttgagataataaagcaataatttctttattaaactataaagttttatgctgtgtgtatgttagtaactttgtttctatttagtaattcatttgaacacagtttctttggcctgacaaatattctaatgtactatcagaatttctttctgacttataaaatagtttatgtaatttttctaattaggttttattgtcacctgggaaaggagaacctcaactgaagagttgcctgatcggattggcctaaggacgcatctgtggggcttcttcttgcttgctaattgatgtaagagggtccagaacactaagggcagtaccctccctaggctgatgcaagtggtctatacctcagaaaggttgaatgtgaacctattattgagccagccagcaagtgctgtttctccatggtttctgctttgagttctggcttgagttcctgcccagactttgctcagtaatgggcagtgtgacctgaaggtgaagagctaaataaattctttcctcccctcagtaacttttttatcagtgctttatcgcaccaacataaagaacactagaacagtagttaaacaatttaatggaaataaaattaaggttgcaatggctgtgcctattgagcttattccctccattctctctccatttgcattttaagcagtcaggtggcgggcatcaccatattctttatgttcccagagttaggtaattagtagacacttaaatgcttgtaaagcctcttgctttgctttcttgtctctgtgcatttactaaggcttttggcagatatttgtactcctttaagttggtggctgccactcttacaatgatttttaagtgtttcttgaatatgattttacatgtaaagaagagctgttgtgtcataagaatagagctgttgagctctgcttgatgtgtctttccttaaatgtgagatcctagcatccaaaagcgcctgagaggaatatattataagaagatatgtgcaaatcacttgcattcttctgtagctcatcataggaatagaactatttcagtgaggaacacagtaagaatatatctaataggttacacatgctgtgatggtctcatcaaatggtccctgctaatcataccagtcgctgattgccatcccttgggttaccattgaaaacactcttccattgtttggtaatgaacagtccctaatctcactgctgatttcaggtaagtgtgccagacttgagatatcatcaaaagtatatcatttgtcatagcgtgttttagaattctaaaagaccatggcaaataggaaggagaccaagattcttctctttcgtttaattttttttttttttaaagaatagtctgtatctcagtctggcctcagattcactgttttgtcaaaaataaccttgaactcctgatcttcctgccctaactctcaagtgctggcattatcgaagtatgccattgtgactggccaagagatcatatttttttctgattattagaaattcaatttgttacaatatatgtgttagctatttacatatacagttagtaggtatatagagaataaatatcatgatatggtcaaatatgttgtatatagtatatattatatgtatgtgtatagttggttaactgttcctacatgctttctgcaataattttctacaaatatataactatatacatatataaatatatatagctatacaaatatataaacatacaaattaatacattctctaaaaacatcttacatacatcctctcttttaacttttaatccttaaagaatctctgtaagtaacaaaaaaaaagtaaggctaagagatatcatatatcctacaaggtttcagagccaggaagcagttgatcctgggccatttttctaagttcttactctactattttgcctgtatgccacagctatcattattacagagataatgtgctaaaatagagccagacctcctgtatttgaaacacagctattttgcttcctggtagtgttatttctgacaattttaagcatctctgtgccaaaagtttctcacctgaaaaatagggacaataagagtacctaccccatagtgttattgtaaagcttaaataagtagatttataggaggcattttgaacagtgccttgagtagttagcattctcttagtgtttgctgctatttttgtgttatctttattattcttattatgatcagcagcagcattattgcatagcatggcagctaaaattcacagtcattatgcacagactaccttcatttaaatccaaattccattaattatgtcaacttgcacaaatttctttgatttccccatgcctcggtgtcatcacaaatatatcagatactaaccacataaagctagagctgctgtgagtttgaatctgtgaaagattctgatgtacagaatccccatttgcctttttcctgctgtcttgcctgcaaactcagagctacgaggtgtcgctatggcagttatatattgtatgtgtcatatgtaactcatcagtcctctgtagtctaatcacagaagccagtggtttagttgtcatggcagtcctttggtaggaatgtatttgtcatataaaagttattttggtcaatcagtatggtatggtgaaatgaacatttgctggagattcagttctattgctaagtcgttttacaagtgaaattccagagcgtgaagaaatcacttagaaagagtaagaaataataactttctagtcatgcctgttttttctgtgaagagtggtgctatattttccagcatataatagtttgagtttatattagacaatgtgataactgtgcttggggaaaaacattccaagtttgatgtttttcctccacaattatattagaaattaattagaaaatgggacacacttagcagttacttcagaaatgacttggtaggctctgttcattaaatactactaattgggatactatggatatattcataggcaacacctcagtttatgaagtgattttattccaaaagattctaggctatttaatttgttagagtttcctgtacaaactatgttattattgtgaggaagtgcccaggttagctcacaacctgttataagacttgtatgtgcagtttacataagaatgctgctcggtgttagtaattaaagcaaaaaaatataattgagcagaaaataacacctggatgctaaaatgtaagaacagtagaattaattacaggttgaggagagagacggcagattcaagagggtctttctgaagagcacttctagccactttgagaggacattaggtgttgatggcccaggattttttggtctaatttcagttcgaaaaggatagcaatctcactaacattgctcttataactgtcagtcataattatagtcatttagggtccacaaatagaacaaaaggaccgatagagttcttgaagatactggacaagagaaaggggaagaacaaaagggtgatctgggtccatgagatgacatacaatagggtaaggtagaattagccccagcaaatgatgaaagaagagaaatggagagctcagcttttatgcaggatcctggtaaaaaacaaagacgggaacatttccataatacctgagcacctgcttaacttttattctcattctctcgtctctgctaggctggctcttaaagggcaaaatgatttcttattcatccctctgctgccaacaatagtgagtacataagtgttgaatatactagatgctaaatgaaatcagatttcatctcacaagtgaatttttttgcttgtatctgatcagagctttaaaaatctgcaaaattatgcctttgatcagaatgaggttcatagttttagaatttaccataattgaactcagagtttggaattgtggtattgcaaatggagaactgagaatccagtcacaggttgttgatttgatgaccagcaaagtcccttctgcctatttcataggttacagctcttctgactccatatctctccttgaagatatctgaccaaagtaatttgtaacactctgcacatagactccctgattgacaaaactctctgactgctataacttctcacaacatcctgtcacacacaaaaaggtgatggggagtttgactgttgattctttctcttcctcactatttttttttctgtttgaccccttccctgatgcattcctgctggagacaaaaccacatgctgaaccatgaggaacagaccgcagtgaaacaacaagctgctcccaattttaaatattgcgtgttggggcaaaggcagagttccttttactctaaagctataacattaaaaaaattctgtttgatattcagagttatttgatctggcagtttaacaactgttgatgttttaattgcttctttaaaggatttcatctacattttaagctttatttttattttactctgaaggaatgtcaatattagccatcactttgcccagtaacttaccactgcaagatcttggagtaaaatccagtaattactggcgctggtaacttaagaccctgctgagaagtttggcagtttcccttctcctgaggaggctctcttcccatggagctagcaatcttttattgttctgaatcaattttaagcaagtgttgtaccttcaagatcagctttctatgttcctctagaagagattgaggtcactctattctgagtgaaagagaaatcttaggttactcttaacatggacaaatgtacaattgtaagatgtgttaacatgaatgacttagagattttataatcccttgggggtcttagttcatttttatttgtctatttgttagtctacttccaggaccaaatagaatgcttaattggcatgctacttacatgcatgtaactatccatttaaatcctctgaacaaaactactaacattcaaagtgctttagagatgaaagtgccctctgagatcatctggtccagcctcttctaaatgctttagcttgtattcattaataataataataataataataataataataataaaaagatgcttgctttcagacctcattagatgagtttctttgtgtaatgggttgtgattaactcagaagctcacaactggttgaagtgcatagtataatgtctgtggagtgctcagttacaaataaggcatctgtatcacatccaatgcacaaggctcagggaccatctaggaaaacagggaagaaagattctaagagcaggtttgagaggagctgagcaaaacaatgtgttctgtacatgacaactgcactcatgaactcacagcaacagtggttggccggtaaaagacctgcacaaaatcaagccagtcaacattccagcatgaatgaaatagacatttcatgagctaccactagctggggagctatggactgttaaatgcttctaggagaaggagagtctattttatttaagggtatgatggcttctagtattccaaccattcttcagtgaatgaccccatacccaagagtatgtaggtcaatagattatttataaaaagaatatgaacttgggggcataagaaggtagtggtcggtctggaaagtgccgagggggaagtttgaggaagaatatgatcaacattgtgtgaaattctcaaagtattaataaaaatatttgaaaagaaagcacagaaaataaagaagtatgctagagctcacattctcatctatttgcatctatatgtcatttgaattatttacaccaagaaatatttataaaatgcttacaatattgaacccagtctgaagcaatacttagagtttgagagcttacacactaaaatgagaagcactgacaggccacatttagagaattatattctctcttctgaagcttctttatactctctgtccaacacacacacacacacatgtgcgcgcgcgcacacacacacacacaaacacagaggggggatgacgttgaggccatagaaactaatctccaaaccagttgcttttcttcatgaagcagcactgctctataagacttcctttttcaggaatacttcatccttatcaaggataatcaaaagttaatttaaaggaccagccaactggttgatgggggcaggaacccctggctaggatatatggaaagcagtatacttaaacatgaggtatattattcagtcatattatccttttctgcctatactctatctcctcaacacagaaaacaactatatgactttgtgcttagaaacataatgcctaagttttcatacttacatatcattctcaaccacccttttgggaaagtgggatcaaatactagtttaagtaatatttacaagtcagaagcttccaaaaggatctcttgactttctactgcttctttctggtatcacttcaatagccttaaaaggccaacttttgtgggtgatgatatgattttaagtcttggcatcctttcctgatagacatctctcaatctttgaaaagtttaaatattactctgtgaagaattttgaaatataaattatggtagttaaaaaaaatttacatggagctggagagatggctcaccacttaaaatcactggctgttcttccaaaggacccaggttcaattcccagcacccacatggtgtctcataaccatctttaactccaaccctagtggatctgatgcccccttttgtcctccataggcactgcacacttgcagtgcacagacatacctgcaggtaaaatacccatctgtactggctgattttgtgtgtcaacttgacacaggctggagttatcacagagaaaggagcttcagttggggaaatgcctccatgagatccagctgtgggacatttctcaattagtgatcaaggtgggaggtccccttgtgggtggtgccatctctgggatggtagtcttgggttctataagagagcaagccgagcaggggaagcaatccagtaaggaacatccctccatggcctctgcatcagctcctgctttctgacctgcttgagttccagtcctaacttcctttggtgataagcagcaatgtggaagtgtaagctgaaaaaaaaccctttcctccccaacttgcttcttggtcatgatgtttgtgcaggaatagaaaccctaagacaccatccatgtaaataataaatgaaaatttacaaatataaaaatataacaaatgaaaatgtatacacatatagcataatattaaaacttaatattttcttggattgctttttctgagtctattgatgtagatctaaccttctctgcctaagatttcagtttttgtttctgcttgatttctgtagatcataagcttgatagaagaggagactaccctgtctattttaatttttactaataagtctttattattatctcatataccaaaaatagtacttagcaataattggcattcaatattttatttatccatccatttgttaatttttgagtcgttttctcactatgtagtccagggttgtctcaaactctaactccatcctccacttctcaagcccttgaattgtaggagtgtactaccatgctcattttaatacttagctttagactggtctatagtcttagcctcatcccatgtttatgtctatctttgctctgattagatgcctctatctgaactctgggtatttattgataaatcacaagattgtgggcatttatgtttgatatcaagtatatctggtattttcccaaattcctttctatttctggagacatttctctgattacctactcttgaaactctttaagtgttctcttttcacactagatttctctcctaatcgcttctcagacttttggcaaagatctagtgtagatttctctcctaaccaattcctacccttcatttctgactcctattcctttatctattgttccctgtttaacctaggttgcattttggttcaaagcattttatatattaccatccagtcatgtctgtctcttgtttgatattctataaagaacaaactagcatttatgttttatttgtgtaataaaatacaactcctttctacctgcaatttataagcagtaaaaaggatcttcaaaaacaaagacaaaaagtagctgagtaattgttttttaaaaataattttaaaatcataacattgagataatagtgtgaaaggacttcctaaagttaaatttgtaagtttctacgtatcttcttcatttccctacatatatattgcacttacatatctaccatttgaattggattttgtgaagcttttgatttgggagttatgtcataactatgacttatagaatgtctttgtattattacctcctgagagctgggattatggcatatagtacagtcattctgtctctattcccaatcaccagtgtaaattgatagcagtaccatgaactcaggtatactggcaaacatgcaaacacacacacacacacacacacacacacacacacacacatcacagtataagttctacaatatgccttaaaaatacatcacttcttagccttttggctaagataaagtataaaaatatttatagctaaaagcaatctctttcctatttccatgcatagcttagatcagagaaaatttcaactaagtagatggcaaagttagaattgttgccttgatgacaatttcatttctcagcatgtagaataattcaagcaagtaattgctactgtgataataattccaaacgtgaagaataactatttggtgaaacagtggtgataagaaccttggagaaagaagatgtgcatcttagagtttgtaatgacagaagtggtattgatgaccattcatccttacagaaatgtgattcacgatttgactgaaatatagctttttcatcctgctactgaaatcatgaagtctttcagaactgaacaattctaatttctggacaatagacaaggaaaagaactgtctaaaatagtcaaattcaacctttcttatgtcccagtacaccagaagggatatgacatatatcactccagaaagtgcatgagcacacatcacaattttcagagaagcatatataatttaaaaatccacccaaaagggcattctcaattccctaaccccctcacaaagacataatttatctgtgggactgcacagtacattcttcaatatgtccatatgtgacatgatacaaagagtacacaaatctagttttagtaaagaacataattctaagaatagtgtcacagaggttaaagcctttcgaaaatgctaaggacctctgaatgtatgcataataaatagaactaaaaatagttctctttaaagcaagaaaaagaaagatctggtcccacttggcatcctgttgaaagtgacagctggcagtactagttgcccagacctctatcaatgagaatggtatccaagtagaaaggcatggataaaataattaagaaagaaattgaagctcaaagttagtaaaaagtatgaaaatgtatatattcttttttgagtctctaagaccagacaaactagagtagagctaagggtacagaaagaggctgtaatcacaaaaccactacaatgtgaccatccttaatatgaaaatatgaaatatacaggagcattggcataaacctataatcctagcacttgaaagactgaggccagaggatcacaagtttaagaccattcaggtctacagaataagacccctaccaccaaatatagataggtaggtaagtggatggatggatggatgaataaacatacagacacagacagacagacacatgagaaatagatacatatatttgaaatgcaaactgcactggatgctaaactatttgaaacccaacatgatactacaagtggaaaattctgtattcaaccttatgagacagattacaataaaaactggcatatttaaaatgtattacatttctttcaggtagttatacatgaaagaaatgaactttatatttagacttaagtacaaatcccaggatatcttatatgaatatacaaatacacttaatttaaaaaaaatcctagatttgaaacttttatgaccactgtaatttcaaataaggagtatttaaccagtactccagattataagaaattatattaagaataatctccaaaagacaagaataaacaaattattttttctcaaactgagaggcttggagtgatttggaaatactgtgtatctctaaattgggcaactactatcaggaaaattctaaaagtattgtttcagggaaatactttatgatgtagccagtgaagaaaatgtttgacaccagaaccttcaagttcattctctgaggataagtcactaaggaaagtatagatttttgggttttgtttgtttagtttgtcggttggtttttttgttgttgtttttgtttttgttttgttttgtttttgagacagggtttctctgtgtagccctggctgtcttttaactcactctgtagactaggctggcctagaactcactgagaaatgtgcctgcctctactttctgagtggtgggattaaagaatgcacccccaccactggctgatgcatcattttttgatagggttactaaattagacataaaaagagaccatgaggaaattctgatccttcaggggtgcacgctagagcaggttgagctgcattcgctgtaacctagagggagtatccagtggattactgtagagcattgtgctgcttaaaattcccaccaataacttggacaaaagtattgaagatttgcatattgaatatttagatcatagaaagccataaataattacatatttgaaaattggtatatataagaaaaattagaatgagataatatttgagaataagaggaagaagccaagagaagaagttgtttgtttgttttttttttttttttagtgtagaacaaatttctgatagggtttgacagtttaatatttaatattacagtggtatgtctgatatgataatgagtaccctcatttccagtagatggatttaaactgaaattagatgaccaactctcagactgattgttaatgtaactcactaggtagaaaagtttaggaaactgagttctaagatctcttccagttatgagatggtacaatattccctgtacaggctgttttgacaatagctatttctatcattcatttcaaaaactaaaattcagtaattccaaatgtcacaccacagatacttcattcaaatccaacccaatggtgatatttacatttttgtgtggaaggggtatgtcctccttggtcttgcaaatatcagacaaatttctaccactgggctataccctcagcccccatatatactctgcatggaaagctcccctgtgtggttactttcttctctcattctcctctgcttccaaatatctaaaaagggttcattaaattagtagtagaccttttgtggtagagttctacttgtttatgtctctgtacaaaacattatccctgccatcagagtaaacaataaatagacttattcttttgttttgtatatgtatatttcaaaaataaacatcataatcatgttttttaaaaagtcagtgtttcctttgtagaagcagtataggctccatttccacatctagccagtggaacactctgtcttttagaagtatggggcactgttttataatttagggtgttttctgaaagaagtctagtattctgtattaaactactgtggatttatcatttatctatgaatgtacatgaatttcttagactttctttcctatttgtgtatctagtctaattaatttctaaacatggtgttgaaaatatacccagaaagctaggtaaagtaaaatatagtttcttcagcacaaaggtttgtcactgttgcttatctcttttaacaattatcaggcccctattattgtgctagacagtttcatagttgtctgatcttttccaaaaatatctgtgaagtaagcaagcaatactcatagattttaacttcagttttcaacagtataagcatgcatgcatgtatgtaagaattacccttagatatttgctaatcatttttcaacttcctgctaattgtcttatgttcttactattttcagcagtgagtttcatttcacaagaaacaaaaagtctgttgccttttttcagggacctttccaaatgatgccttagcaaagtcttcatagaatggattatagtgttcttcggtattgctgagttaaatggcctagtcggccatcactggaaagagaggtccattggacacacgaactgtatatgccccagtacaggggaatgccagggccaaaaaaaatgggaatgagtgggtagggaagtgtggggaagggtatggggaacttttgggatagcattggaaatgtaattgaggaaaatatgtaataaaaaaaagcagaaggtgagagtttaataaattcctattattctcttccttaatatggtaccttattcattcataaggaagtttaacattttcttctgtttcattaggtatattttttttagatttttttgctttaaaatgttatgattctgagttgtagtagatttaaaacagcattacaacagttgcatgtctgtgtgcaagtgattttgtgagtacctagtgtgctagtcattctggtgggagagggaacaaaacagacatagttctcaccctgctagaacacttctgatgtacgggcaaagtccctcatgtaatcagcaataatacaatgacaagttcatatatatatgtgtgtgccaaagataacctttttagggcactttagagaaaagaagactctaaaatgaaggcatacattccaatcccacttctaatttctttctatggcttccttgtcactgattctccctagcttcttttctctctctcacacacacaaaatgaacatgttgtgcaagactgctttcaacttcttccctagtcagttaaatactcagtctcaccagtgatacataggtacaggcttttaagacagatacatggattcactccctgcatcgcaagtccaatttgtataatatgtaaatgaatatttcagatcttgggtaagaaattgatcatttttattttttaaatatttattttacttatgtgtgagtgtgtatcatgctagttgcctttaatcccagcatttggcaggcagaggcaggcaatgtttgtgagtttgaggctagcctagtctagatagcaagttccagactacccagggctacataatgagaccttgtctcaaaaaataaaatataagtcaattaataagtttaaattaataaaactttaaaataaaaatggagccaggcggtggtggcgcacgcctttaatcccagcacttgggaggcagaggagaccagcctggtctacaaagtgagttccaggacagccagggctacacagagaaaccctgtcttgaaaaaaaaaaaacaaaacaaaataaaataaaataaaacaaaataaaataaaaatggggcctttgagattgctgagtggttaagcatacatactgctcttgcagaggacctgagcacaattccaggcacctatgtccagtagcttacaactgctgtaacaccagctccaagatacctgatgtcctttggtctccatggacacttgtattaatgtgcactactcctaaatgattggattaaagcatttaccacgatatttgggctgataaaagaattatatgagggcaaatatgcaaccttggtattagaagaagacaccattttccatttgtattaaggtaaaataagcaatttataataattcttttaataaaacatacttataaaatacaatttaaaatttgccaattgttaataaaaacaaataattttctacctttgcatataccttttgacattaccagcattagaactctttggctttagtggatgctttcattgtaaagttttaagaagcatttcataaaagtccctactaaggtgcatagtacataacgggacttcagtagatggtagtccgtattatcagtatagctctcagaagtgttcactgcttataacttccaatcttgagcttatagacacctttgattttaaaattgttttcctggttgtacctcttcattaattcatttccatgttgaagcaacctttggtatgtgactgtggaaaaaaagagaaaactccctagaacccaaataaattgtgcatccattgatttttccactggctacatctttacctccttaacgagctcctacaaatttaatcagaatgatttctacttttaaaatgtgttgctacttcccactgagttattaccttgtagacatttgttcttagagattacagtgtttaaactccaaagaacatttctaaagcacagcaacctaagtgaggtccaaatgctagtgtatggcatttctaggcagagttatcaaagattaaataggatccataggtcagtgccaaactttcccttatctgctgctctcattttcataagccccttgccagaagacaaaataatctaattccatttctcctctggtcaagtaataacacatttagtctattttgtgttaataacatattaatccaagtttccatatatttcagcatttcaattttcttttgtcatgaaataagggcttactatgtacacaggctagtcctgaacttgctatatagcctagcattactcagaaatttcactgttcctatcttatcctctcttctgctttgattatagatatgcaacaccaaacccaggtaaattttaaacgatggtattattttaattgtatatatttaaggcaatgacaggatttcatataccttacattttactaaaagatcttaagcccatgtgacatggtggcatatgcttcttatcccatagtttgagagacagaagcagaaggaccagaagttcaaggccagccagcctaacttcataatcagtgtgtagcctgggctgcatactatttatctcaatcaaaatgccaatgccatccttcacagaaatagaaaagatagacttgccctttcggtcggcaccagcaccaggtcaccttgggcacagagtcagcgcataaccccaaggtcccctagaggactctccatgccgtcttaggaccactggtgagtggaacacaacttctgttccaatccaatcgcgcaggaccagagacagcattagggaagcagaaaacccggcctgactagggtcacaaagtcccttcctgtgggcgccagcaccgggtcacctttggtgcagagtcagcagacacccccaagctcccctagaagactttccacgtgatctttggaccactgatgagtggaacacaacttctgttccaatccaatcacgcaggacctgagacaacactagggaagcagaaaaccgagcctgaccagggtccaaatcccttccggtaagcgacagcaccgggacaccttgggtgctgagtcggtggagaaccctaaggtccctagaggactctccacgcgatcttaggacctctggtgagtggaacacaacttctgttccaatccaatcgcttgggacctaagacagcactagagaagcaataaacccggcatgaccagggtcacaagtccctttcgttcagcaccagcaccagttcacatgggcaaagagtcagtggacacccccaaggtccccagaggacagcttctgaggcataccccgtttcgggatccagacattcgggcaccttccctgccagaggagaggtgtccaccctgcccgggagagctttgccagagcacctggtggagccatcatggctcccgaatcccgctgagagtagtctgcacaggtgagagtgaggactacagaagctaacagcttctgggacaggccagagtgacacagcttctggacacatcctatttcgggccttcatcttctgctaggagtcaggtctgaatgccagatatctttgcaccttccctgtaagaggagagcttgcctgcagagagtgcactgaccactgaaactcagaggagagagctagtctcccaggtctgatgatagaggctaacagaatcaccagaggaacaatctctaaccagagaccactataacaactaactccagagattaccagatggtgaaaggcaaacataaaaatcttactaacagagaccaagaccactcaccatcatcagaacgcagcacccccaccttgcccagtcctgggcaccccaacacacccgaaaaggtagacccggatttaaaagcataactcatgatgatggtagaggacatcaagaaggactttaataaataacttaaagaaatacaggagaacactgttaaacaggtagaagaccttaaagaggaagcacaaaaattccttaaagaattgcaggaaaacacaaccaaagaggtaatgtaattgaataaaaatgtccaagacctaaaaagggaagtagacacaataaagaaaacccaaagtgacgcaacactgaagatagaaaccctaggaaagaaatttggaaccatagatgcaagcatcagcaacaggatacaagagatggaagagagaatctcaggtgcagaagattccatagagaacatctgcacaacaatcaaagaaaatggaaaatgcaaaaagatcctaactcaaaacatccaggaaatcctggacacaatgagaagaccaaacctacggataataggagtagatgagaatgaagattttcaactcaaagggccagcaaatatcttcaacaaaattatagaagaaaacttcccaaacctaaagaaagagatgcccatgaacatacaaaaagcctacagaactccaaatacactgaaccagaaaagaaattcctcccgacacataataatcagaacaacaaatgatctaaataaagatagaatattaaaagcagtaagggaaaaaggtcaagtaacatataaaggcaagcctaccagaattacaccagatttttcaccagagactatgtatgacagacaagcctggacagatgttatatagacactaagagaaaacatatgacatcccaggctactatacccagccaaacttttaattaccttagatggagaaacaaaagtattccacaacagaaccgaattcacacattatctttccaagaatcccacccttcaaaagataataacagaaaaaaaccaatacaaggatggaaaccacaacctagaaaaagcaagaaggtaatccctcaacaaacctaaaagaagacagccacaaaaacagaatgccaactttaacaacaaaaataattggaaacaacaattacttttccttaatatctcttaatatcaatggactcaactccccaataaagagacgtagactaacagactgcctacacaaacaggaccaaacattttactgcttacaggaaacccatctcagggaaaaagatagacactacctcagaatgaaaggctggaaaacaattttccaagcaaatggtctgaagaaacaagctggagtagccattctaatatcggataaaatcgacttccaacccaaagtcatcaaaaaagataaggaggggcacttcatgctcatcaaaggtaaaatcttccaagaggaactctcaattctcagtatctatgctccaaatacaagggcagccacattcaataaagaaactttagtaaagctcaaagcacacgttgcacctcacacaataatattgggagacttcaacacaccactttcaccaatggacaaatcatggaaacagaaactaaacagggacacagtgaaactaacagaagttatgaaacaaatggatctaacagatatctacagaacattttatcctaaaacaaaaggatataccttcttctcagcacctcatggtaccttccccaaaattgaccacatacttggtcacaaaacaagcctcaacatatacaaaaatattgaaaattttcccatgcatcctatcagatcaccatggactaaggctaatgttcaataacaaaataaataatagaaagacaacattcacgtggaaactgaacaacactcttctcaatgataccttggtcaaggaaggaataaagaaagaaattaaagactttttagagtttaatgaaaatgaagccacaacatacccaaacctatgggacacaatgaaagcatttctaagagggaaactcatagctctgagtgcctccaaaaagaaactagagagagcacacactagcagtttgacaacacatctaaaagctctagaaaaaaaggaagaaaattcacccaagagaagtagacagcaggaaataatcaaactcagggacgaaatcaaccaagtggaaacaagaaatattcaaagaatcaaccaaagaggaactggttctttgagaaaatcaacaagatagataaacccttagcctggctcactagaaggaacagggacagcatcctaattaacaaaatcagaaatgaaaagggagacataacaaccgatcctgaagaaatccaaaacaccgtcagatccttctacaaaagactatactcaacaaaactggaaaacctggatgaaatggacaaatttctagacagataccaggtaccaaagttaaatcaggatcaggttattgatcgaaacagtcctatatcccctaaagaaatagaagcagtcattaatagtctcccaaccaaaaaaagcccaggaccagatgggtttagtgcagagttctatcacaccttcaaagaagatctaattcaagttcttcacaactattccacaaaatagaagcagaaggtactctacccaattcattatatgaagccacaattactctgatacctaaaccagagaaagacccaacaaagatagagaacttcagatcaatttcccttatgatatcaatgcaaaaatacttaataaaattctcattaaccgaatccaagaacacatcaaaacaatcatccatcctaaccaagtaggtttcattccagggatgcagggattgtttaatatatggaaatccatcaacgtaatccattatataaacaaactcaaagacaaaatccacatgatcatctcgttagatgtagagaaagcatttgacaaaatccaatgcccattcatgataaaagtcttggaaaatcaagaattcaaggcccatacctacatatgataaaagcaatctacagcaaaccagtagccaacaccaaagtaaatggtgagaagctggacgcaatcccactaaaatcagggactagacaaggctgcccactttctccatacctattcaacatagtatttgaagtcctagccagagcaattcaacaacaaaagatcaaggggatacaaattggaaaggaagaagtcaaaatatcactatttgcagatgatatgatagtgtatataagtgaccctaaaaattccaccagagaactcctaaacctgataaacagcttcagtgaagtagctggatataaaattaactcaaacaagccaatggcctttctctacacaaaggataaacaggctgagaaagaaattagggaaacaacacccttcacaatagtcacaaataatataaaatactttggcgtgcctctaactaaggaagtgaaagatctgtatgataagaacttcaagtctctgaagaaagaaattaaagaagatctcagaagatggaaagatctcccatgttcattgattggcaggatcaatatagtaaaaatggctatcttgccaaaagcaatctatagattcaatgcagtccccatcaaaattccaactcaattcttcaatgaattagaatgggcaatctgcaaattcatctggaataacaaaaaacctaggatagcaaaaactcttctcaaggataaaagaacctctggtggaatcaccatgcctgacctaaagctttactacagagcaattgtgataaaactgcatggtattggtatagtgacatacaagtagacaaatggaatagaattgaagacccagaaatgaacccacacacctatggtcacttgatctttgacaagggagctaaaactatccagtgggaaaaagacagcattttcaacaaatggtgctggcacaactggtggttatcatgtagaagaatgtgaattgatccattcctatctccttgtactaaggtcaaatctaagtggatcaaggcactccacataaaaccagagacagtgaaatttattgaggagaaagtggagaaaagcctcgaagatatgggtacaggggaaaattcctgaatagaacagcaatggcttgtgctgtaagatcaagaattgacaaatgggacctcataaaattgcaaagcttctgtaaggcaaaagacaccgtcaataagacaaaagggcctccaacagattgggaaagtatctttacctatcctaaatcagataggggactaatatccaatatatataaagaactctagaagggagactccagaaaatcaaataactccactaaaaaatggggctcagagctaaacgaagaattctcacttgaagaataccgaatggccgagaagcacctgaaaaaatgttcagcatccttaatcatcagagaaatgcaaatcaaagcaaccctgagatcccacctcataccagtcagaatggctaagatcaaaaactcagttgacagcagatgctggcaagtatgtgtagaaagaggaacactcttccattgttggtgggattgcaagcatacagccactctgggaatcagtctggaggttcctcagaaaattcaacctagtactactggaggatccagcaatacctctcctgggcatatatccagaagatgttctaacgggtaagaaggacacatgctccactatgttcatagcagccttatttattatagccagaagctggaaagaacccagatgcccctcaacagaggaatggatacagaaaatgtggtacatttacacaatggagtactactcagctattaaaaagaatgaatttatgaaattcctagacaaatggatggacctggagggcatcatccagagtgaggtaacccaatcacaaagaactcacatgatatatattcactgataagtggatattagcccagaaacttcgaatacccaagatacaatatacaagctgcaaaacacatgaaagtaaagaagaacgaagaccaccatgtggacactttgccccttcttagaattggaaacaatcacccatggaaggagttacagagacaaagtttggagctgagacgaaaggatggaccatctagagactgccatacccggggatccatcccataatcagcttccaaacgctgacaccattgcatacactagcaagattttgctgaaaggacccagatatagcagtctcttgggaggctatgctcgggcctagcaaacacataagtggatgctcacagtcagctattggatggatcacagggcccccaatggaggagctagagaaagtacccaaggagctaaaggagtctgcaaccctataggtgggacaacaacaacaatatgaactaaccagtaccccagagctcatttttctagctgcatatgtatcagaagaaggcctagtcggccatcattggaaagagaggcccattggtctttcaaactttatatgcctcagtacaggggaaagccagggccaagaagtgggagtgggtgggtaggggagtgggcggagggtatggaggacttttgcaatagcattggaattgtaaatgaaaaaaatacctaataaaaaacttttcaaaaaaaagaaaagatagacttaaaattcatatagaattataacagccaacgtcaccataaacaaaaagaatagtgtgggcagtatcaccattctggctttcaaattatactgaaaagtgacagtttcataatcatgatggcactgaaataaaacagacatatatatcaatggagaaattatgttgtctccaataaatggttctaggaaaactatttatctacatataaaataaagaatatttgtggagtgcaaattggtctttttggggtttattttataaatagtgggtagaaaaggtggtgggtgggactgcagagagttgagaaaggttagtggatatgatcaagatgttgaatgtaactatgaagagactaataattttaaaatattgatagcctctacagagcacaattctgccttcctgtatttgcaacaaaacataaatttataaaaataatttgtaataacgatgcaaatcctggaggtgaacatgaacatctgcacacaaagcttatagaattgcctgaacgacaatgtaaaatgcagcattttgaaataacaatgaaaatatataaaaggaaagttataacatggtatacttttaaaataaatacttatttactaaaaaaataagtgaaggaaagaaggaaggaaggaaggaaggaaggaaggaaggaaggaaggaaggaaggaaggaaggaaggaaggaaggaaatagaaccatctccctcaccatacataacagttcatttcaaacgatcaaagaccaacacttttgacataaaatctgttctgtctaaaagaaattcagggacaaagatggagcagagactgaaggaatggctgaccagtgagtggcccaatttgagacccattacaagggcaggcaccaatccctaacattgctgatggtatagtgtgcttgcagacaaaagcctagcatggttgtcctctgagaggctctacccagcagctcactgagacagatgcagagacccacatccaaacattagactgaggttggggacccgtatggaacagttaggggaaggattgaaggccctggagggtatggctaccccacaggaagaccaacaatgtcaactaactagggttcctgggagctcccagaggctgagccaccaaccaaagagcatacatgggctggtctgaggccccctgtacataggtagcagacaggcagctcagccttcatgcgggtcccccaactggagcgggagctgtccctaaagctgttgcctgtctgtggaaccccgtctcctaaatgggctgccttatctggattcagtgggaaagaatgcacctaatcctgcaataactggatgcactagggtggtggatactggggaggggggaaccctcccagaggaaaaggggagaggggatgggaagaattctatgagaaggagttgggagggggcattattggaatgtaaattaatataaataataaagatctgaaactattaagagaaaaaagtaaggaaaacatttccaattataggcaaggacttcagttactcaagaaataatgccagcagttaacatgtgggacttcatgaaattaaaaggcaagtaaaacagttaatttggtgaagaggtaccctagagaatggaataaacctttgccagctctaacctatcaaggtcccaatatccagggtatacagataacgaaaagacaaagctgagaaattaaatgtcccaatcaacaagtgaggtaatgaaataagccagtagttctcaaaaaatgaaatacaaatggccagtatactgataaaaaacgttcagcctcatcagcctttagagaaatacaagttcaaactacactgagtccagttcatgctgctcatatacttacaaatttgagtttctgatggttgtggattttttttttaaaaatgagaacacaaagttggggatatggaatgtgggtggatctggaaagagttataagaggtggtgaatatgatcaaaatataacacatgaaattcccaaagaattagcatttttgagattataatttaatcataacattttctcccttaaatagtctttttaaaaactacattggtgggctagggagatgggtcagccatcaaaaaacctagaatacagagcccatcataatctatatcttatgggctgcactatagtatgctctcaataaatgcctattagactgaggcgggggtaactgcattgagacctaatctcaacctactcaaaatggcaactatcttggtcagtgttctattactgtgaagagaagacatgactatgacaagtcttataaaagaaagcatttaattggagcttagtgacaatttcagaggtttggtccactgtgatgtcagggagcatggtggcatgcaggcagaaatgtagctgaggggtttacatctggatccttaggcagcaggaggagagagacactgagactggcttgggcttttttgttttgttttgtttgtttttcaagacagggtttctctgtatagccctggctgtcctggaactcactttgtagaccaggctggcctcgaactcagaaatctgcctgcctctgcctcctgagtgctgggacaaaaggcgtgtgccaccacacccagctggcttgggcttttgaaaccccaaagccaacctgcagtgacacgctttcccaacaaggccagacctcctaatccctttcaagtagtgccatttcctgatgactaggcattcatatgagcctatgggggggggcatgtttattcaaaccttcacaaccactattaaggaaacaaatgttaatagaatttagacaaaagagaacctttatacagttttggtaggaatataaactagtccaactactatgtgcagcactatagtagtctttaaaaaattaggtctaccatataacataaatataccatgccctagatttacccaaaggactcttaagtcaacaaatcacagagagtcttgcatattaatttttaaatgaaatcctattcaccatagttgagctatggaaacaacctaggtatccattaacagaagaataaataaagaaaacacacatatatacatgtatatgcatatatatgtatatttatatgtatatatgtgagagagggagccttaaaaaacaatccctatcaaaattctaacaccattcttcacagaaaaactgtatatacaaagtatattcacattgtaaataaagaatgaaattttgtaaggaaaaattgatgcaaatagagataaccatattatgcaaaataagctagtgtcagaaatgcaaatatcgtgttttctcttatttgtggttcctagattttatgtagacataaaatcataatgtacaagtagaagaaacaatgtctaggggtacaaagaactaatgggagcagagacatgggatggtgcgattatagaggaaatatgttcaacaagctatatatacttatataaaatggtccttatgttaaaaaatgtaccatgtatagtaaataaaataataaaaaccaggaaatttttaaataaaaaaggataaaaaatattccagactcctgtgcaagcatgaaatatatttcaaggttctccttattttttctgtaatgtctgtgatttatagacttctatataatgtaggtgtttagttagtgttaactggctttacactgtctcatatctgtaagtacattaaaaagggagcaaataagtattagcaaaaatatacatgaatggaaatttaagttgatacatgattgtaaggatgaattagcaccaaaatgactaaattcccaatatcagaagtaaactaattcatcctttctgctaaaggaagctggattcctattgaaaatgaaaggcaatttgaacagtctgcaaagatataattattctgcctgggaaatatgagaccctgcatctctcctgcaacccccaaaagaaagaaaaataaatcactattctgagataacttgcctttctgtgaagtgacagttctttaagaaatgcatttacctacttcctacaaaggtaacaaccaagtgagttaatatcctttcagctttgtcaaaaccatttctataccccatgttagtttgtgaaggcagtcaaatctggtagcaaaatactgatttgaaaagaaaatttccagaagaattaaacatatggttctttcctaagcaactggctagattaaatctaaataaatgtatttttaacatatactggaaacatttgtgactgcttaatagtggggactgtattagattttgtagtgtgacaggagctgaaacttgataaatggacattgatgaaaacccataactggtcaataattaaccatttggagttcagaacatgggacagaaaaggcactgttgatttattatatttttgttccttctacaaaagcccattgggtgtatttacaaacatgtagacaccaaacataaccaggatcacacctgggctatacaccttctccaaactcattaactgaaaagatatagattaattggagggagttcagagaagagtaacagaaatgattaaggggcaagagggattgatttatgagcaaagatgaaaagaattttgtctatacaatttagctaagtgatgactaagggagaagggggtggggacccaactgtctgaaggatgtaaacaccaacgagtaaagagaataatttactatgcaacatgggaatataaatagggctaataagctgtaattacccaaaggaataacagaataagtagttcagggaagcttagaaccatgagactgccaacttatttcacaaggagacaccaacagacatttctagtcttatccaaattaacaagtatttcgtgtgaaataatcatttggtgtcactaagtttcctcttcctcagccttgtcaatgactgtgccttttctatcactacgatacagttcaagtctagtttaccagagttctacataatttgcttagcactggtgggtctttgagcgttttattccagtagtggccatgtaagaacttctccttttggatgagcactccttaagtactgtgaacagagctgtaaaagcaccagaacaagggctcaaacctggaggaggggaaatcttggattcaatttaggattgtaaacaagccagaattcagagtgtttatgtttgggtctccagtataatttttcaaaatgtagctcatgttgagaaaagttcaattttagcattattggaaaaaaaaggggacactaaaaataaatctttgtaagcttcatgatttgtgtaaactttggaatgtggttcttcaaaaaacaagttggtctgtgggttcctgccggctaagttatttggctaattcctagtgtgctatcatgatggtccaaaagcattgcatctaactgctccagagaagattttgcatgtcgctgcagtgaacgcagcctcttttgtatgcatacttttcctcttttcttttgtgttgagaagcttcacagcatgagtcaattctggaaatcattttgggggttgagttaaggttttcccttggtcactgtgttgacatgttcctctggttttgccttacattttatacttccttgtcatcacctttgggggcaaacaacatcttaatgcaatgcttcatttgtcgtattgaagtgtgttttaatttttacacggaggagtttgaactctgagactcacacatgctaggcaattgttgtagtactgagttattgttttggtctattttgtttgtttgtttgtttgtttgttttagagaagctttagatttccagaaaagcagtggcaaagacaccctgcccctggtgtcttttatttctatagtccacatgccacaccaaattaacattaacagaattatcaagtgatacattcttatgaactagaattcctgattgagtcacattgccttagatttgatctattatctaatatctgttttattttccagggttccatccaggaaactatagtatatttgatagtcatcatgtctccttaatttcttcttgaatgtagtaattaattagacttcccttgctttcaaaaacatttaacaattttgtagaatgacaatcaatttgattaatctgatgtttgtttcatgattaagttttggaaggaattaagaccataaagctaaaatatatagtatcaatggtacatggtttatattcagagttaaccttggtcacaaggtaatattttttaagatttctcaactctaagattattttatcccttttaaaactttattctttgtaggggagttgtgatgtccagcccccactcaagaaataaagatttgtgctccatctccttgagagtggaaatagttacatagattatatggaattatgcaaggttgatttttctgatctcatatatatatgtatatatgtatatatgtgtgtttgtatatgtgtgtgtgtgcgcgcgtgtgtgcgcacgtgcatagtagtttaaaattaacacaagcctctgtgggaatgttactatattagtattcatggttatctagagtttctttaccattatgaataacactcgtcccaaagttcccaaattaaactttcttgcttaaaccctttcaaaacaatttctcagaatgagttacatatggccattttcataaaagtatataatgtacattgaacatgtttttctcatacgtccctgtggctcctttagtcccctaattagtttgacttctactttcatattatatgtgtgtgtgtacaaacataataagtaaattatatattgtatttatattatatataataatatgtatgattttatgtatgtatataaattctatggcctacaaattagagaaaatgtgcaacatttttctgaagctggcttaaattccttaagcactggtctcaccatgtatttcagtgagattgtttcaaacatacataataagattctcttatcaaattctgtatcccaccctcagatcaatcccaccatgactttttaaataattttttttcattctgtaaggttcactctactataatgttctgtgtagtttgaaaaatgccatgtatctggtatctggtaagtgctatttaaagtctatttatcatctgcataggccatccctttctaaaatgtcatgtaaataggatgataaagtatatagagttttcaaacattttaatttattgtgggttgtgtgtctatgtgtgtgtgtgcatgagtcacattccaaggggtttgtgctggctggttttgtgtgtcaacttgacacaggctggagttatcacagagaaaggagcttcagttgtggaagtgcctccatgagatacaactgtaaggcattttctcaattagtggtcaaggggagagggccccttgtgggcgggaccatccctgggctggtagtctggggtcctataagaaagcaagctgagcaagccaggggaagcaatccagtaagtaacatccctccatggtttctgcatcagctcctgcttcctgacctgcttgtgtttccagtccagacttcctttggtgatgagcagcagtgtggaagtataatctgaataaaccttttcctccccaacttgcttcttggtcatgtttgtacatgaatagaaaccctgcctaagacaagttggtaccagcatagtggggtattcctgtgataacctgaccatgttttggggaggactgtggaagaactttggaactttgggctagatgatccatttgatgttaagagctatttcaggagtgggtgataactggtgatgactcagcagttaagagcactgactgctcttccagaggtcctgagttcaattcccagcaaccacttggtggctcacaaccatctgtaaatgggatctgatgctctcttctggtgtgtctgaagagaatgacagtgtactcatatacataaaataaataagtaaataaatctttttaaaaagtgctctgtagtatgatatgtaggaccatggaacataatgttgagaacagtgcagaagatggaggcttggcttggaaaatttcagagggatgactaaagactcttttcagggccattgctattttgattgtgaagattctgtggttttggttacctggggctgaagaatcagctgtgattaacaagataccagaactactaaagcaaaaacttttcattactgggactattgatgctggttagttggagctaagaaattagtggtgattaagaagagaccagcatcactgaagtgaaatcttctgggaagtgttttctgagagcacaaagaggctgtgttccagagatagccaaggttgtacctcctgctgcagcaggacttggtaatgtataagagtcactcaggtggtactggttttgaaggcatggaggagtcatgaagtgtagtacaatgaagagcagctgaggcttggcactgtgagaggccatggaaggccattggtaaaggtgcagactcagttgcaattgatggcccaggtcaaaggggtcatgtcatgtaaaggagttgaggcttggcaccatgaagagagcccatgagaggctattgttgaagcctagttacatcggaagacagcagtgttttggagatgccagtattataggatgaccaccaagaacagcagcagcagtggagtacaggcgccggagcctagaaggcaaagtgtgtgctacaaagggcaaggctgcagaagtgacccaagcccttggaggagcttagaagatccggaatggatcccagacattggacagttggagtttgattttgtttttgattgtgactgtaccctgataattttccttcctgaagtaagaaggtattttagtggagcccacagttaaaagactttgaatttttaaaagactttgaaatttaaaagatattggatatactaaaggaattgaaattttaatatgtaagaatttgcaaagactgcaggacttctaaaattatttagatcttggggatgaataagaaagtaagagttgaggcttaatagtgagtgatgtgtttgtgtatcaggttgacaaggagtcaattgtactggctggttttgtgtcaacttgacctcaagagcaatgtggcagtgtaagctgaataaacccttttctccccaacctgcttctgggtcatgatgttctgtgcaggaatagaaaccccaacttagacagcgttcatatggtagtcagaggatgacttgcagaaatccattttctctccacaacttgaagactagagctggaactatggtcatgagacttagtgacaagcacctttgcctacccagctatctctctgatcccaaaagtctatggaatttccaagtgacttacttacttatcaatatggttttcaggttaatccaggttttatgtgacctcatgacatactcccttttttaaaatagcattctattatatggatatatactatattatattcatatattcattcatttaaattacatcttggttgcttttaatttggataagtataggtaaatctgacctaggcattttattcatatgtttatgtgaatataaatattgaagttgttggataaatgtcattggtagatttgtacatctagtacattcttccaaaatagttctgttaataagctttatcattgctgttaccaaaataccttccaggcacaactttagaggggaaagatttattttggctcttggtttcagagatatcagtctatcatagcaatgaaggcatagcagaacgttaatgtcaatttatgccaggaggcagaaaaggggtgaagggaagccagtactcagcttgttttgtactttttcccattttacttttatctaaaccttcagtccatgggataatgccacccacattcacaatgggtcttttttatacatcatttaatccttccttgcaacacgcaagcatactgaggtatatatctcatcaatctaatgaattcttcatgcagtcaggttgacaatgaagatttacaaccacaaatgatttatcatcatttcattctcactagcagtgagtgagggtacctcctgctgtgtacccttgccaacaattggaattgtttaaaaagttttaacctttttaatggtaccttattgtctttatattacactaatgacaagctaaacttctgttttttattttgttattagatattttcttcatttacatttcaaatgctatcctgaaagtcccttccaccctccccatgtcttgctccccaacccacccactcctgcttcctggccctggcattcccctgtactggggcatataaagtttgcaagaccaaggggcctctcttcccagtgatggctgactaggccatcttctgatacatatgcagctagagatatgagctctgggggtactggttagttcatattgttgttcctcctatggggttgcagaccccttcagctccttgggtactttctctggctcctccattgggggccctgtgttccatcttatagatgactgtgagcatccacttctgtatttgccaagcactggcatagcctcacaagagataagctaaacttcttttgaataatagaaaagtaaaagcctctctctttccttccagcccccccccgtgtgtgtgtgtgtgtgtgtgtgtgtgtgtgcagtacaaacacacatgtagttcaaagatcaacattaggtatctcccataattggtcctagctttttttttttttttttgagacagggtctctcactaaacctagatctcaattcagtagcaaagtcaggaatctgccagactgtgtcccctctaaatccccagtgctaggattacagacacaccacatctggcattaatttggatgctcattatcacagctcaggtcctcatggttgaaaggcgggtgctttactaacggagcgctctctctagcttctccaaatccaacgttttaaggaatacttctactttcaccatttcttcctttatcgaaatcgaaggaccaactgtttatcaagtggtagaattaatttatataggaaaggggttgcttagcattcaggctgctacattttataactgtgtaggttttgtgtttctgtattaattagctacaagttaggcaaaaagaaagatttactaaggtgaacattaagtcactggtggcagagaatcaatcctatgtggtgattatgaagaaagtggaaggaattttattagtaagcaagatgcctataaggtcattgtctccctcttaggtccatcacaccctatacacacattcacatctcccattctccatccttaccacatgaatgtggaaacagtggtgaagaagactaaaatgaactcaggatatataccagcatgatttcttcagtacctttaattccttttaaaagttattaattaatgcctgactcttttacacacacacacacacttgtacaagggataaaactagggcctctcgccgggcatggtggcgcatgcctttaatcccagcactcgggaggcagaggcaggcagatttctgagttcaaggccagcctggtctacaaagtgagttccaggacagccaaggctatacagagaaaccctgcctcaaaaaacaaaacaaaacaaaacaacaacaacaaaaaccttacggcctctcatgcatgctagataaatagtattccactgatcagtattcccacagctcaaaaccaaattttgtttaatgtttttcagtgctaaggatttaacccaaggtcttgtgcatatcaggcaaacattatcactgaactacatcttaaattctattacatttaacactgacttaacttgtattttgtgaaatatatttagagcatctatgatttgggtagctcttccaagctgcaaacttgcatttccctcttcaatctatattatatctttatagtttcatgtaaggttaaaaatgcttaaacaaattttattttaattgttaatagagaacaatacagataacactgattggacatctgtgagcaccagacacttttatacatattctcattacacctcttgaagtaattgttgctccatcttatagattacaaatttcagaggaaaatgacatactctaaatgaggcatttgtacatgtgattccttctgcctggaatagcacttccattccatttccaatagcaaagtatcaaacctacaataatcacttcagataccatctaactccctagacagtagtctcagttcatcagaaatctgatacttacccttgtcaagagtcaccatacacagaaccatgccatctgcaaatagggatgtgttaacttttccccttcctgttggtagccttctgtttcctgctttcttctatgtccttctgttgtcttgttgctctagctaacactattctaactagggatggtgaaaatgaacatccttgtgttgttcctgatcttagtgggagtgtttcaagttcttcatttaacacaatagtgactattggtttatcatatatagcctttagtatggtaagataccccattcctagttttatcatgaagaggtgttgtattttgtcaaagatcttttttttttcatcaattgaaataatcatgtgatttctgtgtgagtctatttatgtaatgaattatatttattgatatatatatatatatatatatatatatatatatatatatatatatatgtaatccctgaatgaagataacttgtcttcccaaattttgtttgcaagtattttactgagaatttttgcatctatgttcactaagaaaattgagtaacactggtgttagttttctttgatggcctagtagagttcttcatttaacctatctggacaagccagttgggagatatttgcttgtggtgtgaacattgattaatgcagaaaaaacactaatggtccaagtgcagagagagagacttctggagagggacagtaagttttctttaagggtgtgatcctagtaggtgtaaatgctgctttcatttcttcagataaagggatgaaaggaaagctgtacccaagctgtgtgaatacacagatcaggctgagcccagagcatttccttctctgttctaaccatccctgggcctgggcctgggcctgggcctgggcctgggcctgggcctggaagtttctagcctctgtacaatctaatcttccaagcttactgattcaatcctgttgtgggttggcctcgtgttgtttgtcttttgatgttaattttgtttccttaaaaggggctgccctaactaggagtggatcacacactcaggtgattccatgtgaaccttctcccaattctagctggtcaaataaaggcgagggcctgtggttgaacagttagaaggaaaaggtagagctggaagattgagagcatggaggaagaaggacagaggaagaagaggtggaaagaagttggagcagaagcacatggcctggagaagctagcaagggacctcatagccgggaatagattagtggagtggtatatctgagttctctaggcttctaactgaattgcattgcctggcctcatactaactttggcaaaatattcgaatcttccggctccttttcattctctgactccttctgtcttcaccagtgtctagcttgttctctctgtaacttgtctctgtaaaactatcctggtcaaactgccacatagacacacctaccactaccaccccttttctctctctctcactgttcttaggtagcctctcttcccctgctgttctcatatgggttgggtgtagcttatctctgagtcattctgccaaatctttctctgattcatcactttgtcccttaattaaatgtcactttcaaacctatctccgtccttctacaaactaatcttaccttcattgttagggactaaaagtgtatactaaggacttgtctacattctttggaggtgatcccctgccagaacaaccatgttgctggattaaaatttcgttacaggtagatttattaagctccatggatggctttacacctgtgagtgtatgatcagcacaaattgaacttggtaggttattacaaaatttaaaaagaggacatgaatttaggagggggaaagagttggagatgagtatcaccaaaagacattgtatgcatagatgagattctcaaaaagttaataaaatactatagttctaaaaagaatcaccatacagatatgtatattcctattgaatttctcagtcccttttgcaaaatacagtagtttgtcactcactacatttagcaaacgaatcaggagcttatagaaatgcatttctttgttgttgttgtgggtgaatggataaatggatgtagagccacttgaacaaacttactcaaacaaatgctgaatctctgggaatgagtagaagtgaaagattaagaatgttattctaccatgaaaggggtggttttcctatgtatatttttgtaaacagaattagttattatcttgcacactataaagataagttttggtaaagtcttttggcaggtggagatgtaggcaattttacatgaggagtacttgttggggagcaggttgccatcaggaagaaggactgcacattaaagcaaacgtgagctacatagtaaatacatattaatacagttgacaaacactgtattaggatcacatagaaaattttaagaaatgtactacaaaaattagttattcacactttggttactttgatctttactgtattgaacattgctagcgatatggatatcttttagagtatattttaattcaatgaaatcaacttagtagtataacaagaaatgaagatgaacataaataatacaattccttctttcttacaacatagttaacatctagttcagttttcatcatgtaaaacctacataggaaaatattgcatgtgcaatcatgcatgtacacatgcacacacacggggggattttataaaaactatttgtttacattacatagttgggatattttgcaacttacaaaatgatttcataagagatcctaggaagctaaaattagtgatatgtgtatgtttatgtgaatatatttaaggtacattttcatagtgtgatgacactgtaagtaaatggcataatagctgctacaggattgacagctctgtctagcaaatgccaatcccactttatgtttttgcatttgaaggatatggaaaatttgtcattttacaaaagtttctagccaggggtggtagcaaatgcttttaatgctttctcaacactggaaagacacagtgaggtagagccagcctagtctacataatgagttctagcccagccaaggccacagagtttctcttgtatgatacaggtatttgttgaatacaatctcacttcttgccaaggaatgatacaaaacattttcttttttattagatattttatttatttatatttctaatgttatcccttttcctagtttcccttcaaaaaatccctatcccttccccctccccctgctcctcaacccacccactcccattcctggccctggcattcccctaccctggggcatagagccttcacagcaccaagggcctctcctcccattgatgaccgactagaccatcctctgctacatatgcagctggagccatgggtccctccatgtgtattctttggttggtggtttagttccagggagctctgggggtactggttagtccatattgttgttcctcctatgggactgcaaaccccttcagctcctttggtcctttctctagctccttcactggagactctgtgcttagtccaatggtaggcaatgagcatcaacctctgtatttgtcaggccctggcagagcctctcaggagacagctataacaggtttctgtcagcaagcacttcttggcatccacaaaagtgtctgggtttggtgactgttattgggatggattccccaggtgagtcagtccctggatggtcgtttcttcagtctctactccacactttgtctctgtaactccttccatggttgttttgtttcccccccttttaagatggatatcagtatccatactatagtcttccttcttcttgagtttcatgtggtttgtgaattgtatcttgggtattccgagcttttggactaatatccacttattaatgagtacataccatgtgtgttctttgatacaaaacattttcaagatggcactttccatacaactatatatgatccgaggtaaggtctttgattactatttcaaccattagtgtaagtcagactgaagattgggactgacccacggatgtcagtactgacatgattatttattgcttagaacttgactctgcatagtcccagttcaatgacaattcaagaccccaggaagatattatacagatgactagatttgctaaagaaattttaaaacttttttaaaggtatttaaaattcctgcttctttttggcagtgctaggtggaacttggctcatcatagagctggagtaatcaaagagtgagcaaatgataatttagatccttaggcaaacttacaagctttgaagctacagtatttctaattgcatgcctaatggctgattgacgtgattctgacaattacctcaaaatactactcttagttgttgattgtttaccagtcaccttccactcctccacataaaactctgattcacagactgacaatgatctgccagggttcaggttgtatcttgctacagtgtagattttacttgggattaaatgaaagtatttcataatttcatatttacttgaatgtatattatatggcatatattcacacacatacatatacattcttctaaagtagaaaacaccctaatacttaggactgttcttccttcttctgccatgggaaaagcagggataccggaaacattgggaagtgtggagaaacttaaaagaaagacactgctgtgaattatggccacttttgtggagttcccttctctctcagacctgctcagaaatctctggttacttcctaaaagtcagctcacaagtgattctccctaacttccctccattttaaggaaaagctctctcttccgtggctccactgagttccttcagtgaccttactatatggccctggtcccattggagtgttcagtcttaactcctcactaaattgtaagccttaaagagcatctacgattcattagatgtgcattgttgtgcacagtatttgattaagacaagtactcggtgaattgttgagaaatggatggatggttaaatggataagcgataagacaaacaaacaggaaaagtacatccattcatcaatgtccgcatacttcaacaaaagtctaaactttcttcctaatgttctatttcaggcatctgcatataggagtagatgttcactatgttgctttcaacttatatatcatctatggatatcataattttaatacggaaaaattcaatataatctacttcattaaaaatttcaggaataaaaaatcatatgatcatataagtacatgcaaataaagtatttaatgaaatcaaacaaattgtaatatacagatatattctcattcttataaaggacaatctatagctagtgttatcttgagatgaaaatttgaagactttttttctaaaatcagaaacaaggcaatgatgtctgctgtcatcacttgtagttaatgtgctagaaattctagccgaatatatagaaaaaaggcaactaattttgatgctgtttattacagtgtttgaaaatgatgctatctttatatgcagacagcatgattatctttgtaagtcataagaaagttacaaagcaattacaagaactagtaagtcagtataactagttcacagaatatgtcactattaaaaccaatcatattccatagttagcatgccacacactctgcccctaagatccttccatgccctattttcttactgtttcattgtcctcatatctgcaccttgtacgatgtaagatcttttgacatgataatccaattatttaaaatttgttacttgaagctgaaggggtctacaaccccataggtggaacaacaatatgaactaaccagtgcccccagagctcatgtctctagctacatatagcagaagatggcctagtcggctatcactgggaagaggggccccttggtcttgcaaactttatatgccccagtacagggaaacaccagagccgagaagtgggagtgggtgggtagaggagtgggggtggggggagggtatagggaactttcgggatagcatttgaaatgtaaatgaagaaaatacctaataaaaaattggaaaaaaaatgttccttgagaataattctaattcaaaaattaaataaactggttaaaactcaaaataacggatcatattccaatgtatactaacaataaacgatcataaattttcaaacactataataaaagcatcaaatttttgcaatattaaaatctcagttttggtttgcaacctcataggaagaacaacaatatcaaccaaccagacccctcaaagttcccaaggactaaaccaccaaacaaagagtatacagggggtacccatgactccagcaactgtagcagaggattgccttaactggaatcaatgggagggaagccccttggtcctgtggaggcttgatgacccaggataggggaacactaggccactgaggcaggagtaggtgggcaggtggggagcaccctcatagaggaaggggaagggaggaggggaaaaggggcttgtggaggggaaactgggaaggggtataatatttaaaatggaaataaataaaataaccaataaaaaaaatgaaaaaaaaatctcaattttcacaaacttgattttataaatgtaatgcaatcttagatttttggcaaaaaccaagaagatgattttaaaacttctgttgacaaatgatccagaatgtctaaagcataaaggaaaagttgaaggtcttatgctgactgatttcatagtatattaaaaagttatagtaatcaagacagtgtgttaacaaaaatcccaacacaaagggggaaatggacacaaaattctacccctaagaagttatttgcaattggtacatgttggaagacagaaaatcagtgttcttcaatggaacgacactgggtagatctgccatgcttcaggacaaccccatgtccaggagtagagagccaagtgaaatctcagttattttagtgctttttagtgactttttgcttctttttgaaaaaaagagggaaatatcataaagttgggtaggcggggaagagaagaggttctgggaggaattggaggacagagaagaatatgataaaactgtaccacatggaattctcaaagaaaaaagaaactgaaatacatggcataggttagaataaaatatttgcatagcacttacctggcttatatcaagacttttggataaattattaaaacctggataataaatagatatctcactattttaaaataattaaaaggattgaacagaaatttctccaaagaaatgtatgaaaagatgttcagcacattagtcactggggaaatgcaaactaagacaacattgagggctgaagaggtgacttcatttgtaacgtgcttaccatataaccatgaagacctgagttcagctcctcctcggcacctgagccaggagcatatgctagatctgttgctagagttttgaggaatcgccatactgatttccataagagatgaaccagcttgcactcccaccagcagtaaagaggtgttcctccttccccacatccccaccagccattgttatcatttgctttgttttctgtctttagccattctgactgggctaagatgaattttcaaagtagttttaatttgcctctctgcaatgactaaggatatggatcatgttaaaaaatatttctcaggtattgcatttctaattttcagaactatttccatgccacaagttttaattatgtttgttttctttatgcttgtgtgtgtttattttttagttcttcccatattctagacagtaaccctctgccagatgtatacctggtaatgatattttcccattctgtgggctctctattcattcaaatggtgatatactttgctatacataagcttttcagtttcatgaggtcccatttttcaattgttagtagcctgtgctaccagtatcttcttcaaaaagttctttcctgggtctataagttgaaacatattccctactttaacctctaacagattcaggatatcaggtcttttgttaaggtctttgatccatttgtagttaagctttgtgcaggtgagagataaaaatctagtttcattcttctccatggagctatccaattccaccagcagtgcagagttaagattctttccttttcagtgtgtattttggccactttgccaaaaatcaggtgtctataaaggaacatagacttatattggggtgctcagttttgttcccttgatcagtgtgtttgttttactatcagtaccatgctggtttgatggctgtatactataacatgaaatcaggggtggtgccatctccagcaatgcttttattgttaacagttgtattaggtatcttggtctttgctgtttccatatgaattttgagagtgcttttttaattatgtgaaaattgcactggaattttgatgggtactacattgaatatgaagattgcttttgttacagtggacattttcatgatattaatactaacaatccatgaacacgggattgttatatttttcaatcttatgttatatttttcaaatctttaagtgtcttaaagtttttattgtttatatttattcccagatatttttgaagctattgtgaatggaaatgttaccccgatttctttcttagtatgttcattattggtatataggacgccggctatttcagctgtaccactcctgagcatattccgaaaggactctatcctactacagagatacttaatcttaactccatgttcattgctactccattcacaacagccaggaaatgaaaatagcatagttgtccatcaactgaaaaatggacaatgaaaatatgatacatatacatattggttggaatttttgtcaacagataccaggatcatttggggagactgaacttcaattaagaaaagtgcctacatcagactgatttgtgggcatggctgtggagtattttcttgattaatgattgatgtgagtggaggacctgacacattgtgggcaatgacagctctggatgggctgtcacatggagggacccatgactccagccccatatgtagcagaggatggtctagttggtcatcaatgggaggagaggcccttggtcctatgaaggctggatgcaccagtgtaggggaatgccagggcagggaagcaggagtgagtaggttagtgagcagggggagtggggaggggatagggggttttcagaggggaaaccaggaaaggggataacatttgaaatgtaaataaagaaaatctctaattaaaaaaaaaaagagaaagaaagcaggctgagcaaaccatgaggaacaagccagtaaacagacttcctccatggttcatggtctctgcttcagtttattcctccaggttcctgctttgagatcctgccctgactttccttcatgatagactgtatgttttaaagtaaaatagaccctttccttccaaaattgcttttggccatgatgtttatcacggcaataaaaagtaaactaagaattgttcagctataaagaaaatgaggttatgaaatgtgcaggtaaatggatggagctgaaaaataatcattctaaatgagataggtaaaccagacaaaccatataacatgtcctatcttatatgtggatgctaactttaagatgtacatccaaattgaagtacccatagaagtcggaaaactaggaaggagtcaagatttcaacagaagagggctagagcacaggtggtatgaaagtctaaattggagttctccattgactcccttttttgccttgtcttattctatcctgttttgtcctgtttggcctgtttgaggcctactcttttctgaagggagatggaggcaaagtggatctcgggaacaggggaggtagagaggatcttggaggagtggagggagtggaaactatggttgagatgtgttatatgagagaagaacctgttttcaataacaaaagaagttttgctggaaaaaaagaaagagaaataatagaacaggaaagattaaatggtgagggagataggagattggggtaaaagagggagtatgagaagggattgctaacactaaaggcttttgaaaataccatgtagaagtctactactctagaagcttcctgaactatatatgcatacatatacaaaaagagttagggtggagttaccctataacatgtgaacaacctctctctcagataccatagtatcctccttttgtgatgttgtcttgtctgacaccattaactgggtgaaaaagcatggctggctaggtcataggtcctaaggaagaagctaatgctattactctgctaaatggacttagtattacactgccccctgaattctcatctttatgcccagagagattagtgctctttcagcctttatcggagaagcttcttttcagccgatggcagttaataaagagaataacaactgatcactttacagagactaggggattttaggatgctcaattctaattggacatctgtcctacactgctacaccaaagctcaaaaaatatttgggaagaagggaatagagttataaggagaatcagaagtttagagtgcctgtagcaaaacactattgttgaacatgacaccaccattgcacacagaattaatagggaatggataggactatatgcctccgaactctacaggctcaagcaacccaaaattccatcatgaatgggagagggggtcatgaagtcccacccctacctgaggaggtattgacaagtgacatctgctaggagagggagagagttttctttagggatatgtcccctgagaagctacccatgccccagtagacagtcctatgcccatgcatatgcaggcaacattaaagagactctaagatggaaatgaagttgggagggaaatgtggtttagggagtgaatggggatgaatttgatcaaaacacattatatgcatgtataaaattctcgtgtgtatccatgcacaatgccttgtaatttcagctcttgagagcatcgagacaggaacctagagtgcttgctagacagtcaatctaattagaactgtgaattctgcttcgcatctgcgagataacctgtctgaactatacaaggtggagagcccccatttcccctctccaattcctcccatctctatattatatcaatcgaaaggaatacacacacacacacacacacacatgcaaaacaaatatttaaacagcatggagaaacttttctgggtgttagacattgtcattattttcattgcgatgatatttttacacatatgccaaaatttaccaagttttacactaaagaatttccaggttttataagtataaaagaacataaaataacctctgtggatgaaaataaagcaggtcataactgtatccacaatttgtgttaagtttcaatagtttaagagagagggcataggctttaaggcagatgagagagggggtatgtagagatggctccttgtcaacactctttcaggtgaaatttctcaggctggtttgaatttggattgctattttaaggttcttggttaatttggaaatagccatatgattatttttatatcttataaagtagtgaatgcatgtggtttcagaaagtatgaactatgtacacataagcttataatatatggaattaactgggatccagctcaaggggagaccccaaggtctgacactattactgatgctatgatgtgctcacaaaaaagggatctatcatgactgccctccaaaaggcccaagaagctgctgaaagagtcagatgcagacacttacacccaaccaatggactgaagtcagagacccctgtggttgaattagggaaaagctggaagaagctgaggaggagggtgaccccataggcagaccagcagtctcaaccaacctggacccctgagatctcttactgaaccaccaaccagacagcatacaccagctgatatgaggccccccaacacatatacatcagaggactaccgggtctggacttgatcagagaagatgcacctaaccctcaagagacttgagaccccagagagtggggaggtctagtggagtggagggagcatcctcttggagaggggggcggaggaggaggtataggtagtggactgggaggggaataaagtctgaactgtaaaaaaaaaaagcttaaagaataaaaatattcaaaaacacacacaaaaaaccccaaaggaatagttggaaatttttaaaataatttttcattaaaatttttctctccaccaatttttaaaatagaaattatacttgtgtgattttttttcagttctctgattctgtttttcattgtattgtctatgataccataagtttctctactttcttcatgatgaatgtagttaggagcctctgctcctgcttcttgtggatgctaccctagttgtcattaattgtcaagttgacatagccccgtgtcatctaagaaaagaggcttgagaggcatttcctaggtcaaattaacctgtggatgtgtctgtgggacttgtcctaacaattaattgatacaggagggcccagcattctttgggtgtctcttcctaggcaggtggtacaaagctagcaaagcatgggcctgagaggtagccagcaagcagcgacctcccatgggtcttctctaatttcttacctgcagtttcctagtcagaagtaatgtcatgtggaatgacagttctgccatcatgttccttccttgtattcctgccctgacattgctcagtggtagattgtgagctgcaagagtaagatggggcaaattctttcccctccaagttgcttttgatcaagatgttctgtcacagcaacagacaacgaatggtaacaggcaccttccgttttcagagccttggttgcttcaatttggattttgtgctccgcaggcctgccgtgcagccctcaaccttggccttactttcattagtctctggttttaggtccactgttttctgaagctaatatatgtgtcaatctttgtttactcttacattttgctagaatatatccctgagtaactttgtaggaatagggtgtaaaatgtgaagtttgggaatttgtaaaaataaaaacatcattcttttgctgtcagactcaattttgagttaagagacagattacattttcaaaataatttcccttcagatagttgaaggtgtttctctattgctttctcttaaaaataggttttctggtaagaggatcaatttattcaaaatcttgtccatttaactgttgatgtttttcctttgtgaaagctcttagggacttgtttttttcctttctgaaagctcttagggacttgattttctgaactgttaaaatgtgtctacttgttgaggaaagtgcctaccatactctgtatgaagcctgcaaggcaataaaccacacccatctctatagttgttaggcttgggaacttataaaggactctggaactgtactcttcatactgtgtgcctcaattctttcacattttatttaatctctttagaaaaagctttctgatttgtagggggaacacttggaacgaaattcctgattactacagattctatacatggggaaagaggtgactgttctgtatgtagatgctcagtgaattcctcacatcctcacaatcacacccttttttatggttctgtaactccaggtctacatgctccatgatacactgtgttcccaggacctcaccctcttttcatttgtcctttccaaattttaaactactccattgtctctttgggcaggcccatatctccacaagctctaaactcccccttctattttctctttattagtccatctttattatccagaactctacctactttctgtgtttcagagacctattgaaatctcttttctgctgatatcctgtattgcttcgttatctgtttaatatcattttaatttgagtcttgggagccaatggtgctaacatggcttggttagtcagcttccttgtctatatgtgtatatccctgttaaatgttagcttttattagttttcttatgattcttttgaaaatatttgcaattaggggcaattaggtatgagctggacaaatctacaccgtttacccatcagtagaaactagagaattcattagggtaaaagccctgtgagagattagtagacagtggtggaatctgattctccattgctttgtgggaagatggctttctcctgaaaactaacaggcaaacataggatatacataaaattaactctactgaaactgttgttatacttcattttatcctaatttttatcctaatttcttttcaggggctagctctgctgtgatactatggggaaaaaaagttaggagacaatagtcagcaagaggctttcattgtgcagtggtgtggccacaaatgaaaggcaggaattttcctctgatcaaacagagttttccatagacacagtctagaagtagattctaatcagcagccatgttgaattttgtttcttcttgtctgttatacagctactataacaattttggcctgccattatatcccataaccagttatttggtatttaccaccaggaggcctggcccctcttggacagaggaggaacaagaatgccaagctgactgagaactgaactgtaacttcggatttgtctaatctcacagtgaaatggtctttctttatacccttgcaactttcttgccaatccctttataccacttgtggatctcattttacagtatttaaaatggtgaatttgaggcccaggtcttctactacttttttctaatcttttggcttgtttcagactattattgtgggctgaatctctcctaatcatatcactagtgattaacccgcctgtccttaagatatttatatcttagactccatcttaccttccctaacctttctctttgaagttatcaactgatatctgagatttctctctccctccttttcttcccccccacaccctctttcctgccctgtcttctctcttcatcttcccttccctccctctctcctccttttgtttcaccctctctttttcactctccctctccaccatcatgatcctcttaccctagcctttcaagtacttggattgaaggtctgcaccaccatggctcttgagatttgttttctattttctcattttggaaagccagtttgggattaaaactagttacaattgattttagcatcaacttaaacagaatgtgatttatgtctccctaaaatcctctccgcttaattttcctaagatatctgaaacatttgtttctgtctcagcatcagtagtgacctgtgtcttactttgattttacctagtcctcactgataagttcttatggttatcactttatagtcacaggctacctcactttacccttcttccatacttgatttttaatatcatggccaaatatattttaatttacatagtttacagggcttggggctctataaagaacaaaacagattttgtagaatgctgctgacagagaaattttgaacaagcagaaaagttctagtttaaaatagattatacaaacaatctcattttgttcaccttcgtgctctgacctgttagtccagctttaggaagataaactataacaaaattacacaatgttcagtctttaattcacaatcaagaggatgcacttgaacttactttcttaacccagagtgcaactggtttataatatggtcctactccaagtactacaaatggaggtgcttctttcctttaatatgccaatgtgctttgatctttagaagtatgaggaattacaaattaaattagcaaacaattcctaagggaagtaagtgatagccactatatatcattgtccttcttaattaagtatgttacttctaaatcttgaactgaaagtcctctctatatgacatacatagatacaaactactttttgatttatgcttgcagatgctatttgtacagtctgccactgcctgtatgtctctgttcaacttgtggtcagctaaaagcctttctccaaaaaagtttccaaattccatattagattgctagctggtctcttttgctattttacccagcaacccacagctatgctgtgttatttgaagctatgctttagtgcatcctttacaatgcgtcttatgttctgcctgtttgtggttatgctataaagctcgccataccaaagatgcttgagtatccttctgtcattgtgtctccacatatgtcaccaatgaacatagctttaatgctgatagaccagctgaactttcaaaatcccagtagtggtggtcctctcttgccatttcacattaagcatgattctgactctaacaatagaatagatcaatgagataaatgtgacatctgtgctggttatggatttcaaagtcatataaaagctgggcatgtttgtattgtccattgatacaaatcagttcaagaagcttgtctttttccacctctgttttgaacataggatatggaaaggtgaaagcactgcattcctccctctttcattagtagtcatgcttttataatagccctcctttcccccttgatatgcatcataagcagatttcacacttgtcctacggacaagtctaaacatattctgaaccctctttgaggtgcctataaagagaataaaatttatattaaaatatataaagcattatttaataaaggttaggtaacttgttcaagccaaaactgagtaagaaaaaaactaaacattgagctggtttattatgcaatttaacactgataccacactaagataatctccctaagcagaggtactgtactttctaattttttttttatttttcagtaacttgcattgtttgacattgatgttttttagtcaggctgcctaggaagcagtatccagagactgcatttagctctatgtgtgatgaaagtgttcattctgtttagctttactacataatttcacatgccttccagtggatctattgaatggatgaaaaaaacctagcatccccatcagagatactcaaggagccaatttcacttcgtgtataggcacactgctaccactgccaccccaactcagctggtggtatctcctatgggatgacgctttgatcaatgttgaatgcccttgtttgcttactcccagaaagtagcacacagcactgcactctgttcagcagtcagcaaatactgtgcctttcttcttaccattgagttggaaacatttttatctccaattaagtactatcattccacttcaaataaattgtgtggtttgccctttttctacatatgtttagaatattgtctaattcagaacctttcatgtgctatgtacaaaatgtttgttcaaaagacagcactcgggtccgagacccgccgaacttaggaaattagtctgaacaggcgagagggtgcgccagagaacctgacagcttcaggaacaggcagaagcacagaggcgctgaggcagcaccctgtgtgggccggggacagccggccaccttccggaccagaggacaggtgcccacacggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccagccaccgtccagaccggaggacaggtgcccgcccggctggggaggcggcctaagccacagcagcagcggtcgccatcttggtccgggacccgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtccaggacccgccgaacttaggaaattagtctgaacaggtgagagggtgcgccagagaacctgacagcttctggaacaggcagaagcacagaggcgccgaggcagcaccctgtgtgggccggggacagcggccaccttccggaccggaggacaggtgcccacccggctggggaggcggcctaagccacagcagcagcggtcgccatcttggtcccgagactccaaggaacctaggaatttagtctgcttaggtgagagtttgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagacggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgaaaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaactttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctgcatataaaattaactcaaacaagtcaatggcctttctctacacaaagaataaacaggctgagaaagaaattagggaaacaacacccttctcaatagccacaaataatataaaatatctcggcgtgactctaacaaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccatcaaaattccaactcaattcttcaacgaattggaaggagcaatttgcaaatttgtttggaataacaaaaaacctaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggatctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatgaaaaaaaaaaaaaaaaaaaaaacaaaagacagcactctgaatgaccctctccagacctgtttataatcaaagcgtattaagtgtccttaataagattaaaaatgtgttcagtaccaccttttgattcattttctatctaagatgtgttaaccaagttcagtgcttcactaattactacaggaatacccctatcttgctatgatggaagcacttgaagattttgttaagcatttaaaatacagcttagtagtagaatgcttgcctagcatgttcaaagtcctgctcaatccctagcacggcaaggggaaacaactcacatttcagagaataaattatcttatttttaaagctgtagagtgtgtgtgtgtgtgtgtgtgtgtgtgtgtgtgtgtgtgtgtgtatgtgtgcacgcgcgcacactcacgcacatgcacacacgcacacacacacctgttgagtttcaaagagggcaaatgatcccctggaatggggtaataggcatttgtgagctcccagaaattggtgcaggtaactaaactcagtcttctgaaagaaaagcaagcgcttagccactaagtcttctcctcaggccctcagaacgtatgacattttaatgtttcagaagtctcagctgattattgatagatgataatgatgatgagatgacattggctataataggaaagatagattaaataaattaactccagaatattgaaagagaaaactttttaaagtaaatgatgtactaattttagaaagtctgatatgcacatgtctcctgttgagatggagtattgactttttataacctgattaagattgacagaagaaaaggtaaaaaaaaaaaaaaaaaaaccactagctgtccaggaacccttttttactaaggaaaagaaagacaacttaaccttttcagtctaggttataaactagtttcagaacacacaatacagaagtctcttgaaatgtatctcagtgattatgtgtgttgcgatcccctaaagagcaaatttgggtcaggttcttggatttcacttcaggtctacacaatctaaacttagtggaggatggggatggaggcctgggattctatacttttaatattcatatgtagtgattctgatcaagaatgtataacactcacctacaaagtctctcagttttagcatcctatcaatttcattcattattaatcatataagatttagcctgtcccttcctggttggtctccaaaacaggcccaattagaatgaaatcatactgtggcttcaagaagtgtgtaataatacagtttgaatgtggagtccctaaaatttcaggtattgctcgtaagatgacatcatcatatggcaggactctaagatttaattaggccatgagagtaccttccttataaatgcgattaagtccatataaaagggtcttggtaaaacagtctgttctccttcccttcttctttctaccttccagcacacagtattccttctggaggatgcactaataaggcaccatcttggaaatgagtgcaatgctcaccagtcatcttaacattaattttgccttttcagcttccagaactatgagaaaatgaagttctgtgctttataaattactcaggtttaagtgctttgtgttagcagaaaaaaaaaaacttgactaaaatcgtttagattattctcttaacacggagatatttcttaggggcctactgtgtgctaggaccaggtctaggcactagttataaaaaaattggatgagctgtgctccttccctcaaaaggcttctgagtcatttcctgtgaatcagctagtacaatccagtatctttgcaatgaaatagaaaatgaattaaattcaattcagtctatgtcgagtgaaaagtatccaataaatttatagggtttgctattagaaaaaaaagtttgtagtagtaatccttggagagtcactacaataatgtatgtagcctttgtgtctcactgttagcaaattgtttctagctgtgatccctgtaatctgcaggtgctgtttaccatgtaattttaccataagaaacaagaatgtaatcacataataaagtgtaaagaattagattttcttccccttgagcaaaatgcctgactgtggccaacattcctggtgctctctccttgtgcaataggaaagcaatatgctgaaagagaagactattttgttcatattctacaacgtgcctctggagaccatactaatgaatgcagaactaaagctagaattcaggattcttgtgtgagaagctactgatgggttttttttgtctttatcattattctatatagaatatagtttccctcctgcctttaattgaggctcaaatagggcactgtgaatagggaaacattttgattaaaacgtgttttgtgttgttttctttcgttgtttgagaaaatatgacatattcaaagaattttcatgttcaagcaatccctttctaatgaatacttgacttatgaatatcctatactatcaacagcttctctttgagggactttgagatactcctacacctgtggaaattggaattgtttctgttgattgcataaatttgtctctcccccagcactcctgttttggaaggttgaattcttgtaagctgtcatcagacactttggaacaagtgtgaacaactttaatatgtgaatgacttctctttctgccaccaccaggatataagaacgcacaaaattccataccagacctcacatagaagttgtgcttaagaggaaacccaaagcacatgaagccatgtctgggagtgtagttggcaatggtaaagaggtgctccacttacatttggagtcctttatcccagaaataccattgtactttaataacatacccttctagaatttgggtatagacagactcatattgcagccacaattgaagcagtaagcaaatggtctctaatacagtcaatgtgcatcttatgaaagcactattcaaaactacactgcttcttgtttattgtttttacatgagcttaatcggtttttaattagatgatatgcctgtagccacaaatttgaaggatctagagaatacattctaggtgggtgacttgaaatctagtagttgacaacaaggtgacagtagaaaagaaagttaagaactcaaaaaacagtcataatgaatgtttcatatctatcatgaatgaataaaataaaaattactgacattaccaagtattagtgaagatggaaaacaccaagactcacatacattgatggtgggcacatacagtgctgcaatcactctagaaagcagtttagtacctatcacataaccctgagggccaactcttagatgtctttccaggaaaaatgaagatgtatctgcacaaaacttacacataaatgttcacaactagaagtaaccgagatgtacatcagtaagaggatgcacttaaagagtgataaccctatgctgcaaactcggggatattttaatatcttggaaagaggggttgaaagaacatgtgagttctggaaaacacttttctggagaagacatggatataacactcatgaactcatagcatctgcagttacctacataggatctatatgacacaggacccattaacattccagcatggatgagggagggccatagataaccttaggagctattggtagttcatggctactggatgagaaggagtcttttttgttcagggtttagccactggtaagaaggccaaactccattagtaacaccacacccatgtacatgcaggcaaccccaatgaaactcaaaagagttaaaaagagaaataagaaaaagaaatacataacactaggaataggacatgtggggaaaagctttagaaagaataggaaggcaataagagaaagaaatggggtaaatagaatggaaatacattatatacatgtatgaagttgtcaaagaaaaacttttaaaaattcaaaggacagagtcttatgataaaatactactaattactaaaaactaatggaatgcttatacatataacaggaattaatgtcataggcatactgaatgaaaaattatgcatatgcatatgtgaaagtttattctaggatgggagaaaccaaactgtgacaatagaaatcagaactgaagtcaacttggggcagaagatactagagaatgactaaaaggggcaaaaaggaaacttgtctagtcatggaaatgatctatattttgagttgagtagagattataaggattgtacatttgtcaaatctcttgctttaaaataacattttttattataggtaaaatatatctccattttcacatggcaagaattttaaggaagaaaaaaaacccttcacctgaccccctcctgttgatttggcataaattccttaacctgatccaatcccataacgcccccctgttcatctctcaccattcctctctacctcctattctaagttacaagtagttttacaaactgtgtttgtttttcttcttggaatttcaatacaatgttcctttcatctggaattccttttccatttgtaattaatcattaaatcctttccatcattcagggcctatgatgttacatcttctctaagaagcctcatttattagcaatctgtagtaggtgcttccctcttgctcaccaggtgatctcaagctcctttttaacaaagcatgtatttatttgtaatgtgattataataacaaaagcccctcaagattgtagtagactggggtcatttagtttacaagcaaataagccttcacttattctgcaaagccttgaaataaaagtaaattctatccaaaatagctcaggttctagtactcaaagttatagaaataatggataaatagttaggtagatagatggagagatagataaaaaagtactcagtgttaaaaataataaataaataggtagatagaataaagtactgttataaaaattaaataaataaatgtgtagatagatggatggatggatagatagatagatagatagatagatagatagatagatagatagatagatagataacagcttgttctatcccaagattattggcagtctttctgattcaggagtttgctttgagtctttattttgtttatttatttgattgtttgtttgttttccagacccagttttattaagaagcacctgacactgggtttatgatcttctgtctcagcctgcagagtgctgggattatgaatatgggccaccacacctggcaagatcaagatcttactttaaatgccagtttgatttcatattattagtgttgtattagctcatttatatggtggtttaagtaacatttctgtgggcttaaccagatttttttttgattctatggaaaaaatacattctctattacagtcaagtgaccccaaaatactaaccagttgaaccatgcgagtatgcatgtgtggatgtgtgcacgtggaagctccccagtgctgggatacgtataaatatacatatttagaaggcaacttgactgcatgttcatttagcaaaacatcaaaatagtaagcttccatctagggcctatgatttccccaatatggacttttgagcacgtttgcagtatcaagcatgcatttcctcctacgaggtaggcctcaaatccaatcagaaaacaacatgttgccctcagctaatgcaccagtgggcaaatcttgtctgaatagtcagttttgctacatgcagggttcttagctggataagaccattgatgacttttctccctaaatagcctgtatagcatctttcaatactacgaaagctactaccaagcagtatgcttctagctaagttccaacttcatttctctgtgtcctctaacctaggtgtgttctgtcttcaacaacagggtcataccatctacttctgataggtaattaagagcaattggcaatagcctgtattgttttaggggagtctgtgggttccctggagaatagccacttcatgtggataaatgtaaatgttttgaaatgtaacatgattaataatatgcaggttacatatattcatttattcattgatacttaataaaagaatctattctcctagatgactgtgcttaagtctactggatatagttgtttgatataaacaatgaatcataggaacttaaagaaagtttatatagactgttagggtttccatggggccagcccattttttttaactaataaatgcaccatacatgcagattcaggaattactatttttccagctggcaatagaatgaaaatgcattcattttaattttcaaaatcattaaggtatttaaacatagtaatatctaacttttattgagtatatattatatgagataggtcctgtgatggtccaataactgctttaggagtaaaatgctattttcaaatgaggaaatggaagcttaagaaatttgtccattctaaggaagaatgaagtatccacccttttgtctttgttcttgattttcttgtgttttgcaaattgtatcttgggtattctaggtttctgggctaatatccacttatcagtgactgcatatcaagtgacttcttttgtgattgggttaccgcaccgcactaaggatgatatcctccagatatatccatttgcccaagaatttcataaattcattctttttcatagctgagtagtactccattgtgtaaatgtaccacattttctgtatccattcctctgttgagggacatctggattctttccaacttctggctattataaataaggctgctatgaacatagtggagcatgtgtccttataaccagtaggagctaagacgaaaggatggaccatccagagactacccaacccggggattcatcccataatcagccaccaaacccagaccctattgcatatgccagcaagattttgctgaacggaccctgatatagctgtctcttgtgaggctatgccagtgcctggcaaatacagaagtggatgctcacagtcagctattggatggaacacagagcccccaatggagaagctagagaaagtacccaaggagctgaagggatctgcaaacctataggtggaacaacaatataaactaaccagtacccccagagctcatgtctctagctgcatatgtatcaaaagatggcctagtcagccatcactgggaagagaggccccttggtcttgcaaactttatatgccccagtacaggggaatgccagggccaagaagtgggagtgggtgggtaggggagctgggtggggggagggtatagggaattttcgggatagcatttgaaatgtaaataaagaaaatataaaaaaaaagaaataaaaagaaatttgtccaaggttacacagcagtagggtacaaatctaaacctctgtgcactgtttaccttatgcgcatcttctcacctcaagtatatacttaatgaagctatggttatcattagtgaaaccagacccattcacatagcaaacatataagcaatgattagaagatagcagagggccaaatatcaaaatgagtactttttatacaagatttattttattcagatacattatcttataaaaacattagtagttgaatgagaataggtttatgttttccttaaaaactgccaaacagaatgggaaaaataatcaacttttgtttttcgctaaaatgagtcttctagactacatgttctggagtttgggaaaaggcagagagttgttgtatcctttaccatatcttaactcccataagacaactgacatactggtaccctagtattatgctctctgctctagaaacaagttaaaagcagagcataaataacatgacaaaatcagatgtatgtgataatcaaatccaaggggtaatagaaaatccaaggctaattctggatagctatcagtaatgtggaagaaaaattagaaatttattgcaaatcccagaagtttgtggacaaatgtaacctacgggacttctgatagtgctattcagagcaaaatagagaggcttcagatattaaccaaaacttcatacctacatgataagaacagcggtgattaaagtcatttgaaaagtagaaggaaagggaggcttagactttagatatatgaaatgtaatggaaagatggaatatgtattgaaagctagttggttggtttttttatgtaggatatagctaacaaaggccaacctttgatacatctacttgttaattttacagatggccctcctgaatttcttctttcctgatgaaaaggcatattctgaagaggaaagtaggcgtgttcgccgcaataagagaagcaaaagtggtgaaggagcagatggtaagtctactcaagtgatcttttttccatgatatactaataaaaatattcttcattctcatgtattatccaaagatcatggatttctccagcctaacctgataatcaatcttttaacatagaactaacaatagaaggatccttcatcctctaattccagataccttcagtctttttcagtatgtttggaggccatgctagcatttatgtccctcaaggttactctcaacaaggacctcctctctcctggggacataccatatcagctatgtccaccaagataatttgatcctatttttgtaactgatagtgttttcccatgctggcaatttatagtatgtattgtttccaatgataattataacagttttggtatctgttactatgtccaaatctaaaccaaagcatgtaacattactctggaagttccttgaggacaaagatcccttccccttacataaccctataatatggcctagtatttgtctcaccggtagtatcgtaatgtaacttgacagtgtttactgtccctttggctaggcagtgattcaccaaggaaaaccattcccattatgggtgtaatagctttgagttaactagtagtacattcaggggatgacaaaatgttgtgggagctcctgggcagggactttgaatcgctgtatttcagtgttactctgtcagttgacagaatgctacccctttggcacagaggtttataggatacatagctctgggctgttgaaaagccatctggattcaaagacaatgtgtctggctacatctgctgatgatatgtgtctgtaggggcttacaaagcaatatgattttataaagatgaaaatgagatttttaagctgacatttgtcagtgtgagtaagggccaatgatggaagcagttccagaaagtggaaacaattgaagaaatggaactagtactgccttagagttaaggataaagggtgccaggggattgtgaaatcgtctaagatacttaacctttcacctgggaggctatagaagcatttctttagatgtgatgagtgtctcaatgagttaaaaggtagcaaagcaatccaactttccttttggaaagctattcatgttattttgctggctatggacagtgtttgtcaaatgcattctaaaaatatttactgagtaaacagatccaatttatatcacagtaggatagaaaaactagaagaagatctgtatttgtttagttaatgtttatattcttaccatgtagacaaggacatggtacatgacagacttcagtgaatatttctggttccccatggggacttcatttctagtgcagagataaacagaaaacaaaggttgtggtggtaagggctgtaaagaaagatacagcaaagaaacagtgaaaggggtaatggagtatactgaacagtgatggggtgggggtctttgtgaaaagggggtggctgaggacagccctgagtgaaatgaagggaaagcaaacggaagaaagcaaccaaaagttttttttttttaaaaaaccctctgaaacagagaatgcatgatatgtttcaggaaaatcagtgtgactgggatcataggaagagaaagaaaggagatgagggcagacagtaaaactcattctacagccttgtaagccaaaggaaaggtcctagtgtcttattctgcatggactggggaactatattagatgagtttgagtagatgaatgacagtatttgacttacattttaacagactccttctgacttctctaatgaaaaaacagggagactcaaagggggtaatatccaggcaagagatgataatagcttagaatagggtggaagcagtatagttagtaggaagtgctatgactctagaaagattttgaaggaatggctgataagacttagggatctataaaaggatatgaagatgacagacaagagccaagagtgacctcgagagtttgggatataaagaactaaatggcttgaattgctatttctgagatggagaaggaaagggagacgtgtagagatgtgtgaggaaagagttatgaatttagaaatcagatttgtgaaaggaggatatagatagaagagggggtatcagtgatgaatagagttcaagtttatgacatatttgaatttgtctttctgaagctaatgactatgtacaatgactatatattagtattttaattaaaaataccaaaacataaaagaatttaactagacctgttaaatttgagatgcccatttagatagccaaagagatataattcaacatcactatctcaagataatgagcgagttctgttttatacaaataatgaagttcctaataaagagtaagcctattagtaattaattttaagtctatcgttatttgatattataatgcaagtttagattatctatctcaagtttgcctcacaagtgtcaaagaaaaagcgatttggtgttcgaacctgcctcctggcagaagttgtgatccactcacagaggacatggtactaccagaagatcctgcaatacctctcctgggcatatatccagaagatgttccaactagtaagaaagaaacatgctccactattttcatagcagccttatttataataaccagaagctggaaagaacccagatgcccctcaacagaggaacagatacaaaaaaaagtggtacatttacacaatggaatactactcagctattaaaaagactgaatttatgaaattcctcggcaaatagttggacctggagggcattatgctgagtgaggtaacccaatcacaaaagaactcaaatgatatgtactcactgataagtggatattagcccagaaacttagaatacccaagatataagttacaatttgcaaaacacatgaaactcaagaagaacgaagaccaaagtgtggacactttgccccttcttagaattgggaaaaaaacacccatggaaggagttacagagacaaagtttggagctgagacaaaaggatggaccatctagagactgccatatccagggatccatcccataatcagcctccaaatgctgacaccattgcatacactagcacgattttgctgaaaggtccctgatatagctatctcttgtgagactacgctggggcctagcaaacacataagtggatgctcacagtcagctgttggatggatcacagggcccccaatggaggagctagagaaagtatccaaggagctaaagggatctgcaaccctataggtggaacaacattatgaactaaccagtaccccagagctcttgactccagctgcatatttatcaaaagatggcctagtcggccatcactggaaagagaggccccattggacttgcaaactttatatgccccagtacaggggaacgccagggccaaaaagtgggagtggatgggtaggggagtgggggggagggtatgggggacttttgggatagtattggaaatgtaaatgaggaaaatacctaattaaaaatttaaaaaagaaaaaagaaaagaaaagactgctaaaaaaaagaaaagaaaaagtgatttgccttaaatagttaaaaatttatttttaaaaaacaaaacatttttcaaagatcaaaaacaggactaagggccagcatgatggctcaacaagtaaaggtcttactgcaagactgacaacctgagttcaactcctcaaatccacatggcagaaggcaagcacctgctcttgcaagctgttctctgacctctacttgcatcatagcaggcacatgcatacagcacacacacacagacatgaacacaggaatgcatgcatagatgtacagacactaaaaaaacagaaactcatttaaaacatagcagaaaaacagttctaaatttctattagttttgtaatctattgatatcctcagattggatttcaattcccaaactattttactgtttgttatttagtgagccttctacatacaattgaaaggagtaaaccatgaaccaggcctcagagaagtttacagagaagctctggtaaaggggctggtagatttataggcaagaggtgagggtgaagcacatatatagtaatgtggtagattcctagagtatcatataatatgttgataacatttctcctcaaaagagagaatctcagctaggaaaatatttccataaccttgacctgtatgcaagtctctggggtactattgctgatgtgggagggcccagttcactgtgggcagtgccatgcctgggctggtgttcctgattgttgagcaagccattctttcatggcctctgctccagttcctaccttcaggttcctgtactgaattcctgacctgacttcactcagttaatggactgtgacctgaagtaaaccctttcttacccaagttgtttttagtcatttatgttttattacagcaatagaaaccataactaagggactgactttcctgttccattggtcttttatactagatgattagaattataacataagcaatccctgttttatcttcaaaacaaaagcagggccatcaagatagctgaaagggtaaaggcacttgtcaacaagtctgatgacctgagttcaatgttctgaggcaacatttggtagaagagaactgactcctgatatttgttggctgcccttcacacatggtacacatgtatacacacatgcacacatgcatacccatgcacatacacacacacacacacaaataaattctgggcttggagagctggctcaacaattaagagcatttgctgctcttacatgagtacctagattcaattccaagtacccacaatgagcaactcacaaccatgtataattcatatttcagacaatctgataccttcttctggcctctgagggcatttccatccatgcagtccattacatatacacaggtacacatagatatacataaaattaaataattagcataataaatgttagctttttctttaaaaagatagtagctatctccaagatgtatcagttttttctaacctgcaatttaagaatgactacattctccactttctcagttctgagtgctctgtaagtgggggattgactcgtaaatagtagttacaaacacaacgttactttccccaatataaatcttataatgttattgttataacaactcttaaaatgaatttctttttgtttttatattttacatgtatagatgcttttcctgcatgtctgtctgtgtaccatttgtgtacagtacacatggaaaccagaagtggagtcaggtcccctgaaattggcattacacatggttattatatgccatgtaggtgctaggaattaaacccacatcatcatgagtagcaagtgctgagccagcttccaagaccatagattaatttttttctgttctacatagctatatatctgcattaaatttatgtgttttgatggccagaaattttttagtagtttctgaattcatttctgctaattaacgaggcttttgggttactatcattgtttcatttcatagtgtttgctgaggcacaatacataagcaatctgtgtcaaaatttcctgataaagtttgtactctgaagtcataattgctccaggggccatctcttataggctacaacatggactgtggaatggattcaggagctcatgagggaaaaagtgcagtgtggtataaaagaaaaggtacttgagcaagttacagtctaaggattacaaatcctaatatccccatatattagctgtcatgtgatcttggagaagtcacatccctctgagctttccttttcttgttggtataatagagacggtgagcctggcttaagacatgaagttactgtattgatccaaagtgccagtagatttttaaaaaggaaaaaaattgtaaattactaaatgttattactcagttctctcaaacattgtcattatcttatagacaaacattataactcagcagtgatgttatatttcagcaaaattctttcttctcattggtactgttcagtagggtagcacatagcagccatagggagaaaactctagacctcatattctgacctacttcatcacaacaaagattgatcacaactgcatattttgtccatgacagttccttgctctatctgcttggctttgtctatctacctatttgtttatcatacccatatatgataaagacatagagatagaaatatgtgtgtatgtgtgtgtatcttgggatttttcttctttgataattacttttgaacagataaaagaagttagtatccttttctactattataaatgtgtaaaaatgatgataaattaagattaaaatgtatcttttgtttttaatttcttaaaaataagaatgatttaggatatagccaccattccgttgatacaactgatcataaaaggctatggcatcaaagaaaacagatgttttgtttgtaaatggttagctagaattaaaatcgcctttatgctggtattgctactatatttattgcttttcagtgccccatcactgagctagtgtcaaatgagaaagactagaatcatttcaataactgataggatttcagaggcttattcacaagatgaaatttaagcttttgaaagcttaccatgtgtgcacttgaagaagattcttgatttcagttgtagaatccccaaggttgcctgctgtttgtggctgccaacagcttaagggcccgcagtataacactctagaaagtggctttatatcaaataaaacattaaacaagccaaaatatcttagcttgttcatactccaacatagcctttaaagctatattttctttgatagaactagccccacagtaaatgatctcaataggccatcaacattgacacttggttaacaagcatttttcgaataacaactattttagactatccagtaagacatatttctaggctctgtagttggtatagctacaaaactcctattcttattatatataaactaaattgaattgaatataagaggttaaagtttgtctcataagacaaatatatatatatatttgttttctgtttgtttatagttcttaacttttatattgatgcatgaaatcacgtacatacatgggaaagtaaaaataaatgttgaagaatgtaaagagggctaacagtagcggagagaaggaagagaaagaggagtaggagagcatggtgggcagaacttgctcaacatatagtggatattcatccacaacccttgaaagtaaatttataaaagtagaagctgtttaaaaatatttattgggttaattctaggctatgtggagaactgaacccaggtcttgcatgtgctagacaaatattccacgactgagctacatctgtattccatgttcatagagttttcacggttataaaaatagtacacgttcgttgtagaaaacaaaacattacatgtaagtaaccaagagccaggctttggtgaggcatgcctgtagtgccagctgttttggaggctataattcaagtcaggagtttggaaccggcctgaacaatagagctaaactctatctcaggtaaacaaataaatattaataagtggtttaagcaatacagaatcaggtaaagtaagctgaatatgacataccagccacagaagtactataaagataattgtttactatttgcctgaagaagacaacatacccagatattctgagattctctaaaggtccttccagtcttgctttcactataactgtttgtttctcaatattagggagccttgtgatcactaagccaagaaacttggattctaacccccatgccattaattgtttactagtaactcttatttcactcatctcagtttattatggatcatctcagtgtaggaactagtagttcctacactgagatgtcaagagtttcaaaaccatgtaaggagtttttcttctaagtacatgcaattctagaaattctagtcactgtacaccatgctgagaaaactctagtggggtaggtactgttcctgatgaaaatttgtcatatccctcaaatatatagtgttacaaaaaagatgctgaattactacaatagaaagtctaattatctccttccaattctaatacaatttctaatacaacttctaactatttctgatttctataatattgtaataacatccaggctagttttaaccaattagatggtatctgaatgattaaatactcaggatttctatttggatggtcaatgagccttttcattagtatccatgaagaggctcactaaggcatgagagcatgcaaatggctttaagaagtgaaggataagaatgttaatgtgtcagctaagtggtgaagtgttcctgtatggctcctcaaaatgtcataaacagatggagatgtgtagttagaaagtatctgttggctcaccctgccttactttagacattctacatcttaaccttctgggcctctttggcctgaaaaattacagaacttctacactgtgttgtttttgttgttgatggtgatggtgttgtttttatttgttttttattcatttgatgcatcctttattaagtacaatgtttattaatcattgctctggatactagggacatggtgatggataagattagccccaagatctccttcaccacattcataataaacgattatattgtagtgtactaagtggtacagtgaggtaagcataaggtgttattaagtacactggtgcctgaactaaacctaggaagtcaggaaagttctcctaacgagtgtaacatctgagctacaatctgaaaagtggcagaggtagccaagagaagacttgagggaagagtgaacctaggagaaagaacgtcagtgctaaaaagccttgagtaagcagggaacttgaatcatttaaggaactggaaagatgatgttggctgtggctgtcacatgtagcatctattgtgctgagatatgttccctccaattctaccttctctgggacttttatcatgaagacatgttggattttgtcaaaggctgtttctgcacttactaagatgatcaggtagtttttgtctttaaattcacttacatgatttattatatttattgatgcatattgaaccatccctgaatctctgggataaacaacttggttatgataggtagtctttttgatatgtgcctatgtgcagtttacaagtatgttattgaagatttttagaatgatgttcatcagggatattagccagtagtttttattctttgttgtatcgttccctaatttggatattggacaacctttgtgggagtttgtcactagaagcaaccagttctctctctctctctctctctctctctctctctctctctctctctctctctctctctctctctctctctctctcctcccccccctctctctcagcagtcattggcctattgtagctcctcatctagatgtggaaccatgtgaaatttcctctgttggcatttacatgtcattatgctggtcttgttgggacagccatattgttgagagttcataactgcgttacctagcaacaagtgccctgggctctgcctcttacaatttttccagccatctcttccatgattttccctgagctttaggtttaggggttgcattacagatgtaacagctggggttgggaaacctgcagttacttattctatgaaatttccagtttatatgtctgtagtagtcttcattagttgcaaaaggaaacttctttgataagaggcaagagctatacttatttgtgggtataaggataggcatttagaaaacagtaagaaactatattggtttaggaaactggtaggaataagttctgaatctgtgatttttttccagctatgagtagttggctaagtttatattactaggcatgaactcccttatgatgaacaggtcttaatccccaagataaaagttccactgttttaccattgtgggcagtttgtaagtccagtcatagtgctttataagctgcacagatgggtgggatcattatttgcttttctccattggcagcttgcataacacctcaatactatgaaagctgcttctcaggcaaacggctttaaggtcagtttccgcttgattcctccaagtccaagtttaaagtgtgtcttttctttagtaatttggccttagcttcaaattctgagagtcaagcaagaaaaatggcaataacttatattgtttgggtggacttcttagactagacacatgcacatacaagcaaagctaaatgcactcaacaggatatataaatgtgcatatatacatatatacatacattcatatgtgtacatatgtagtgatagtaaagaagagatcataaatctgaaggggaggagctgaaggggagaagagggaacaggagtgatgtacgtgtaatgcttgtgtataaaattaccaaaaattaaaccagccctatctctttaaaagggaataggaagtttgtgtgagtacagtatagatccaaaggggaagtgatgataaatgagctgtctgatatgactagatcattcaggactctggaatccattttatggagctcagaaactcctaaaggcaatggagaatcacatgatcaatgccaagaatagattatatgacttgtgtctttaaatactaaatgcacataatctgatccagcaggtctaatagatctatttctagatatactcacacatggaagatcatttctcaaaaaagatcgtctttgctgtactatttgtaatatcataggactgaaaatcacctaaatgtccattactgagaagctggtttaaatgtgaaaatctgggacataaagagtttctcatcgacaaaaggacagaccatctagagactgccatatccagggatccagcccataattagcctccaaacgatgacaccattgcatacactagcaagattttgctgaaaggacccagatatagctgtctgttgtgagactatgccggggcctagcaaatacttaagtggatgctcacagtcagctattggatggatcacagggcccccaatggaggagctagagaaagtacccaaggagctaaagggatctgcagccctataagtggaacaacattatgaactaaccagtaccccggagctcatgactctagctgcatatgtatcaaaagatggcctagtcggccatcactggaaatagaggcccattggacttgcaaactttatatgcccccatacaggggaacgccagggccaaaaagtgggagtgggtgggtaggggagtgggtgggagggtatgggggacttttgggatagcattggaaatgtaaatgaggaaaatacctaatttaaaaaaaagaaaaaagagtttcttatcaagaaaatcaagtttttgcaacacatgtcagaggaagctaacttaatgtccattttttgtatcttttcatttttagcttacatttctaacaaatttaaaataaataataaataaaatttcaatttaaaaataaaacatgcatagcatgccacttttctccccagaactaaacagtctggcaacattatcataacataataacatatactaattaagaaatagaaagcatgttttggtagagaaaatataggttgcttcaatcactttgtatattaatcaaattaaatatcagaatacttttggcctagaactcatggttaggtgcatcctacaaaaatgggaatactagtacacaggtcttgaatacaaggatattgaagcaccaaaaggaggaatcattttaacaactaaaataaattagtaaatgattacattatgatatatagccatgctattggctgttggacaattatgaaactatatgtagatctgaaggactgacaatgttctttctactactggactttttaaaagagcaaattccagagtgatgtgtatgtttccatcttcagaaaaaaaagggggggaggatcttttaatccatcaaaatgtttgcacaaaaacagtcatagaaagaagcaacatcaaacaaaatactgataatttcagattgaaagggtttgagtagaaatggaatagactgtgaagttactatttatgtagttctgtgttatttcaattacaatgagcataaatactacaatgctatggaaaattaattaaaaattgataaagaagggagaaaatggactgaaatgggcacaaacaaaacagagaaagctatatcaccaccaaaaggaccgagggtgaataaattagaagagcagagggctggcaagatggctcagtggttaagagcgccgactgctcttccaaagatcctgagttcaaatcccagcaaccacatggtggctcacaaccatccgtaatgaaatctgatgcccaaaaaaaaaaaaaaagagagcagaaatggagactagcaggcagattacttagtaattggaaacattaaagattggttgtgtgattgaaagaagacaatgatgtcaaggaagccaggtttctggcaagctgttgtagtgttcagtgagatagtgatcaagggaagaatatgtgtggttttagacaggttggagctacaggcacctttgggaaattaaagagacaactataagcagtctgagatatgcatcttaagctcaggaaatatatgcaggctgaaagcatagatatagagatccttagtattaggactccattagttccaagtgagtgttggtctaaactggtgtgtatgtgtgtgtgtgtgtgtgtgtgtgtgtgtgtgtgtgtgtgtgtatacatatatatatatgaaataaaggagggtttattgaagacctcaatgcagatagctttgaacattacttaaccttggggcataggtgatgtcattaggactttttcttctatgcctcctttagacatgttttatctctggaatagcaaaaatagctgttagcagctctgactttatcttaacaatttaggaaacccagtggaaagtgtatgcttcatccagctgaattcaatgagaaagatgttgacaacattggtgacaatggttttaatagagaagttggaacataaaggttcaggatgaaaccagatgatgaagaaaatactatggttacatagtgcttttcacatagtaggtatttaataaatttcaggttattattttgttctttcttttccatgtatttctagcaaatgaagtaccaagttcaaaggctaaggattccctgtgtttgcttcttttggactcttaggggcttgaaataaacaccaatgaaaaatataactactgaacagagaagaaaaacaagagccccaaacaaccaagggtgcttttaaatacccattataatttgtttaaaaaaatggtgttttaatcccaaattaccttggtattgtctttacctcactattcctttcctctattctccatacacttgatatgtaaacactagcaaggtgaagcaaaaatttccatgttactaaatagaagatttgagctgtgtacaatggttattgttggcaacagtgttcacctttgatcttctacgtgccaacctacagaaaagggaaatacgattagagctattctataatttagaagcaacagttaatcctacttcatttgttgttcaggactctcaacttagaagagatagatcttatataatttacatgttcacaaacatagtcagagcttttgaaatggcaaagtactaaggaagctttgctatagctttctgaatcttgtctgcattctaccacttctttagtgacctagtgctgtaatttattagggcagttgtttatgggtccaaccacacggaattctctacatattaagccaggggtctaaccagcctgtgctttgtcaagtggtattctagaagaaagtggcttcatacatacctgttctccttgtagcaaaacaaatcatgggcctggcctggtgccagaaagtgcatagtgcatagtgtcatctttacagatgaaattctgcacattgttatcttatattttgctagaagagcaggaagaaaactgacttggtaatttgctacattctgatcctaatctgcttagaaatatgacttctttaaaaggaaatgggaacagaatatgtttctcatgataacctcatagtatctcctgaaaggatgttcagttattgtaaatacagaaatttgattctctctttgaatttcagatatatttcatcttttaaaaataagctacattgtcaacacacagacattgcaatcacaaagtcacagcagttgcagatacctatacagggtctgcataagaatggacccatcaatagactgacatggatggaaaggagactatgggtggccctagccctcactgatgaactagatgctacaaataaattcaaggagaggaggaatcagtgacttcaactgtgttccatctcatgattccaatccaatggtcacacaaagatatggttaaactaaaggattcccagaacaaaacaaatggtatcattgtaggaaaactgacaggataggaacaagttaaatcaggatagagggagaagataatcggtaatcagaatatgctttacatgtatatgtaaagggctttgttggagcacctgggggagccaccttggctaccggatccctctgagactagtctatgcaggtgagagtgtgaactacagaagctaacatcttctgggataggcagaagccacacagattctgaggcagaccccattttgggctccagacattcgggcagcttccctgccagaggagaggtgtccaccatgcccaggaggtctttgctggagcacctgggggagccaccttggctcccagatccctctgagactagtctgcgcaggtgagagtgtagactacagaagctaacagcttctgggacaggccctgttttgggccttcatcttctgccaggaggcaggtctgaacgccagatatctgtgcaccttccctgcaagaggagagcttgactgcagagagtgctctaaccactgaaactcaggagagatctagctacacaggtctgctaatagaggctaacataatcacaggaggaacaagctctaacgagagacaactataacaactaactccagagattaccagatggtgaaaggcaaacataagaatcttactaacagaaacaaagaccactcaccatcatcagaacacagcactcccacctcgcccagtcctgggcaccccaacacatccaaaaacctaggccgggatttaaaagcatatctcatgatgatggtagaggacatcaagaaggactttaataactcacttaaaaaaatacaggagaacacagctaaagagttacaagtccttaaagaaaaacaggaaaacacaaccaaacaggtagaagtccttaaagaaaaacaggaaaacatatccaaataggtgatggaaatgaacaaaaccatactagacctaaaaagggaagtagacacaataaagaaaacccaaagtgaggcaacactagagatagaaatcctaggaaagaaatctggaaccatatatacgagcatcagcaacagaatacaagagatggaagagagaatctcaggtgcagaatattccatagagaacatcagcacaacaaagaaaatgcaaaatgcaaaaagatcctaactcaaaacatccaggaaatccaggacacaatgagaagaccaaacctacggataataggagtagatgagaatgaagactttcaactcaaagggccagcaaacatcttcaacaaaattatagaagaaaacttcccaaacctaaagaaagagatgcccatgaacatacaagaagcctacagaactccaaatagactgggccagaaaagaaattcctcctgacacataataatcagaacaacaaatgcaataaataaagatagaatattaaacacagtaagggagaagggtcaaataacatataaaggcaggtctatcagaattacaccagacttttcaccagagactatgaaagccagaagagcctggacagatgttatacagacactaagagaacacaaatgctacccaggctactatacccaaccaaactttcaattaccatagatggagaaaccaaagtattccacaacaaaaccaaattcacacattatctttccatgaatccagcccttcaaaggataataacagaaaaaaaaaacaatacaaggatggaagccatgccctagaaaaagcaagaaggtaatccttcaacaaacctaaaagaagacagccacaaaaacagaatgccaactctaacaacaaaaaataacaggaagcaataattacttttccttaatatctcttaatattaatggactcaattccccaataaaaagacatacactaacagactggctacacaaagaggacccaacattttgctgcttacaggaaacccatctcagagaaaaagacaaatattgcctcagaatgaaaggctggaaaacaattttccaagcaaatggtctgaagaaacaagctgaagtagccattctaatatataataaaattgacttccaaaccaaagttatcaaaaaagacaaggaggggcacttcatactcatcaaaggtaaaatctttcaagaggaactctcaattctgaatatctatgccccaaatgcaagggcagccacattcattaaagaaactttagtaaagctcaaaccacacattgcacctcacacaataatagtgggagacttcaaaacaccactttcatcaatagacagatcatggaaacagaaactaaacagagacagagtgaaactaacagaagttatgaaacaaatggatttaacaaatatctatagaaccttttatcctaaaacaaaaggatataccttcttctcagcacttcatggtaccttcttcaaaattgaccatataattggtcacaaaacaggcctcaacagatacaaaaatattgaaattgtcccatgcatcctatcagatcaccatggactaaggctgatcttcaataacaaaataaataatagaaagccaacattcacgtggaaactgaacaacactcttctcaatgataccttgatcaaggaaggaataaagaaagaaattaaagactttttagagtttaatgaaaatgaagccacaacatacacaatgaaaagatttctaagagggaaactcatagctctgagtgcctccaaaaagaaactagagagagcacacactagcagtttgacaacacatctaaaagctctagaaaaaaaggaagaaaattcacccaagaggagtagactgcaggaaataatcaaacttaggggcgaaatcaaccaagtggaaacaagaataactattcaaagaatcaaccaaatgaggagctggttctttgagaaagtcaacaagatagataaacccttagccagactcactagagggcacagggacagcatcctaattaacaaaataagaaatgaaaagggacacataacaacagatcctgaagaaatccaaaatatgatcagatccttttacaaaaggctatactcaacaaaactggaaaacctggatgaaatggacaagtttctagacagacaccaggtaccaaagttatggggcatgatggggaaggaggtgtgggatgtgaagcagttagagggtggatggggaggagcagggaaaggaatatggagtgtaaaaaatgaattacaaataaaattagatttaaaaaaaagaaagtggggaagagccttgagcacatgggcacagaggaaaattttcctgaacagcacatgaatagcttatgctctaagatcaagagttgacaaatgggacctcataaaattgcaaagcttctgtaaggcaaaggacactgtcaataggtcaaaacagcaaccaacagattgggaaaagatctttaccaaccctatgtctattgaatagagggctaatatccaatatatacaaagaactcaagaagttaaactccagagaaccaaataaccctattagaaaatggggtacagaggtaagcaaggaattctcaactgaggaataccaaatggctgagaagcacctaaagaattagtcatcagggaaatgcaaatcaaaacaaccctgagattccacctcacaccagtcagaatggctaagatcaaaaattcgggtgatagcagatgttggcgaggatgtggagaaagaggaacactcctccattgctggtgggatttgcaagctggtacagccactctgtaaatcagtttggcagttcatcagaaaattggatataatactaccagaggatccagcaataccactcctggacatatacccagaagatgctccaacatgtaataaggacacatgcaccactatgttcataacagccttatttataatagccagaagctggaaagaacccagttcttttatcatactacaataataatgttgttaacaaatggcataaccaaaggacaacactgtacaatattcacaatattcctttttcacttttaaacataaatgaagaaatatattacagtgtatactattatgccatatttactctctccactaactcccttgtttgtattgcttctctgaggtataggatgggacaactgaccttttattggcataataaacatcttgaataacattcccatacttctgggggttttagtacatttttctagtcattgcccataactagacatactttttattcctgttccataaaacctatcagaatgccattatagaaataatattatatgtgtttcaattttaaagtaaatcattaacctttaacacatttttagtaagaaagtacaacacattttaatactggagttgtaagtcattggagcagtaaactggactttggtttctcatttgagaattagcattcacattgcaggtttgcagcccaattcccatgaaatcttaaacatgtttattaatctcttggcttcacttgccataaaatgccaataatgttgatacttcgctggctaactgtggtaatgaaataaaatggtttttgaagactgattttcaaaaacctgtaaaaatctcagttcggattccccatatgaacctgcctggtctctccttggcttcagccttgaactgcttttatttccttctgatcctatacgaactcttcagaatcatttccttagaggtgatccacctaataggccctaattcacaatgttttttttccattagaacttgctatgtgaagccctagttcttaaggtatttattattgcctccatactcttccactttaatgcactctgaaatagaaaaaaatagaattttctatctttttatgctccaaagtcaaactcttcttttctcctcccagtacctccacatataatcaagtagagaaagatggcttagtaggccaccaagaacaaagagttttaaggatatgaaaactgtcgctgggccacccctggacagcacagatgggcatatgggactgggctgacctgaaagacctgagggtctgactggcctgcactatgctggtacgaggctaacctgctgattctgcagagctgagaactgctatggagagcaggtgctacggctgtgctgtccagtttaccctcttcaaggagtatggctgtaagaattgtggccaagccttctgtaaggactctcttagcttcagtgttctgctaccccagactggcaacacataacagaaagtctgcaagcagtgccacacagtcctgaccagaggatcctccaagtgatcgccacctcagtataagaagtgtgtggcagccttggaagacaagaagaagcccagcacttcctagagccaaggcctgacccacaaagacaaagacattgctgagtgcctagcaggaatttggccggaaaacaagcccaagtcagtaccctcacaagcagagatagaggcacagctagccacgctgaaggatgaagtccagggccccattcctaccacacaggagatggaggatcagcttgcagcattgcagggcacagtcctgcttcttcacactttgaggctggcacaccaggcaccagatatcaggacccaaggccagcagatgcagaatctgctaacacagttgacagctgaggtggatattgatgaaagctggcaaccaagagcctcagccccctccccctccataatgaccttaacaagggagctacaagaaatcagcacacaaattcccaggggcaggccacccggtctctggaggaagagaagaacaagctgctagctgaggcagcagttgagctacaggaggagaacaaccaggcaggaatagatcctggctcttgccaaaagattggttatgtacaacagagtgaccctccaggacgatcaacacccaaacagtgatgaggatgaagagacagccatccagagagtcatacagcagctcactgaagaagctgccctggatgggacaagtggctttaacattcctgaggaaccagctccaggatcccaggcccaaccctgcaaggcagagactgagggtccccaggctgaggaagaactcccctggtgctgtatctgtaatgaggatgctactctgcacggtgctggctgtgatggagacctctactgtgctcagggcttctggaagggccaagataactttgatcttaaagaacatcagacttctccctaccacccccaaccaccttgccaagaacactgaggataacctaatgatctcctgaggtggcagtgccacagcaaccagcagcctgggaagaaacctggggccaagtctcagagcatccagggggacagcaaaccctgctctactgatggcaaacacacccctttgtgagctacccagtccctggaaggaagaaagataataacgctgagagggggctggtgaaaggaagagtcagggtgctcttctaagaggctggcctcaaacagagacagatggagaagagaccagactgaagccaagaataatacctgaaatctgcttcccaggcacaaccctggcctatagtggagctaataaaatgtgttgaaaaaaaggagatgaaaactaaatataaaacgttgagacaagattccagcttttgttttaaatgattggttcccaagggtttattgcattttttaaactaactactacatataagccagtgtgaattaagatctttaaatataaaatatatcccatgcttaaacccccccaaagcaatgtaaactatctaattaatatatctacattgattccatagttaaatgaatgtattttaaatatatgctgctcagtaaaaagaaagtatgaaaacttcaactgtgtgtgtatatattgtatttatgtatagtgcatacatacatgtgtattcaggtttacatgcccaagtagggacaagaaaaggattttgaatgttttgttctgtgacattcctccaccttattcctttcagacaagatctccactgaaccagagctatgcaagcagctagaaaatccccagaaatcttcttgtctccagctttctcacatagagtgttggggttgcaagcgcactcagccacacacagcttttttatatgggatctgaacttgggtcatcagtcacctcaaatctgatttttatttactaacaaaattatttaaggtattatataaaattactgctagatactgtgaataaagcttatgtgaaatataattgaatattatatttagacttctgtccattcccaactttattatatatatgaagatgttccacaatctgaaggaaaagaggatccaaaatgtgaagccattctagtccctacatattttggataaagaatatcaaatctttataacaattctgtaacactgctctttgtatgtatacactgatatttttggctaaaatctatttagtttatatttgaggacttagtaactctaatgtactttatctggggccttctgaagccttgattgaaacttttaatgactacaatagcaatatgtgcttcttctaaaacagaattcagcattagaaaagcgtgtattataacacaaggaaatcatcaacccagtctcagctcctacacactgtcaatattaacaattaaatgagttttctagatatattcactctaaggtcttagaattggagtgttaacatttttgctattccttctcactttatctgatactatacatgcaatggaaagctgtaagtctatgtgtgatcaatcatagagataaagcagtggtttgtaccactagaatagaatactctattgttcgtttggatttattttcctgaccgtatcttctctcccctcagcaaaagacatgccatttggcttgtatttatgctaaaagtacagtgaatccaaatcaatgttgcaagattttcttaataccctttgggggaaaaaaatcagagacctagaggcatactataaaaccagaactaaaaatcactgttttagtgtattgatctccaacaaagtacctgatcatttctcccagtgggtatgaaacaggcttctgaggggagcataatgatttggaaacatcacatgtatccatttcaccttcagtcataggcttctctctattcttaggaatctgcttaacaggggtagtttagaagggagagaaaagaatctaaatgtgagtttgggactatgtgctgcatcttgacatttttctttccaaaattcccagagctctatacaaaaaacattaacagaaaaacagctcagtaccacaggcattacagaagctattttctttgtgcatgctactgactgacaaattaaaggatttttgcatactttttctttactagataccaaatagttatatttcccttttctttccaattaagccaagtcatctattcaacatcatattctcagaaatcacaaaaatggattttacaattttaaacctatttttatgtatatgggtatttcggactgcatctatggctatgtactatgtttacacggtgctcatggaagccaagaaggcatcggatcctgccttgaatccctggaactggatccaattcaagcctcttaaccactgagccatctctccagcccctaaaatgggtttttaatcatatgctatatgatcccagtcccagcaatagttgagacctaaaagaaaaataaatttaaaaaaatttcttattgctattctaatgagtttctcttccctttccctttagaaaaaaatggcacacttaaagtagaaatttgtaccatggcttttctctaacctaaccctatttactcagcacttccagtttatttttgttatatatatgtgtgtgtgtgtgtgtgtgtgtgtgtgtgtgtgtgtgtgtgtgtgtaagtactataatatacaggctaagaaaggactccttagaatttctatccataaactgttttacaaatccttcctggaatcatggttattcactgttatatgtgatcccatgtaagaatgctaggcttgttccaaaacaacaaaaagataagttggaattagataccaaaaatcactttcaataattttagatatagtagtaattatgtatttctatgatttcagtttatttttgctatataaaattactggatttatgaagcaccatgtgatcatgtctattaaacagaatgattgttacacagaacagttaggtaaaaatatatctagaatgcatatctaatttagccattaattggccgtgatgcttagatcaacccaggttaatgttgaaagcacaggaaggaaatggcctaactctagtctaacaaccataaagatattatcaagattaatacatcaggaatatattggattatagagtacttgcttagcatatggggaaccctttgttcaatcccttttcctatagaaaatgggaaaagtataaagagttgccagaaaatgctttgaatattaaacattatgtacacatacggctcttcagatatgattacattttcagcttcaacattcaaaagaatattcatttcctgttcacttcccttgtactgtgaagatatgaccacaaggtcctctgagcttgtcagtatagttagaaatgccagcctttgtacaaagatatattttatttgagaaaaagaatattgtatcacattatctcttataaaaattaaaatagaacattttgttaaaacgactagacaaatagaaatgctatattatatgtggcaaaatttctaggtacctgaataatactttgcttactgaaatataatgaggattatgatagttgtttccttttttgtctttttaaattaattaatacatgctctcacccagcatggcatgatgttttggtctagatgtgtattatacagagatttcattgagataattaaacatatcccaccaacttaagattttgatggtgaaaatgttaaatgtccattttaacaactttaaaatatatattacattattatccattgtggttactatataatataataaccaaaatgtatttccccactataatcaagacttttttaattaggtattttcttcatttacatttccaatgctatcccaaaagtcccccataccctcccccacccactcccctacccactcacttccacttcttggccctggcattcccctgtactggggcatataaagtttgcaagaccaaggggcctctctttccagtgatggccgactaggccatcttttgatatatatgcagctagagacacagctctggggggtactggttagttgatgctcacagtcagctattggatggatcacaggacccccaatggaggagcaagagaaagtacccaaggagctaaagggatctgcaaccctataggtggaacaacaatataatcaagactttttaaaactaagtttctgattcattttttgatttgtgtgcgcgtgtgtttgtgtgtgtgtatgtgcacacatgcacacatgtacaaacaccactgtacaggtatggatttcagaggattacttgcagggagttgattctcttctcctatcaggcgggtactacagatcaaactcaggtcctgaagcttggcagaaagtgtctttgcctgagtcaccttactaaccctaaactgaaaagtttatagcctttgttcactatctttcctttttcatatctccctcttgggtgaagaaggtacccatctacctcttgcaaccccttttcctctatgtttttatgaattccactgtttatactcagattgtacagtgttcacctctctgtacctggtctatgtcatgtcacttagcataatgacctagggaaaatacctatatataacttttgaaaaaaaactttgtttacatatgtgtgtgtgtgtgtgtgtgtgtgtgtgtgtgtgtgtgttaaccctcattatatatggtcactacatgcatgcctggtgctcacagaagttagagggcatcagatccccctagcactggagtaatgaatggctgtaagccaacaagtgggtgctgggaaaacaacccaggccttctgcagaaacaatatgttttcttaactgagccatctctcaaacccccagaatttcttttctaaagctgtatagtttgagtttatctctgtctgtctgtctgtctgtctgtctgtctgtctgtctctctctctctctctctctctctctgtgtctctgtggggggaggtcacacagggacattagaggtcaggtggggtgggagctggaggcatccacatggagacagggtggggtggggaggaagtgtgagatgtggagcagtgggagggtggatggtgcaggaaatggaatatggagcataaaaaataaattaaaaataacatagcaattcctttgaatatgtaaccagaagtagaattcttaggccatacagtaaattctatttgtagggtttttttttttaagcttccatactatttcccaaaatgtccataccagtttataatcttacgaaaaacatgtaagggttcttttattctcattttctcttgtttgccagcatttatcatgtattattatgtttataaaagcaaccctgcagtagtttgtgattgcagtttttattttcactgtcttcatagagacactgaatattgttcatgtacttgtccacttgtagctttctattaaggaatgtttattcaaattctggccttactttgaattgggttgttttgttgttgttgagtccttctagactttaccctcttcctagctatgtggtaggttgtccctgctctctattgtttcctttgctgagagaagttctctatgtcctcacaaatacttgttcccatccttttttattctagccatcctggtgatgtgaagtgtgtctcactgtagctttgttgttattttgttgggtgtattgtgatgctgaggatggaagcagtcttgttggatgtagggaagcaccctaccaactggatacatccatagcctcattgtagctctgatttacattctgtaataattatgccaatcaccattggccaattgtatctttggagaaatataaagacaaggcacaattaatagtaaactaattacaaataaatatacatcagaacctcaactcattttcaaatgagttattactgtttctgtggtgacataagaaagtctacggtatgtttctcactgtatgatttgatgttcagtagtaactcagatggttctctgattttgtgatgaatttatagctctgttgcttcttgacaaatgtgagcctcactttgccatcttcctttctatttcgtttgcctccctgtggaactagatagtatgaacttgaaacaagaagtcattatttcatcgccatgacacttctatgaggaccatttctttctgtcttacacttaacaaagatgaaacaatattgtagtcatagaggtatatctgtgccttaacagttaaccaacatatatatggcctctttaataatttattgaatttcaagtttaggagtgtaactcagtggttgaaatgttcacaaggccttgggatccatctccagtactgctaaacaattgatggaattttgcctgtagagtctattctatgatgttagctggtaggccctagcaacctgtgctttctctgaacagcttagttatcgaatgccttggcaaaaggatctgctgattgctttaatataccaaatctctgccaagacaaaactgttacacatttaaatcaaaaaccttatctctcaaccatgaacttatatcacttttaagtaatgttaaaattaatttattaaaaaaaacctacttgacaacccattgcgtcggataaggcaggtgctggtgactgcgttgtgtgcgggccatggggccgcggcctggttagggcccagagatgtccagctacacacggcagcagcggcggggtgtgcccccactatcacagacatggagccgcgtggttcctgacaactttggctatggaaaggggaaatgtactaaacaaggtccgtcgggagcccatgagacgcactttggaggtgacaaacttgaagaccttgaaaaagccaatccattctccttcaaagagtatttgaaaaccaagaacctcagcctgtcaaacgaagacattaccaccagccgaatttacctgaaggaagcctcaaggcacccactgggactaaagcacagctcccctgcctccaagcccatgggatatggcctagattatcagcagccattttgtgaagacccaacaagagccaggaacctagaagaggatgaagaaaatggatggaatagaacctacctgccacctgctctggggcagactcattcctctagagccacacagaactcgtcaccccgtggcacctacctttcctttttctccaacacatcagagctggcaggtcctgagtctttgcctccatggaagctgagcaacaccgactccaggatctctccagtatttccagctgggattcctaatgcagactttgcagctcatgaagactccctaggggacagacacctgcggacgctgcaaatgagttatgaagcactgaaagatgaaaactctaagctcagaagaaagctaaatgaggttcagagcttctctgaaactcaaagagaaatggtgcggacgctcgaatggaagttggaggcgaagatgatcaaggaggagagtgacttccatgacctcgagtcagcagtccagcaagtcaaacagaacctcgaactgatgaccaaacggactgtaaaagcagaaaatcatgtcttgaggctgaagcaggaaataaatttgcttcaggcacagctctcaaacttgaggcgagaaaatgaagccctgcaatcagaccaggatgccagccttactgtagtgaagcagagcatggatgtggccttgcagaacctcagtgttgtcatgcacagtgcacaggcatccataaagcagctgttatctggaggagagacactgaaccttgttgctgaactccttaagtctatcgacaaaattactgaagttaaagctgaggcagactcttaagaagttctacctgccaccgggtcccatcacctctgcaccgaaggcaccacacatcttccaaatgtgttcctatctatgccgtcctcaccaaagcattccacagcctaagcgtgtgactggtcatctgcagtacggggctcctttctaccagttgcacctaacagtttatatgaaatcccactgttcaatagactcactgatttactggaagacatttttataagacccagaaacttttagaaaccaataaagctgaaacaacagttgtgcaaaaagcttctttcactgtcctctcaaatttagctctaggatgaggtcgggctcagcctcagttttatcgaggggaacactaagtgagccagtgtgtaagtgagcagcctgtacagagacgcgtgcctcactgaggcagcaccacttggtaggtgctgctgtcctctcaccaggaccataggaccaaggtcacacactgtgcacattgcaaagcttcatacaccctctactgtgtgctgtcagctttggaaagccatttggggctgtcggtttgatgcaggttaatgtgtctgtgtgccttttgcatagtgcagttcagactggaattaaagcacacacccacctgggggctcagcaccagctctttgggctggctggctggtttttgaaggataaacaagatagaagcagcaccctgtgctctgctgaggggtcaaggtttagggcacactttcctatagttttttttaattttccttttcccctcctgttgagattgacagctttcttatctaaataaatcctgaagatcatttaaaaaaacattacttgacatacctaactcatttattctttaatcacttatctaagatgaggattatgagtgacaatatgaatctctctcctgaaaccactgacaccatatctcttggccaaagaatgccagtaagtaaaagtcaccagtgtacgactgagatagagcttagtagcacaatgcttgcctggcatccatggatccatgggttttattctgagcactgcaaataaaaaacataatcactagtgcagagagaagacacacacgggggtgggggtggggcattcttgccattgttttttgagacttagagctctgctattgcaagctccaaaaggaccctgctctcaccaacgttaacttctactctacagtaattgtgaatgtcaaaacttgctttagacacaaggagctaaagtttcctgacacttatttcttttattagggaaaaacaaagagctttacaaacctacaaagaagtattgtgtagaaaagaaagttggctcagaccaaaaatgatcagtttaacattcaaaaaatttctagtgcatgcctttctagtctagaaaaaaaaatctccatctctgaatttccttagaaattcttttgctatcatttatcccttcaactattgctactgtcacagataaccttaaaagttcctgaaaatgcattctgagggtgtttggttctctgctgaattataaataaataaaaagaataaaaatgctctgctctaaattaatcgggcttctgcatcatagcccctctttctgaagctcaggaatctttatggaagagagggctgagaagactgtaagaactggaagccatggaagacgataagaaagtattttgtggccatgacagggcagctgcacacatgaactcatggccactatgattgccttcacaagatcaagcagccaaattctagcacatacactggaggggagcatgaagtcctgccctaggtaaagaggtattagcagttggtagctgctagggaaggacatgttggttttcttcaggaatgcgacccttggcaggtcatgctgcagtggatgacctgcgtccctatgcatacactggcactgagaggactaatgagttttcaaaaagaaagcaatcaaagatggtaaagcaagatggtaggaaaatggggaacattttggaggggaagaaattaggggtggaattgacaaaacacatacatgtatggacttctcaaacagtaaaagcaactaaaaacaaatacaatagtccagctatatcacaaaagcaaggctgaatgttggaaagaggaagcagattgctgttttgttttgttttgttttttagcagttccatgtgaggtttattgagaaagaaacgggcaaggtggtggcagaaagaggaagggtagtggggagagattttgaacttgagaaacactgtgatgttaggctccatgggtttcctgttgccgccaagataactcagtaggtctgtacaggatcctcccatccaaccaccaataggcacagaagaaaaactgcttagaaaagcccatcttttatatccaaaggaaagcagatatgggtaagattacaacaagaacattttttgccaatacctgtcctacctggtcaaaaaccaatgagaaaaaaatctaattttcctactgctctgcagtttctttttcttttttttttctttttaagcttacttaaaacatggaatttttaattttttctttttttcttcattttcatttcaaatgctatcccaaaagtcccctatacaccacacccccccccgcaccctgctccccaacctacccactcctgcttcctagcaatggcatcccctgtactgggataatctttgcaagacaagggcctctcctcccaatggtggccaactaggccatcttctgatacatatgcagctagacacatgagctctgggggtactggttagttcatattgttgttcctcctatagggttgcagaccctttcagctccttgggtactttctctagctcctccattgggggccctgtgctctatccaataggtgactgtgagcatccacttctgtatttgccaggcactggcatagcctcacgcgagacagctatatcagggtcctttcagcaatctcttgctggcatatgcaatagtgtctgggtttggtggctgattatgggatggatccccaggtggggaagtctctggatggtcctttcttctgtctcagctctgaactttgtaactccttctatgggtgttttgttccccattctgaaaaggagcgaagtatctacactttggtcttcgtttttcttgagtttcatgtgttttgcaaattgtatcttgtatcttgcggtattctaagtttctgggctaatatccacttatcagtgagtgcatatcatgtgagttcctttgtaattgggttacctcactcagaatgatatcctccagatccatccatttgcctaataatttcatgaattcattgtttttaattgctgagtggtactccattgtgtaaatgtaccacattttctgtatctattcctctgttgagggacatctgggttctttccagcttctgactattataaataagactgctatgaacatagtggagcatgtgtccttattactagttggaacatcttctggatatatgcctaggagagggattgctggatcttttggtagtactatgtccaattttctgaggaactgccagactgatttccagagtggttgtacaagcttgcaatcccaccaacaatggaggagtgttcctctttctccacatcctcgccagcatctgctgtcacctgaatttttgatcttagccattctgactggtatgaggtggaatctcagggttgttttgatgtgcatttccctgatgattaaggatgttgaacatttttttcaggtgcttctcagccattcgatattcctcagttgagaattctttgtttagctctgtaccccatttttaatggggtcatttgattttctggagtccagcttcttgagttctttgtatatactggatattacatccctatcagatttaggataggtaaagatcctttcccaatctgttggtggtctttttgtcttatccagaaattaatcttctacatggctctcagaagcttgttgctagcatgtgtgagcagatagctggtcttttcccactactgaccaaaacaaaacagatggcaccccattctgctgctgtactgtgttaaattgggctagtggtgagctaagttgccattcacactgagcagcaaggcaaggttagttgctactaaacttcacaacactatctttatttcagtcagtactgatagaggcaggtgctgggctttcacccatcccctctagcaggaagagtatggtaagttccctgatttcctctacacctagtgtcagaaaagcccagtgaagagttgaagctccgtactcacgggcagcaaagaaactaagaggcagcatgaagtaggactacccagcactcctagccccaacctctgaggtcaaaagctaaaaagacccactggggaatctgagcttctaattcagtaaggcttaaggtggtacaaggtagaactacttagcattcttcattctgcatatcctggttgtcaccaaagcatagctgggagctgagcttgcgccctgccttccgaagctgcagacgctttgggggttattctgctatcacttgccttactgtcagcacagtcaggagtggctgaactcatgcttaacccatttgggacaacaaagcaaaatttagttgcagacggccacaagagtctgagcatactgcatgtacagactacctgatttttaaagatttaaatatgatccagaatttcatgatacagtatctaaaatgtcaaggtaacagttttaaaactcactctccaatcagattatatctgacagggagatataataatatcaacgacaaaataacgcactaacaataaaaaattctcttgaaacagatacacaaaatctcatcaaataaatagaaattataaaactatgaaggttgggaatttaaaaacctcagttgatagactgcatcagctagagacaacagaagatggaatcagtgatcttaaagacagatctgtaactttaattctttcaaatcctatttttaatgatggttcttaaatgctttaacctcccttctagcccaccacccaccagaggtagtagaaaagaaaggatacagggggagaggggcgtggatctgtttagaaaggttctttggagaaactcccatctgtgttgtctggaaatccgaagttcagttcacaggtcagcatcagcagctggatccactcacatacactttacagatacaccagcagtccggttctgtagagtaaggatagcaaatacgaatcagtagtgatggcactacctaccaaagacagccgggcttcactcagccttggctcaagacagcaggaggaacaccgggagaagttttttctcagccaagcaaagatcagtgaagactggaaacccacaagcattgcacagctaactctataagcaagcctaactctaatataaataaataaataaataaataaataaataaataagcaagcctaacttagcccccatgattgtccattgaattctatttatacgccctccaaacatcacatgccctccgtgtgtcttgcttcagcacctggtgtctgtctcagctgacatcactctgcctatcagcctgagcctgctgaagtggcacaccaccagaagtaggtttttggcatgtttctctctatagtatccctacaaatgcagctcaactatgaaatgtaaattggaccaatatacgtgtgttgttagcaaagaatctttcatcatgtgtcttttcacatgcttgctttagcagaacatcttctcacctgtgtctgcttcagccaaatgttcctccttgagtctgccttagcctttcacctgtgtccactttgagaaaacactcctttcatgtgtttgccccagtagaacaccctcgaacacaactgactttccaaagaacccttaagtttccacttcacagatcacccaataggcttatatacttgaatgcttagtcaccatggagtggcactacttgaagtatttggaggtgtggccttgttagaggaagtatgtccctgggggtaagctctgaggcttcaaaagtgcatgacaggcgcatatataatcagtgtccaaaggataagagaaagaggtgtatagtaaggacttgtaagttaatggatgttttggaaagggaattctggcacatacaatgtcaataaaccttcaagacattgtgcaaagtgaattgaggcagtgaaaatagacaaataccatacacttctatttatatgacattctgagaatagtcaaattgataaagagagatcatggtggaggggatgactcagtggctaagggcaattgtcaccaagcctaaagagcaaaaattaatgcccaggacccatgtggtggaaggagaaaactgactcccagaagttaccctctgaccttcacatttgggctgtggcacactcccccaacacacaaaaaggtaaagaaaaagaaaacttttaaagagaaaagagaatgatgattgtaaggaggttggggttagggggtattgcaagatgaaaagagtttaaaaataccaatataaatatactaaacacttctgatctatacccataaaattgttacaatggtaaatgatatgtattttatcacaattaaattgattgcttaaaaataaattttggctgaaaacgccacaaacttggcaaaataaacagttacaaatttaaagagctgagtgatatcaaagtatgataaatctaaataactcaatgctaaggtatgtcataattaagctctttgattttggggggcttagtttatttattgatttatctatatgtctgtctatttattagacgatctggcaagctgtctgtgaactccctaggtagcccagactgacactaaacttgcaaatctcttggcacagcttcctaaatgctaggattattatattgtgccaccatgtccagctctcataattaaacatctgaaggctaaaggtaatgaaaactattgaaataatccaggggaaaagatgcattagttatagaggaataccaatttaacaatgaacatattcttgtgtggcatacaagtattgaagccagaagaaaatgtcatatttctcaagtgttaaaagaaaacagctgttaattgcagattctatatccatagaatcccttcagaagtgaggataaaataaatgaatttctgtgcaaagaaccttcagagtatttgtttctggcaaatatattcttaaagattaaaacaagttttagaaacaagtgataatagaagagacctcagaacttcaaaaagaacaatgctgaaagagtagatataatagaatatcctagttctaataattttcataaattattttgatggttgaaacaaaaaatgtgccactatctgatgaaatgttgaacatatagaggaaatacctactcataatacctagagtcctaagtccataaatacacagaaaattaaaaccattattcaaataaatacttgtgcataattattcctagcactattacttatactatttccaaagtagaaactacccaaatatctatccactaataaatgaatgaataaaatgtggtatatgcatgcactagaacactattcttcagaataccaatatgtgctgtaatgtccttgaacctgaaagtattgtgctaagtgaaagacacctgtaacatattgtatgattccatctgtttatgaaatactcaggatagacaaattcatagagacagaaagtagattagtgcttcctttggggtgagtatagaggttggaagaaaattaggagtttgataaaatatagaatacaaggtttcttctcaggataatgataacggtcgaaactctattatggcagtgtttgaccgcactaaagtcattaaattttacatggggcttctttccttctttctctcttttttctttcttttcttttttttgtttttgtttgtttggatggcccaggaaatgtcagtagagaactctaacaaatattagaattaacacaaactttgtccaatctcttctagaaaatagggaaggaatgaacattgtatcatttactttatgagtttaatgtcaccataataccaaaatgagataaaacatgacaaaatgtagaaaaaataaggaccaaagtccttatcaaatttgatataaaaattatcaacaagatattaatactacaattacaaaacagttgtacttcatgataaagtggaatttgccccaggctttatgcaagactagtttggtctttggaagtaagcaaatttagccccacatattgaaaggaccagtgaaacagctcagtgagtaagggcgcttgacttcagtccctggaacctccaatgggaaaaggagaaaatggactctgcaaagttgtcctatgccttcacacatgagctgtctcacagacacacaggtctagtccagagagacagcacagcagttaaaagcacttgctgctcttccagagggcccaggttttattcccagcacccacattaggcagcgtacaatcatctgtaactccagctctgggagatccaatacctctggcctttgcaagcagctgcactcagatatagctaaaaaaaaaaaaattaaaaagtacaactagcatcataccttatgaagaaaaaaatagtgacagcttccttcctaagactgaaagaaacaaagcacttgtaatttcttattgttattgacacagtactagaaaatactagccacttcactaaaacagggtgtagggaaagactactggttcagttcaggtttaggttgatgagagcttataggtgtcgcttctgacattcctaggagacaaatctcatagcaaactccctgatcctctggctgtatgatctgtccactcccaacttccacgatcatccctgcacactcaatggttatccaatactaaatggtcagctctaaaaacatacatgcaagtaacatgatacgactaagcaggttgtatttatgtatttaggaatatttgtttatttatatattatatatgtacattatatatatatatatatatatatatatatatatatatatataccacaaagattactgaaaagcgggccatggatttgaaaaaaaaacaggggagtatatggggggttttggagggaagaaaggaaagggggaagtgattatattataatctcaaaaatgaaattaacttttaaaggtataactggtggttttttttttttaaggaatggagatttttgctggatggtggtggctcatgcctctaatcctagcatttgggaggcaaaggcagacagatctttgtgaatttgatgccagcttggtctacagagcaagttccaggatagctagggctccacagagaaatcctgtctcaaaacaaaatgaaactaaatgaaacaaaacaaaacaaatagagatttttgtgtggctaaagcttgagcagattctgtgtctactctcaccactgctgtgagttcttacctgcttctctgctgtcttgaaaccagtttcctataggcctctactacctctggcttctacagtctttctgacacctcttctgaagtgatccctgactcattggaggaaagagtgttctacagatgtcccactgagggctgatcagtccatggtctcttattttctgcatcttgatcagttgcagatctctgtgttaattaccatctaccctgaaaagaagtttctctgaggagggtttcaaagatcaactgatctgtagttaaattgtttaaccattaatagtcagcttaattaatactgttgtctatcttgaaaagtaatggtagtatgtaccccaccttaggttcttggccccaataattatgccaggtatgaatttcaacttgcagatcagacctcaaatcaaattagagagtggttgtttagtcccatgctattattgccattactgcaccagtcagacatgtcttggaggtaagcacttaagtgctactccttactaaggaactattgagtttggtagctgttgtaagatgattaaaaatgtggcccctggtaacatcaaccatgctccagtagaagagcacacatccacacatcgcaaaacaacttttatttaatgagatttttatgaagtgaagcaatgtggaacaagctctcactgtgtagttgtagctttcctggaaacttgctgtgtaaaccaggctggcctgtaactcataaagatataccagcctctacctcgcaagtgctgggacttaaggtgtatgccacatgcttgatggggttttcttaataattaaaaaaaaaaggccacaaagttagttgtatagggaaagaggggttgatctaggagagttggggagaggcatgactatgactaaaatacattttatgaaatcctcaatgaactaatataaaaatgagaaaaaggaatagagttgatatgcttctcattagaaaagaaagtaaaactgctatttttgattatgtgtttgtctatataggaaacttcaagaaatctattttttattttttattttgttattacatattttcttcatttacatttccaaagccccctataccctccccctgccctgttccccaacccacccactcccacttcttggccctggtgttcccctgtactggggcatataatctttgcaataccaagggcctctcctcccattgatggccgactaggccatcctctgctacatatgcagctagagacacaagctctgggggtactggttagttcataatgttgttccacctatagggttgtggacccctttagttccttgggtactttctctagctccttcattaggggccctgtgttccatccaatagatgactgtgagcatccacttctgtatctgccaggcactggcatagcctcacacgagacagctatgtcaggaagaaatctatttaaaaaaaaaaaaaccctaagaattaatattatctcagcaaatttgcagaatacaaaataaaagcacaaaatcacttcaacttctacatgcatttgtcacttataaagttttttttgttttttgttttttttaattaggtattttcctcgtttacattttcaatgctatcccaaaggtcccccatacccacccacccccaatcccctacccacccactccccctttttggccctggcgttcctctgtactggggcatataaagtttgcaagtccaatgggcctctctttgcagtgatggcccatcttttgatacatatgcagctaaagacaagaaggtatataaagtttttacttaaaaaaaaaaaaacgtggttaagttataggtctttgtttgccttgagtttcgatttttgagacatgggtttgctatgtagtccaatctggcctcacactcactaagtagcaaaaatggatcttgaacttatagtcttcctgcttcaacctctcatgtgctgctgctgcaatctagcactgatgtgtggcatggaggttagtatctctatattagaggcttcaatccaccaaatgttacattttgtcatttggaattttatttatctccattttgctgttttatgtgttacaataccatttcagtgctgcatcatgggtgtatttctctgtctagttttgtggtggtggtgtgtagatagatagatagatagatagatagatagatagatagatagatagatagtattatataatgcctatgaatttattatataatacatgtgaaacatgcctttgttaaagtcatcattttacttccttatgcaaaggtagaaatcttaccactcttaagtcccttcatttatacaatacattctaattaccttaatatccttagcatatgtcaggagctacatgacacaatattgcagctttgatttatttatttagttctttgctatacttcagaaaacaagaggaataacatgtattggactttatctataatcttcctttttctgtaggttcctatgtggttatgcaagattccttctttctcacttattttcttttttagaccattcttcggggtaggccaactggtagcacactctctttgttttcctctgtctgataagtttttggtatatctttaattcccactttgactaggcagagctaagactggagtttaacaggtcttttgacagttgaaaaagtatgcagtgcttgcccgtggccttcctagtttctgatgttgtatacaattagcatttaggttgcttttttactacacataagacttcattctcctctgtacattcaaggttttaaacttatggttactttccagaaatttagagattatatgtctgctcttgactccatcaactaagtttttttctgttttttttttcttaaactctttttttttttcattttcatttctgttatttcaatttggttcttatttgtagctccaatttctttactaagactatttgtgagatgactctttcagttgtatcaactgtgttcataattattcactgaagcattcctttgatggctactttacaaatatgtgtcatatggtcctataatatctgtcatctcacaagtgccttctggttttaatttttttttttagcttaagttagactttgtggtataatgtgtgagttaattgaaacttcaatggttcatattttattcaatgttctagactttgtttaaaatcttttgccttaattgtctttacaagacaccattccagtaggagaagagaagttttatacctcattattcccaagtataggtagaaacacaggtcccattcttggtcctctttgacacttaagggagaaggggctttttattactcattggtaaaaatggaagttctagctaccagtaacttgactggagtctacttacctgctgagcatgaaagtgagtctacacatatatatgtatgattgtacacatatatatgtatgattgtcacattattacttacagcccatttctttgttttctaatttttaatttctttcaagggaatttataattgatcagtagaggagtgattttatgatggtgctttgaagcttagatagtcccaccaatctgatttatggcagtattacatcaagtgacttttctcatttatgttgttatatgcctggtctttactatagatattaatgtatcctgtacagtgtgcctatagatggctcctgacttacaatactttgccttatttttttctagcttacagggattcaaaagatatacactcaataaaactatatttcagattttgaatgttggtcttgccctaagctagcaatacgtggtattctcttgatggttttcaggaacagagaaacaaggctctcagttagttatggaatcacagtaggaagcaaccagtgttctacattctcagtgtggttatgctggatagcgtttctcctcatgatattttcaatttgcagtgagtttatcattaaaacaccactggaagtcaaacaggacctgtgctatactaggagactcttaacaaaaattatgttttcccctgaaacatttttgggtgtagcatatcaatcctggtctatttttttagaacaatttagtagagatggagaatattccatctctgctggtggctataaaaagaaaaaaaaaacatacctaattgtgctatcttttgctgctagggaaagagtcaatagacaaagactttgagtctttctactaggttaaggttcgggagtcactgaaagtgatttcccttctggggctcattaaatgatcaggagacatcaggccttggttgctttgaacattgagtagaaatttggcagataccttgcctatattatctgattctgcttagtggtgggtaagggcccattaggtctgggcagacagttataaagcacatggacatatggcactctccaatgcaaggctacctgcttctgactggcccagagcaaagaccagattccttgagttccatgagttctactttgttatgaacagatgatgactttgccactgggtaaaagtttctctcatgagttcctattcatcttccccattcctttccctctgacagagcagatatcctacgttccccctctatttttgtctgtgcttgctgctagtaactacttgtagacccatccagtgggtacccaggctggagcataagtgtcaaagaaagaaaacccaaggacttcacccttacatagttccttctgtatgaaatccacgactcatcttcaactttcacagtcttcttatgattgtctgctttcctaaggtacctacctagccgtaattacaggagaggaaccattattccaaaaccagaagtctaacttatatttgttttaaattatgataagtgatagtgtctttatatttttgcatttaattctttatataatatcaccattttgaaatccatttcatcttggtaaacatagatatatatagtgcattcattttaaatactgtagaatttgctgttgtgtgaatatgcagcaagttgtttatttgttctcctgctggtgggcagtgaagccgccattgctttataaacaaagccaggataaatgttcccatacatgtctccttggatactgactgtatttgtggaaagtttatctgagcctgcatctcaagtggaactgctaagccataggagacatagagcattgtcatcttcatcagatattaccaaactgctcaacaactgtgcatgagatactttgttttgtcactgaaacctgtgttaaaatagtcaatttgattctcctttaacttatggattgggttttgacttgtttaaaaaaaaatcattccataaactaaggtcataaaaatatcttcagtatttgcttctacatttactccaaattaggtctttagtctttatctgtaatttacttttgtgtataatctaataaaggaatattattctactttttccaatgtcgatagctaatttttcaacgcaattaattatttatttagaattccacttcaaccatatatcacactcccattttacttatgttgatcctgaagtttacaaataaccccaaatgatattagctaaaatattgaatttaaatacatgtattacaataaaataaaataaaaccttattcttaatcccactttctattattactggaacaaaaagattagtactgattaagtccctactaacatcaattaattactgattatctattaggtactgctaggcaaattaatgctaggataattttaatttattccttgtaacaacattgaggagccatgatgtcatttttctattacagataaaaaatacaaaaatgttgaaagtcctgttgcaagttgcatgttgtagtagtatgattgctcatcatatacagggacttgaggtcaaaccccaattttacaaacatacatacatacatacatacatacatacatacatagcttgtcttggttcacacagtgaaattgacagagttcaaattcagctccaggtgattgtaagtagtgctttgtcttgctgctttactgcactattatattagttacttttctcattgctgttacaaaatacctgacaagaagcagtttacagaagcaagagttcatttcagcttacaacttgaaggcatatcatggtggggaagtcatggtgccaagagcttgaggtggctggcccatccacagtatatccacagtcaggaaacaaggagatcatgattttcatgttcagctagcattctttctatccaatccagaacctcagcccctagaatgttgctacccacagttaggatgtgtctccccacctcagttaacctaatccaggtaactcttcttaggtataccaggaagcttgtctcctaagtatttcttagagtctatcaagttgaccacactagccatcacaactatctttaagagaaatgtgacatccctccactgagaaagatacagatttgtacattataagtaaagtatatttggcaagtagtattgtgccttgaatgaccaagttcaaagaatgactgtcttgcactttatatacttgatcattaggaaacatctgcctaggatgaattcttggttactcttccatcacctcatttctctatctctctatcccttacttcttgaagttggaatatataatttcattgtcaatgcacctcctgctaagatgaagctttgaggaggaaaagggcaaaaaaacgtatgatggttgaatcacttatccttgttgtaatttttatacaagaatggattctatccattaaaggcaccaaatgtagtgctgatatgataacagcctttgcatgattttatcatattatgataattgatttcttattgagctatcattttccctcatttaaaatcaatgccctaatctaagactgttaagaagttataataagtagcaaaaataagggatttggtgtcagccttaaatgagccttttactgaaagatcctagagctcttcatgtgtggagcaagtggaaccctgtcaccagacaaaaactaagaaggctgagctgattcaaaacgccagtaattctcatatctgagaatactaggcgtttcatctactcctgacccggtttctgtcctggagcatgtgaccacaacaccccatatgaggatcgatcatgacaactagttgagtagcagagcacagcattctccatgctaatgaggtgtctagatgggccctgaggttttagcaaataagggaacttccaggacattccttcctgcaaaaggtatttagtctctggtctaccctgtgtaagtagtatgcatccactgcaaataaacagtttagtaaatcaaggactgtctctctcatcaagagaaggctgtgggcaaagccttcgtcatgcagagccatgttgcctaagtctctgcgctccagatactcacccttaagctaatctggattcctcttcccccagagcttatggttggcccacgggccccttaattctcaactccttgtggtttccagctgggtgcccaggagaatgggaaccccaaccttgtcctcagcctgtgatgcttctcacccaggctgggatcttgggcagtgttctgcctgaccattcctcaagcccagcccaagatggaatgtagcctagcacctcccccattttgtctgccagagcagcgttcacacaccccagcggcaaggcggaaccacattcatagaggtttaattttttatctgtagactggacagtaatcgaaaggcgatgctagaattaaatcaaatggcacttgaaaatgtactttataagatactgcatgctgatgttttcatgtatctactgttttctaacttactttttatatatgtctaccactagtaccctgctacatggccctaatgctgccagtttcatagtaatcactgactcctgacccttgtcttcagattttatttagtagatctgagatgagtctcagaaatcttttttttttcattctctccaaataatcccttaaacacaaaccagatatgaggcagacacacttgttctggaacacttagcaccatatatacaagaaacaatttactgcccctgactgggattcccagctaaaagcaggttacaataagaagttgcaaaccagctttccttaacgctccaaattcctacccctcctaggttataggaaacccagcctcatgatctcttaacacccccctcccacttctgtgactccagctgcatcctgagtacttcgaagcaaagactggtaaattgagccagcaattattgccttttaaaatgattttgagggttttctttgaaaagtcttagtcaataggaacagaagactatgaataacaccaaaatatttagctgtctattgaaacttctttacagtatcatgtaaaatgggaacagatgcaactagaccaaagcttggttagtaggtaacagatttatggacttgctcattttaaaaattaaggttataaacaacatatgtcaaaatcctataaaactgctctggaaagcgtcttcctagaaagcccaaatccctgttaatgttctgaatttgctttcagaactgaaagatgacattgtatacatatgcttaaaacaatgcttccttgaaacaaaacggactctgtgtgggtgtgcattcagtagccacactaaagtttcaagcacctagtctcttcccagaatggaatctatccaatcccttgagagaagaaagctttttctatttacaaatacaggtggtgttgccatgagttacagttttctggaagcctttgcacatagctcatgcttttaagacaaaggaagtcatatgagagtgaaatcaccaggtctttggtctatcctgaagcctagagacttgagaagaatctcaattggctccttttccttttactgtcacatctgcaagtctcctgttgaagctctctagtccactgttccctctaatgaagtcatgttctgtgctcagggcagtaatatcctcagaagcagatgtctcccataaagcatgacctcattccttggaatgggaaaagcccgcagtcgactgttggggtaatattgggaaggactttgtttaaaaatagtttctgtaaataatgtgttcaactttttatatatttctattaaaaggcaaatctagtttgttgctgtttttttttgttaaccttgctcgtctcttccagaagtagcagtcactgagctagaagtaacagtcctcacagagctcagacaattccacccagttgttggggcagatgggcaaaacttaggatgtctagatgttaaatctatgctctgtatgagaccccactgagtcacaacctacatttcataatatccctggagcttaggaaaaacaagccaaagtgtccaaggaaagttactgatccagatgttcccaggaaatgaggcaagtgagagggtcactagacaaggaaagaactgaggaaaagaacaacaattggaagcatgcagcttaaagctaatacaaacttgtttagaaacatagatatatggtagttcctagacactggcctctcaaatcacttcagaaaactagaatatagaaatagaatatagaaaactaggatatagacatagaatatagaaaactcggacgcccatagccttttagttacaacctgcaaatgccggtgtgctcctcacttctctttgtgtctgtgaataaggtaaatgcaaaagaggaataaaaggtctaaatattgaatttactaaatatggaaggattttacaggatcataaggcaataaaatacatatcagttaagcgtgatacctgctacttgtaaattaattactatattcccataagatgtctgtttcaggaacatctatgcattaaaaatgaagaatgctaataattctatgaatattaattgatgagaataaatattgaaaatacatttcctttcccaattcccatattagtcaccttggctagcaaccagtccctttccaatgatctattaaagctgcatcctcaccatagtgcttttccatggcaaacctcccaagaatccatttctccttgaaacttttctccacactctcacctttcatccctcctatttctaatgtcgctggagataacattggcccttgataagaaagtcttagagaacatttaaaaagaaaccatgacaggtttttttgttgttgttgttgttgggttttttttttttgctgctggtggtgatgatatttataagtgtgtgtgtgtttgactagcacggttgagagaactgttaaaaatgtaaactagactaaaactgtataccatttatccctcagaaaagtgcaacaaactaggaaaaacagaattgtttttattttttgtgatattagagattgaacacaaagccttttgcatgctacacaagcactatactgttgacatgtatacccagccctgtttgcatgtgtgtgtgttttgtgtatatgttcttgtgtatgtgcacacatgtgtagatgtggagatcagaggtcaacgttgggtgccttccttaactactttccaacatatgtttttgagagaaggccttcactaaatcttgagatggacaattccgatagacccaggaagtattctgcccttgcctccacaattctgggattataagcacatactgtcatacccagctcctgcatgactgatggaaaatggagctcagatcctcaaaattgtacagcaaacactttattaactgagccatctcagttaatattattaaatggatattattgggttttttttttcctaccagggtcatgcactacccaatgacatcctagaaaacaggagttatacccaaatcaatcaagttgttataaaaccaaacactcccaaatactataaactgttacaacacataaataaagaatggacgcttcctggctcattttgtgaaatggatatgaccttgataacttgtttccaagaaggaaacttaagatttctcacatttacaaaaggtcttaaataaccagtctggcaagacatagctactgatacactattgacatgaatatcatgggagtaaccatcttcattaggggtttctattgctgtgataaaacatgatgaaaagaaacttggggaacaatgggtttatttcatcttactgcttatagtccaagcaaatccgaacaggaactaaaggcaggggaactgatgcagaggccatagaggagaggtgattcttgtttattctccaaggcttatagagcttatatagcacaggaccacctacctgcccagaagtggcaccctccacactaggctaggccttcccataccaaacactaattaaggacatgtaccacaggtagaaggcatttgctcaattgagaatccctcttcccaaatgactctagcttgtatcaagttgatataaaactagccaccacagtaaccaactactttctgattagatttaaggttcactccacagaaggaatccataccgggtaccattatcaggagcaaaaagcccatggctatatagatcatcaacctagggaagagcccaatgctattattactatgctcaatgaacatagtatgaaatcaactcctagtgaattttaattatacctatgaattagtgtatctctcacatgttatcagaggtgttgctttttacaatagattatgattaaaatctgagacccacaactggtcaaggtctagaaaataggagactataaaatgcttagcccttaattggatcacacctcctcctccacccaagacttggggatcattgcagaagaaggagcagaaaggttgtaagaggcagtagatgactacgaggaaatagtgtttgacagagcaaggcagttgcccaaatgagctcactgcggttgtaacaacatgcccaagacctacatatgctcaagtcaaacaaaagtccagcatggagagggtaggtgggcataaattcccacccctagctaaagagctattggtaactggtaagttctaggagaggaaaagtcagttttcttttaggatgttgacccttggttagtcaacaaagatccattggaagaccacacacccaggagtttataggcagcacatattttatttgatgggttttctcttattatttaaaaaaccaacgtggacccagaggaagttggacaaagggtgaatataatcacaaatactgtattaaatactcaaaagaactaagtttttatatgtgaaaaagaggttgatagacattatagaaaaatttctagagattttaaggttattttctttgtcttccaataaaggaataatttataaaagccatcagaaaaatctgaaactagcaaatcaatcctgaaaaaaatattcactgtattatatgtcatgaccattttgtgctaggaatgtaaagacgattcaatgatatgaaaaagtttaatagtgcattacatcaactcaaagaatataagtcaatgatcatctcagataaaaggcacttgataaaaatttagcatccttttatgatacttcttagtaattgcagcatatcttggtctaataagcgtggtgcttagaggccatattactaaagttgggatgctcaacattattcttgaattctttttttaagatttatgttattttgtgtatgtgagtgttttacctgcatgtatgtatggacaccacattgacatctgatgccattgggggccagaagagggcatcagatgccttagaacggcagttacaggtggttgtgagccagcataaggtgctagaaactggacccaggtcctctggaagagtggcccatgctttttaactgctgagccaccttgaatttcttattaatacaatgaaagaagtagaaatatcagagagttacataaacactcctcacttactaatcaaattctgtagctagtaaacacaagaaatgtaactgaaaagatactgtaagtagaaagctccaaggtggctaggccagaagtgtccatttcttataggacgaggacagtatcagcaaaccttctgttcagaaaacatttgtaagttgaatatagttgaaaaactcagctggaaaattttttataggcagttagatcctttaaggccatttcagcatcatgtatgccttgagatcatgaccctgaacagcaattggtattagataaaaaggcctggttagttgagctttctgcttacttaggtttaaactgattgatgtttgtactagatttttccccatagtgatgagtttatagttatttaatgtccagaaactattttatccactttttgttatcttgtataatccttaaaacacctctgtcaagtaaatgtcattatcccagttgtacaaatgtggctgcactaactcagagttgcaaccatttcctcattgtcacacagcacttggtagagaggagcttcagcttggatgtaattctgtgacttcagagaccatgccttttccaacaccagttcccatccgtgcgcacagtcttccctccaagtatttcctggaacgtaattggaaaatgtggcaagatcagtaatgaaaacagagaaggcaagaagagaccttgttgaagagtaactagttacctctactctagggcagtcactaaatgactagagtacgctcacactggacagcagaactcccctgttgatccactgtaagaagaatccagtaagtctcagaataagcctcatctctggttaaagtgaaacagcatgcacagcggcagaagaactagccatcttgaactgttctgggacccaatctagagccatattgtagaaatgtggttctcagtgtaaccagtttgtggtttggctgcccagcagttgcggctgtattcctcaaaggcgaggcttacaaaattacttctgggaacagcacatgttacctaccatctgggatccttcaacccatggataggtttaacctgtccacaggaagatggtgtagctttgattaattacatcatgttccaacagtagattctctctgattcctgtgctttgttgggcaggaatatttggatgatggattgctattataacctttaacatatttaatgaattaacacatctcaactactaaagcaatccatttgattcatatgcatgcagctcaaaataattccttgaatctgcttaacacttcacactttcccaaattgtttttatttctattgtctcatcgatccacagaactgaaagcttaatacctcagattttgaacccagataaaggagaatagtgcaattagtactcagcatttgacctaggtcacggttgtcaactccagccaggcagtagagtctccagaagagcttttacattgttttcatgcccacccagcaggctgacagcatcagaatcctcaggacgggagtctgtgcagtgaaaggtgttgactctcttcaggtaattcaaaagtgtagccaaatttgaggcaatgagtttaaatctaagtcctgggtgacaagaacacattcaaatttcagtgtcaccatggtagtcagaggctgggatttagaaagtagcattttctataagggttgaatcttagaacagactgtactcatgagaaagtatggagaaaggagaaaaacaggagcctgaagactaacctttaatattcatagtggttaagaattttacgtctgttaacctagctttttggggaaaaaaaaagccgcatgatttcataataagaaaaacacacacgactaatcagaggcctttgtggagagaactgtgcatgtgtctaaggggatcaatgggaataatttatttagactttcaaaatgcctctaagtggcgtttgctagcaaaggttattatgctttacgttgtgtcgccatgcactacgaaatcagaggggccatccagggaagaggccttgaaaggcaggaataacgggcaggatgaatgcatatcttactagagtgagacacataaacagtagagtttgtaatctgcttctggttttagttaacatttttaaatactgattgcataaaagactgcagtaaaatctttaacaaactcctcagggctctgccacttattgctgtgtgacccctggcaagtctcttaacctctcttgttctatttcctcttcacctgtaaagtagtggctctggatctaaaagtctcctagaaattctatagatgagcttatcttagctcctctctctgcatctgaaatgaaagcaacacatgatcaagttctgtcattgattagagcaatggtaggaagtgactagcacagggtcaaggaccagaggaaccatttgttatacagaattatgcacgatatgaagttcattgtaaccagattggcaaagcactctttctgccagccatctgctggaacataaaaatagctttttatataggactgttctttataattggatttaacgtttaccaccgatttctttaacaatcaataaatttataaatctcttagagcattttatagttgaagcttgtgagacattagaggaaaaagttatctagtgcatatgtacatttaagagaattgtaaatagatgaagtgatccacctaaggtcagagaacaaaaataacactacagagatgtatctctggacaacttgtttagctctcttcaccttcttcctatacttgattccaaagcaataaatatatggctttagaaaaagttgagtccacaggacagacttatcttttggccatcctttttagctaggtatgtggtttggtaatggtggtaatgacatatgaatatgaagattatagttatctatgagtgcttagatattcttatatgctatacattttctcacttatcatttcttttgagatagatactatttttgagaattctacaggcaaatatatcacatcatttccatccctcttgctcccactcccactcctttgccccctccactctctctaaaattcatgacttcttattctttaactattgagctatatatgcatacatatttgtgtataatctgcttattgcatttagtattgtgcatatgtatatatatttaaggctgaccacttgatatttgataacctctggagggaagggcctggagaaaaccgattctccctttctcggtagacattgattgtatctcttcctctagagttggagtctggtgacattctgcccgtccatatttgcatgtcgactgtcactctcatcattcaggtctttttcaggcaatcatattgttaagatttcatgtgttcagcttcactatcatatatagaagacactatctccaagccctcatattggtactctgctgtctttctgtcctctcatccacaatgttccctgaagggttgtgttgtagatgtttcatttgggattaaacatcctgtgatctgttgctttctacatttgacaagtgtggattcctgtagtagtcttcatatgcttcaaagataaggttcttcagtgaagaataaaaatgacagggtataagtaattagaatgggtattagtaattagagaatgcaattacaaattacactagtgaaagtagcagtagtagattctcccttaggatccatgacctcaacagccacaggtagttagctaagtttacattaccaggcatgaacttctacctattgagtggaccttaattgcaattagacagctgttagctaccaccaagatataagtgccactatccacccttgagaatatcttgttaggctgaaggctattgtagtacatgggctttatacaggtattactattattaatttttaagtataactgattcagagagctaaagtaacttgcccaacatcatgtaggtattgaatgttagcactagaaatcaaagctggttcagaaaggataacaaggttaatgatctttctacaatccaattttcccaaagagtataagccagagtattaactcaacaaaaaaaaatagataactcttggaaaagattcttgaccaaacaagtttgcctttttgtctccatttcctactgctgaatttattgaaaatttttgagaagccttcagctgaaaaaatatgtatttttctttaatgctatgtttcttaaactctttttaaacaggtatttattttttcaagaacatctgctaatatcacatctctttcatattccctataatggaggactacaaaatgtataaaacttgggagataaaaacaggaggatcaaggtttcaagaccaacctcaactacatgaaaccctatctcaagatgccaaaaactagggatacaaaagtgacttagtaatgtactccttgcacaagcatgagggcctgagtttggacccctagcacctatataaaatctggacatggtagtacattattgtaatctcagcactagagaggtggagacaacgagatccctggaactcactggccaactagcctaacacaatcagatagcatcaagcaccagtgagagaccctttatcaaaaaccaaaatggggccagcaagatgattcagcaagtaaacacacttatcaccaagcctgacaacctgagttccaactctgcagttcatatagtataaagggaggacaggtaactacagattaccctctaacctccacacaaatgctatggcacacgtgtccctgtgcttatacaagcagtctctcacagagaaactccagcaataaataaatgtaataaaaagaagagaaaagaaaagaaaagcatggtggacagccctcggtaatgaccctgacattggcctgtggcctctacgtgcacctgcacatatgcccagacacgtgcacatatgagtgtacacacatacactcaagcatgcacacacacaactatttaaaactgtactacttctcaattcatcttcatagattgcatcctaggcctagcttttttcatcttaaccacttgtgaccaaagactcaatgttgcagaatgtttctttagcaagagcacatgcttgtcactttgagtatgtctttgataacgagaacaaacctatcccttatggaactttaaggcactattaaacttctgaactgtcagcagttagtggggctggtttactgttgccctaaccacagtaatatttttgagtctttcccaaaccaagacagaagtgagccagaaaatttcatagctgctaataagttaagtcatgtttgtagagcttgagacccagatatggacctctgctctaaagcatataaaggaaattattggatgaaagattcagaccctctcacatcagaaataattgagattagagtgggatggagtaggggtgggatcaacttgcacggtcctacctcttctggccctttccctcatgctcagagcagatgttggaatcataatctgggttctgagcatggacattccatgtggtttacattcagaattctcactcttctttgaagctaatggcttccatcttctacaaatgtattgggcttgccacgcttatctgtgcattctctgtttataattcttatggtataaagaaaaatattaaagaaactcttaagatttcaagatttgaagacataaactatgtaactacttgttgtttgttttgtggttttggttccttgggcttgtgggactaggaattgaccctaggctatcacttgaccgctgaactatacatgaagccccctgctttgaaataagaaatatctcgttgtatacttactcatctgctatccatcccttttctttttttttttaatctctttactgactggtattggggaacatttggtcatgcctagtccctggtgttattctctacataaagaaaagaagactacctgtgcaaccaacaaacaataaaatgtacatttatttgagtacttgcttcacatagatcactttcagtaatttaaactggaaaaaaaatgcaattgtgccagttgtacagatggtcaattttggaaactatttgtctatatacttggtactatggttaattcaatgtaatggaaggtgaagtaagttggagtctgaagaatcttgattcacatctccaattatcacctccttcagccattcatttcttcatcaaacaatcagtttttaactcctattataaaaagaaatgctttaggaactaaagacacagaggtgaacaattcatagctcttaccctcaaggagttaacaatattgtaagcaaaacaaacacataataaaagattataatctgagggctggataaatggcttagaagttaagagaactagctgctctttcagaggaccagggttcaaatgttcataactccagttccaggggatccaacaccctcacatgtacataaaggcaaaacagcaatgcccataaaatacaaaataaaaatattacaatgtgataaatgtatcagtacattatggaatacagaagaactggtatctagaaggcatcttacagggtgagcaggcactggaagagagtggagctgaagaagggcatttcaggcacatacaatggacagaggcaaaaggtgttgcatgttgggggtgtgcagctaaaatccatgctgaattacatatagtatggttttactttaaaccagtattaattttattaacatccttttatgattatactctatttttagaaagccacgatccacagaaaattaaacagaaacaatgttctaaaatatattctctctctctctctctctctctctctctctctctctctctctctctcttctcctccttggcaagtattcattgtttaccatttctccaatgtcacgtggtagtacatagacttttcagcctagtttttttcacttagcaatatgcatttaaattttctctgaatccttctgtaacttgaaagctcatttttcttattgatgagcaatatatcactgtataggtatatagcaacttctttatccgtcatttgttaaataattgttgacagtttgagtcaattatgaataatgttgataaaagccacctgtatgcaagttgtgtgatcacacatttctagctcttttgagtaatatttaacactgtgatttctgtgccaatttctacagaattaccaaaccattttcccaaatgtgccactttacattcacccaccagtgtgacggcaggacctgttgcttcgtattctgtcacaaattagttatcagtgttttacattttgccatttgtggactgctctctcctcatattaaattgcagtttcatcatggcaaataatatctttttccccatcttaattatctcctttggttaagtgtctgttcatatcttttgcccatttctttttgttcattcattcatccatccatccatccatccattcactttacaaccagattgtagtcacagtcccccctcccaggcccacccttacaaatccttctccccattaccctgtcctcttctacttagatgaagggaagccctccttgggtaccattccaccctgggacatccagtcaccttgtgcctatgtgcatcctctctcactaaggcccaactaggtggtccagttaggggaagtggttccagtggcaggtaactaagtcagagacagcatcactccaattgttaggagactcacatgacgaccaagctgcacatctgctacatctgtgcagggagagctaggtccagcccctgcatgctctttttttggtagttcagtctctgtgagtccctatgggcccaggttggttgaatttgtaggtctttttgaggtgtccttgatccctccagcttgctcacttctatcccccactcttccttaatactccccaagctctacctgatgtatggctatgtgtcccttcatctgcctctctcccttgctggataaagcatctcaggagacagttatgctatgttcttgtctgcaagcatagtatcactaatagggtcaggagttggttttcttatatggggtgtgtttcaagttgggccacttattgactggccattttctcaatctctgctccatctttatccctgctcatcttgtaggcaggacatatttggagttgaaggttttgtggataggttaatgtccccctccctccactggaagtcctgcctggctacaggaggaggccacttcagtctccatattcccagctgctagaagtctcagctagggtcaccgccatagactcctcagagtctcccccatcccaggactccagttactcccagagatgcctcccattgatttctgttctcttccccagtcctctaacacccacctctccccacacccaatcctcatccttgtccccctcctcaccctatctcccaccaagattcttccctttctgagtgacattcacccatcatcccttgggctctcctttttacccagtttctttgggtctgtggagtgtatgctgtactttatggctattatcaacttataagtgagtatataccatgcatgtccttttgggactgggttacctcactcaggatgatattttctagttccatccatttgcctaagaatttcataactcattatttttaatagcttagtagtacttcattgtgtaaatgtaccacattttctgtatccattcctcttttgaaggagatctgggtcctttccagcttatggctattatgaataaacctgctatgaacatagttcagcaagtgtgcttgaggtatagtgggtgtagcccatttcttaatttgattctttcttaattattaggttttctgtttagatgtttgccggttttgttttgttttttttcccttgggtttcaaagctttaatttcaaatatcttttggatagaagtagttatatgacatgttccatgtgtttttgcaaatgtttctcatggttcttgtttgtttgggagttttgttttttgagacagtgtttctctgtgtaaccctgcctgtcctgaaactcattatatacaccaggcccgcctcactcgagagatcttcatgcctctgcttccatggtgctgagattaaaggtgtgcatacattgccatgcttagtagccacagctttttttttcttttttttttttttttttttttttggttttttcaagacaaggtttctctgtagtcctggctgtcctggaactcactttgtagaccaggctggcctcgaactcagaaatccgcctgtctctgcctcccaagtgctaggatcaaaggcgtgcgccaccaccgcccggcttagtagccacagctttttaaaagttcacttaaggataccattttctgaacaaattttaattttaaggaaagccaagttaacttttttctcagttgtacttctaattttctacctaaaaactcgttacaatggggaaagttgactagaggtttattatgttgtgtcatgagatttttatggtttttgtatttaaggtttgaccccttttgagttaattttgttaaaggcataaaagtctgtgtctctattcacttgtgtgcatgtagatgcccaggtgttccaccaccatgtatgaaaataactctcattttttctgttgagttgccttttgtcctttgtcaaagatcagttgactctattataagtctgtttctatgctctgtgttccgtttcacctgtgtgtgctatttcaccagtaccacactggtttgattgctataactttctagtaaattttgaatcaaagaatggcagttctccaactttgtttttatttcacaatattatatttgacagtctgtatctgttacctttgtgtataactgtttgatttagtttgttaatatctacaaagtaacttcctaagattgcattttatctgtatgttatgtttggaggaagtgacatttctgcaatattaagttcttttccatggacatgggctatctttccatttagatgcttatttcttaaatcaaaaatttttcccatatggatactcatattttgttaaatctatacctaaatgctaccctcctctctcattttaaggtaaatagtgctgtaatcttttatatcgaatttcagctgttcattgctgatatttggaaagaatttgactccagtatattagagtttaaccgtgaaacattatgttaattgatatttagttccagaagccttttgtgagattttctaccagaaagttatggtatttgtaagtagacaggattaattcttccttttactttatttcttttcttaacttgtcacatgagctaagatttacagaatgattgctgaattatagtgttgcgaatggacatcccctactcgttcttggatctaaagggataacttctggttttctcatcactatgctatacaggatttcttatagctttcttgattaaattgaggaatgcccttgactcctattgggtggaatttttcatcataaagggatgtggaattttatttaagatattctctacatctagcgatatgactatttgtttttcttctttagcttattgatataaggtagattcaatagattaattttatgctattccagtcttacatatgagaaataaatccttcctggttgtggtctcagtacattttctgctattttaatgaaatacctacagctagaaattttattttaaaaacttatagaaattcatttgttttgttttgagttagtatcggcatgtatataatggtggttagcttttgttatcctgacacaaactggagtcacctagagggagataatcccacaagccagtaagcaatcctgccccttctccctcttgaattcctgccttgacttctcttccgactgtgactgagatgtgtaaatcaaataaatctttcccttctcaagcagattttggtcagtgtcttatcatagctacagagaaacaaactagactagaaatcaatgccagagagagtaggtccttgctgggaaggatctgaccatgtgacttttatgccttggaatgtgttgtgggagaaatgtggagaattttggagctttaggcaaggaaaaccattgagtgattaagcttaatgaactgtatcgggaatttagaagatactgctaagagaaatacaggtggtggaggtctggcttgcgaagtttcgaagggaagcaaagacctttaacaaggctgttcatatgatagtttggattaagaatttctggaagtaaaacctttgtttaacggaaaatgatatctatatttctcaccctgcataaaaaataaagtccaaatggatctgggatctcaatgtaatacctgaaaatttgaaattgctagaacatgtagggtgtatgccacaaaacatagtcatatgtacaggatttctgaataaggcactgtttgatcagaaaaaaaaaagactaacaattgacaagtgggactctattaagttaaaagagtggtcagcatctgtagccaccaggcaaatgcaaatcaaaccccaccttgagagtccatctcaccccagttctagtggtatgtaggagaaaaataagcaacaaccaatgctgagggtgagggtgtcggggaggagactgttgacagggatggaaacttatacaactgctgtggaatccagcattgtgttcctcaaaaaggctagaaattgcatctaccacatgacctgatgactagaccgttcctgggtgtatgtccaagggactctctattctccgacagaactacctgcccaactatgtccattggtgattccttcacaacagctaggaaaacaaatcagccttaacagtgtgctggcttatttttttaaacttgacacaagcaggagctacttgggaagaggaaacatcatcaacaaaaatgcctctaagcagactggcctgtgggagaattttctagaacaatgatgatgggagtggacccattctatggcagggcaatgccaccagcgagcatgttgtcctgagttatataagaaagcaggctgagcaacccatgagcaataagccagtgaacaacattctctatggcctctgctgcagttcctgcctccgggttcttgccttgagccttgatttccctgagagttgtaagctgaaataaatcgtttcctcctgagttgcttttgattatagtgttttattatagcaatgggaaccctaaataaggcatatgtcaatgataaagtgataatgaaaatttgtgatacagttgcaaaacagaattctctataaagcactaaaacatgtaattatgaattttttaggaaagttggtgaaactggaaaaattatgcagggggaaaggcctagaaagataagcactgcatgttcctgctcatttcaaaattttagatttttgtatttaacttggaatatccagagagcaagaggttttataatggccatgggttgggcaaagaggcttgaatggggcaaacagtgagaactcatgttaattaaagtacagagggaagactactatggtggtaaggtttaaatgggaaggggttgtaaaggacaaaggtcaggaggaggtagagacagggagttaaccaaaactaaggttataagaagacatgtagacatctccctatgtggccacctaacaatataggctgttaccattattcttggttgcccaccagaactagacaataatactctatacctgaagacatcacatacctccatttcatgacacagacaaatcaatttggaacttaagtagaagctccctccctattggctaatatagattgtgtcaaaaatgcaaaataggctgcccggggaggaaactcatcaatacaaaactcatcaatacaaaactcatcaatattttcagccatatgtggaccttgtgccctacaatgccacctgcctaccaacacatgcccactggtgcaaatgaatgttgtgagcacagcttcagactctgtgataaatttgagacctgctcctcagaaggaaatccatgcctggtactataaacctggttttaaaaaacaaaactcatggagtttgctaaatgaatatggcatcaaaccactttctaaatatttatacttagatttatacagatacacacatgggattctcagctttgagtagagaaactttttataatgaatagcagcgagtgaaaactcagggctgagagtaattgactgttgagtactcaggcctaagcaataccacctcttctgtctcagggaacatcatgacccaagggtaaaaagaatataagaaccagatgatagggagaagggctgtgaaatgctaccttctaggcatgacacagtctttgcagttgtgaactcagcagctgcaagttgcctatactggatctgcacaagactgagcctgtcagcagtcagtcaggaggcagagaagtacatgagcccacccccaaccccccccccccccgttccctgggaagctattggctttttacagaggctcagggaggggagctgtctcccattgtgtagctgctgatgagcctactgtgctccagtggatccaatgtccatggtcacatggcagccctggctatcatttcttccacagatccttaagctataaataaggaatatatatttgctattattattttgaacaaaagtattatctactaagttgagattaaataaagtgtttaaggcatatttcttcctgaagcttattatttttagcttttaaaaataaaatttaagtacaccattttctccctgccctttcctccctccagcccctccctgggcctccttaccttgcttcctttcaaagtcatgggccttgtcagagcaacctacttagtccattgagtgcaacttagtgttgcatgtgtgcacatgatttcaggtcttggataatcaactaagagactcatcgctggcagggactagttctcatcctctcagcggtcatttctttgtctggatgatgcctgtggactttccccttcatctggtatgtctgttggtgttacacgtcttcagatctcctttctttagcttcccttatctggtcttcttctttagatccaaacttctgccctgtgtcatactcgttctctgttaacatttctttaaatctactgtcaataaatttcctcaatttttatgtgttaaagagtccatttctcccgtttttaaaaagataatttcatgtgatacatgattcaagcttgttagtttttttttttcattgatcctaattctcaaataaagataaagtgtgtggtgttccctaatggagcagacaaagaatgaggtagaaactcacttgccttagggttattttgtttttagctgtttgttagccccacgtctatcataaggcatccttttcctaatgtctgcatatgttagcaaagcctgtctcatctccactttacttttaccaaagcagtctgaactactttacagctggctgtcccactctgatatgtctgtggagttttgcatgtagaaaatatggtgtataacctccccagcctgaaacctgtttgctcaggtttcagtgttagagagcattgtcgttctgccactcccactgcctctgcctgtccctagctgttccagagccaaacacgtggtcacctgcaactttactccagggtgatttggcgggaatcgggccccttcccctgcttcataaccgagtgtcagaagagtaaaatcgagctttgatcagaacctagtttgtcttagcttcgttctttctctcgtctgcctaggcccctcttctcttccagattccaagatgccattccagactagaacccagacttgtgagctgctggccagccgcaacaatcgtggttacaaatagagggaatgggaggatatagaaatgttggttcttatcatgaaagcaacacatgatgatggtagtactatggattagggaagaataaggttctgaagcatattaagaagacggatcattttatcttaaaagttatggaattgaaaagaaatggtctctgttacttagataccgctagtatgggaacagctctagctcaccagcatttcctctctagaaacaggaaacctacagtgacctcaaagagaaagggatacatgtgacaattaaagggaggaattttgaaactcataaaaaatgatttgctggccatagtaatcaatgttagaacaaagaggaatccttatattgttgagaggatatactcattggtgcttgtaggaaatatgatatattgtaataatattatgtgccccccccacacacacacacaagggatatgacatttgcttactaagcagaagttctatgggagtccttctgtgaccagaagtgaagtagaggccaggatttggagcatcagttctatatgtgacctttatgttatagccatttagagaaaaagaaaaatttggctggttctttacctcctcacatagtacaatataattcctgccacattaatcacaatttagaaaaacataaaaaagctagaaaaatatccaaaaatgatacccatgtattactttagggaaagcctactaagcatgaaaactgagggcagtaaccatatatacttaactacataaaaggaaagcttttatagtctttgagccaacactgctatttataatgacacattctttaaatattttgataagtgaatgaaatgatacacacatgaaaacattataatttttaagcattgtttataattacaatttataatcatgataaaaacaaagatcattaattaaatgcctccatattaaaaacaacaatgtagtttgaaagagtagcagggagacaaaacagggtaatggaagtagtgaatggatccgaatatgttatgtacatgtatgaaaacagcataatggaaccattatgcataatgtatatttgctaataaaacttttaaaaaagaaatcagttgaaagtatatttgaaaaatggatattccaatgaaacacatatatctgaatattcaaaactaatatccattgggtggactgtagtagcacacacctaccactcaggaggcaaaaccaggaggagctctgtgagttgaagactggccaggtctacatagcaagttctagacctcccaaagttacatagagagaccctgtttcaaaaaaaaaaacaaaaacaaaaacaaaaacaagggctggagagatagctcagtggttaagagtactgactgctcttccagaggtcctgagtttaattcccagcaaccacatggtataactcaaaaccatctgtaatgagatctgacgccctcttctggcatgcaggtgtacatacaaacagaacaatgtattcataattaataaatctttttaaaacaataacaacagcaaccaacatccacaaacgacagaggaaaatacaagacagttgcctttctgagtctgagttacctcacccagaagtttgtttgcctgcaagtgtcatggttttgtttttaacagttgaatggtactttgttgtgtagatgtgctacagtttcattatccattcaccagttgatggacatctaggttgtttccatttcttggttgacccactgagtgtaatttgtgcttgccaaaatactgtgtggagcactggaacaaggtagacctaccaggaccacacccttaaaactgactcccccatgacacctccatgctgcattgttgactggcttggtcttctacagatgctgcatagctgcaatgaatttgtgagtacaactgtcctgtcacattcaacaaaacacctcgtgttcttacagtcttttcacagtcctcttctatgatggaccctgggtgttatggggaaggggaaatatgttaaatagttgtcttagttagggttactattgttgtgatgaaacaccatgatggagaggaaagggtttattcagcttatacttccacatcacagttcaccattaaaggaagtcagggcaggaattcaaacagggcaggtacctggacacaggagctgatgctgaggccatggaggactgctgcttacaggcttgcccctcctggaggaccaccagcccagggatggcactacccaggatgggatgggcccttcctccatcaatcactaattgagaagatgccctacaggcttgcctacagcccagtctcctggaggcattttctcagctgggactccatcctttcagatgactgtagcttgtgtcaaattgacataaaactagccagcacaatagtttgtggctgagctctccactaacacttattccctgcactttgaccacttgtaagtttctgcaataaccatccactgcacaaaaacatttctctgatgggctctgaaagcagcgccagtctatggttaaggagatagcaatttagagagcagtgtgatattatatctatttaagaaagcaaatagtaggtagatttaccctggagtctatgagctccccaaccatagatgctcggcaagatttttttaaatatttttattaggtattttcctcatttacatttccagtgctatcccaaaagtctcccataccctccccccccactcccctacccacccactcccactttttggccctggtgttcccctgtactggggcatataaattttgcgtgtccaatgggcctctctttccagtgatggccgactagaccatcttttgatacatatgcagctagagtcaagagctccggggtactggttagttcataatgttgttccacctatagggctgcaaatccctttagctccttgggtactttctctagttcctccattggggaccctgtgatccatccaatagctgactgtgagcatccacttatgtgtttgctaggcccgctcggcaagatttatagtagaaatctttttttttttttttaaattctctttcctaagtcagatgcagtgtggcacatgactgcaaatcccaacacttgggcagggagaggagtgtgaagcaagaggattgctctaaattccgagttcaagaccactatgggatacaagtgaattccaggctagacagggttgcatagcaagaccttctgtccaaaaccaaacaaatgaaacgtgtcctctttccctcttatcacccgtgtgtttaaggtgaacctgtttttaagtttttttattcctcaactaacaagcatgactcccgggtcccccttgaatgaaaaatactaaaagaaaagaaaaagaaagaggaaaggaaatattactgttcctagttgtggtgtaggagaaagtttactgtatataaaaggtagaggcagggacttctgggagagtggacatgaccctgagctgggctacgtggggagagggaggagaaagggagagagtggggagagtctagccagatgcagcacccaggaagcccaaaggtacaaaaagagcaggtaaccaaaatgtctagattgtatagggaagagcagcccagccccctggactagagttcagagtagggagtggggaggggtatgccagccaggagagccctgtaacaggtagggactaagggatacctggagaacctgatggccaggttctatttgatatgttaaataggcacttcagccatttgtcccaggtttgaaacctaacactcctatccaacttgtaagttctatgatgatggtgttctggcactatttactgtgctaccaccttccatagggatactcagaaaagaccagctgactggtgatgtcctggattgcctcagaatctggtgcaacagctctatcctttagctagcagaaatgaccaaaaagtagagcagggatatgccaccttggctgtaagggcagggcagctgcagtagccaccaccttgcttatgaggctggagtaactaactggccagttggtagctagctggtggggatgtgccctttctgtgtaaatccttccttaaacagctatcttattcaagaacaaagcgcttctctggttatgttgttgtttctcactcagtcatagccatccagaatgcttaatgctgttttgaaaaacaacatacaggagccaggtatgcctcatgcctgtgccccagctctcaggagactgaggcaggtggattacagttcaatgccaacctagactacacatttaaacaatatctcaaaaactcagagcacaaataaagatgacaacagagggagaaaaggtgtgaggagacagaggatataaaaagaggaaaatcatgatcttcaattgctccactgaacctgaaacatcttctgcacactgcacacaattcctactgctgcacggttctttttgagagaaatctaaacagacattgaggttttgaagggacatatttgctctggggccacactgaagatcttccaggttagagactctattagcttcctatgaaacctgatttcataggtggaaatctttctatacttttacaagaatcaagttagataatacacagaagcatgaaacaaactgtagactacagaactgctcctaaggacattggctgtggtttagagctaggctatattggcttcatggcagtttggaaaagaatttaagtgcctgtgtctaggggaagttatattcatccaaagaaagaaaaagcctgagtccccatgaataaaaatgagctctgttgattaaaatggctttctttagaaacaatacatgagaagacacttccgactctactacaaaagaagctgttgacatttcctttagagcacccattaagttatggcaaattgtgggagtgcatgtggccccacatgaatgtattacagctgcatgcttctaataactaacaagttaaatcacaataaggaagtgactgagaaggaactactattgttctgcttcttctataagaacactgccttttctcttctagtgtcccaatctgaaactttgcatcactactttgcctgaatgcatgactctacaaccttaggacttgcagaattaaaggaatgccgtcctgaggttgttgagctgtgcgtttctgggcctttcatctctacagaagaatacccttctccctcctgactaaagtgggaagaattgttatttttcaagggaagcatccttcgtgtattttgttctagtctctataatcagcaaacaaggattttgatagatggatggtagctaccttggctaaaatctggaccatgactatgggctcctaaatttgcagtgcctcttactggatttttagagaataaccatttttaaaatgatctactaacttaatcttccatcttttatttctaataggtcctgttaaaaacaagaaaaagggtaagttgagttttgtgattttattaaattgtcatgtcatttttaattagaaaaaaggaatgagacaggattttgcatgaatttctttcaacatagattgcccattgcttcattcaatcattcacatgagttttgcactttataaagaacaagaattagttcttcaacaacaagccatggaaggtagaattgactctagcaatacatacaagttgtccttgtagaatcatttatttatttatttatttatttatttatttatttatttgtctgtttatttgtttgtatatttatttgctctgtgtatcttcttcctcttgcactggggatacaatccaggacttctgccctaagaatattaggcagaagctttaccactgcattctactccaagcccgcattgtggttcttctttcttattccttttacatctgtttccagttcatatttatttccttctcttgctctgtccactgccttctgttttcttctttccttcctttatcagatcagttgtcaggcattaatgaagacctaagactgtttatagagaaaagaaacactacctatggaaaggtaccatcaatgatttggtccttcaccttaaagctgtcaaagatgatacctcttgctctgagaatttagcatcatttgctcagtgatagaaataagaatctatgccactgtgttactctgctcctgtcctgtttttaaagtagatgctagttggaactattcactgtgctgtccttagtttcttaagtccactttgtacttaacaagggacttgctaagggcacatgaagtacttgcttgcttgcttgcttgcttgcttgcttgcttgcttgcttgcctaaagaagataatccaacgagaaagcaggttgtattgtaaagactaggcaaataaaattcaccctttgcactagaaaaaaaatcaactgtaaaatcagtttatgtacctgtctgtttctgggttctgacattaaaggaagacagagataatatgaaactaatgagtttccctttagaaatacttcctttttgcctttgtctatatgatactgggaatttaacccagggctttacatgtactagtcagatactctattattggactacatcactcaccctcttattactttctttgaatgagacatgatctcacttcattgtccaggctggccttgaatggactctgtagctcgaactgaccttgaatttagtgatctgccctcataagcctcacaagtagcttagattatggaccttacagttctttaccaggggtacagacataactccactgttaagagcactcattgctcttataatggacttgggtgtggtttccagcatctccttgatggctcacaaccatctgtatctccaattccagggaatgcagtgctgctttctgtcctcctcagacaacaggcatgtgtgtaatgcacatacacgcatacctgcagggaaaacacttagatacctaaaataaaataagtaagcataagaaaggtctttaagtgatttttgtctgtttatatttatggagcattccaaactgcacaaaatggctaactacagaggtagcttggcgatcctctgagcagtagggtactcttatcacttcaggtacccttagctacgtgtcaaactcatgttcctactgaaaaagaaaagctggaaaaatgcccagccttctgacgacctgaattgagcaaagttagtaaacagcagagagccagagtgagtgcagaatccttctgctgtttcctgggtgctcactcccaggatgcttcatcttttaaagaagtaaatttgagtttagagtattgggttcttgagtcttgttgcatcccttcaagatagaaattatagctcgtgccattgcttagcattgccaccttctgtatggaacattattgagaagaaaatgtgtacaagccttaaccatctactttatttaaaagtgatttagaagccagttaatatgggtttccttggacacagtgaataggcacatgcttgaagagggaaattgaactgttcacttaattttcaccctttaatggaattttcctactcacataactctctccctctcttttcacgttacccccaccaccaccaccaccacctccctttactcagttgctttccattgttctttcaacatttagaacttagctgaagaggttagggaaatgcccctttgatgaaatttggctctgaaatgatattattattttatctaagactgcacagcttactttctcagtataaacatctctaggcttttgtatcatgaagtattctgtcaaagttaggaaatctaaagacagaattcaatctcttggtccagaggtcattttctgcatacccttctctgtccctaactttctttttctttttaatttttttattagatattttcttcatttacatttcaaatgctatcccaaaagtcccctataccttacacccgccctactcccctacccacttgctcccacttcttggccctggctttcccctgtactgaggcatataaagtttgctagaccaaggggcctctcttcccaatgatggccgactaggctatcttctgctacatatgcagctagagacatgagctctgggggtactggttagttcatattgttgttccacctatagggttgcagaccccttcagctccttgggtgctttctctagatcctccattgggggccctgaggggcttccttgtccaagtgttgagaatcgaagagggccagctgcagaaacagacttcagcacaggctttttctcagatgccttctaacattttcataagggatcactctctgtttacactgcaaccattattctcttggactagaggaggctctggatgtagttcttctaaaatgacattaaacaattataggggacacacattcttggagctgaagtttgtgatacccacagcacccttagctggaaaatctctgtggagcctgaaaatgctgcaacccagcacatccaacttctgtgtctactccatctatgtttttgtgtcaatttctttgtctcttccaactggaaaataaggagggaggcagacactttacatccaggctttggaagttttcccagctgacattagttcagtctttcttgtggaacctcagtctcaagaagagacataaagcaccaaggccaagctccttgttcttgggttccgagtgcctgtgtggaaggactggagtttacatccttatctccagagtccagatcctgtgttatttccactatactaactagaattgaaatttgggtgccgaataagcctgaattggaagctacacaaattcaaaaggagatgattttcctattcagcatcttaaaattggctagatctagaaactgggcagatcccatcttaaccactaagctcagggcctctaagtctttaaggccctatacgccctcttgacgaaatgctctcagaactactctttcttctctgaagaggaagtctgtgatagtttatatattcttggaccagagagtggcaccatttggaggtatggccttgttggaataggtgtgacctggttggagtagttgtgtcattgtgggtgtgggcataagatcctcaccctagttgcctagaagtcagtcttccactagcagcctttggatgaagacatagaactctagctcctcctgcaccatgcctgcctggatgctgccatgctcccaccttgatgataatggactgaacctctgaacctgtaagacagccccaattaaatgttgtttttataagacttgccttggtcatggtgtctgttcacagcagcaaaaccctaactaagacagaagttggtaccagggcctggggtattgctgtgataggcctgaccatgcttttatttgaaagaatgtggattttgggactttggatttggaaagcagtggaatgcttaaagcatttaaaatggggcttaatgggtcatcttagtaggaatagggaagactttgttgctgggagtaatttgaactgtgttgacctggcccaagagatttcaaaggagaacaatttcagaatgtggcataaagattgtttttgtggtattttggtgaagaatgtggctactttttgcccttgtctgaaaagtctgtctgagactaaggtgaagagactcagattatttgcattgtcaaaggaagttttaaaaaagcccagcagagactttgttctctggttaagtcttatgaagagaagtttgaacaagcatagcaagcttagaaaggaaaaatataaattatatggttcgagtattaaaggcataccaggaagtgaaatggagcaaaatcttgtgttctaggagataacagattaagggagtgggaccttggggcaagatcctacccagctaaatttagatccaggcatggtggtacacacctttaatcccaggagacaggcatgctgatctctgcattcaaggtcaatctgcagagcaagatccaggatagccaagcttaggcagtgaagggtttggaaaacataaagccagtgatagtgtaatagtacaagggtgtcatgttctagttcctgcaagcagcagaactcggcagcttcagccatgtggctctagctctagagttaagagtgaaaagaactactgggacaattgaagctggttagctggagctaagaaattaagaagagaccaacatcactaaggtgaaatcttctgggaattgttttctgggagcacaaagaagttgtgttccagagatagccaaggttgtacctcatgctgcagctggatttggtaatgtgtaagagtcgcccaggtggtacttgttttgaaggcatgaagttgccatgaagaacagctgaggtttggcactgtgagaggtcatggaaggccattggagaaggtgtagcctcggctcggctgtagtttgatggcccaggacgaaggggtcatgcaaaggatttgaggcttggcaccatgaagagagcctatgagaggatattggtgaagcctagttggagtggaataccccagtgtattgaagatgtcagtaccatggaatgatcaccaagaacagcagccatagtggagtggatcaacctgagcatagagtgctacagagggcagagatggagaagtgatgccagcccttaggaggagtccaaaagatcaagtggaatcccagatactgaaacaagaagctgtaacattgagattgccttggagactcaaagatgttaaatatgccagagccatgggatacatgctgaggaaagctgctaacaggaagtggaaccagcccaggagaaagcagtttgttgcaatcaacaaaagtgaaaagggagtggagatctgaagactgctttgacatcagccatggagatgcagagtttggagtttgcccagctggtttcctattgttctttgaggattacagttaagtgattggatgaatctcagaagagaccttgaactttgtatttttaacattgttgagactactatagactatgaggactttaaaagttggactaaatgcactttgcattatgctatgtttaagtatgccccccctagactcatgtttttgaacaagtctatgagggtcaaggagtggaatgtgacagtttgtgtattcttgggccagggagtggcaccatttggaggtgtgacctggttggagtaggtgtgcctctatgggtgtgggtttaagatcctcaccctagttgcctaggagtcagtcttccactagcagcctttggatgaagacatagaagtctcaggtctgcctgtgccatgcctgcctggatactgccatgctatcaccttgatgataatggactgaacctctgagcctgtaagccagccccaattaaatgttgtttttttgtaagacttgccttggtcacggtgtctgttcacagcagtaaaaccctaactaagataaggtcccattctgacccactgtttcattccaaatgagcatgtggttagatgtggatagctggcctctttgtgggcctttcttggattcatggtgggttttttagatatatggaattattctgttttctactttttaacttttattgattcgttgtgaatttcacatcattcaccctaatcccacccatcttctgcccctccgtatccaccttctgcccttgcaacctccccccaaaagaaaccaagcaagcaaacatctctccattgtgtcacgtagtctgcccttttacccagctttgcttgcaaaagatcattgcagtgcgtcattggtctgctttgaggcctctgggtgagagttattattcttaaagggggggttgataaatcagggcagaattcactaaactaaaatatctaaggaatgagttgtttaaagggaagctgatgtggttgccattgtgttactgttgctgttgtttgattcggggatttcatttgtttgtcaacgtgatacaaatcaaagttatttgagaagcagaaccacaattgagaaaaaaaaaatgcctccatcggattttcagtaggcaactctgtggggcattttcttgaccagcgataggtttgtgtaggcccattcatggtggatagtgacaccccctgggcaggtggttgtataagaaagcaggctgaacaagccatggggagcaagccagtgagaagtcttcctctgtattctcggcttcggttcctacgtccaggttcctgccttgcgctgctactttgtcttccctcaaaggactgtgactcagtgtatataagcaaaaaggaaacaaaacaaacaagaccgcaccttctttcctacgttgtttttggtcatgatgtttactgtagaaactcttaagacaaaaggtaaagaaatttatatttgaaattgagaaactgtctcaggagagaacattgtaaaagatttccaatcctgggactcccattaaaattctaagacaggagaacttagagaaagaagcctacccatgaccacctatagtcctttggttagtctgctcaaaagagaacaagtctataggaggaacagttatgatccacttaccatgactacagcctagaggaactgttagaaggactagaatatgaaatgggagggctgagattgttctggaaagacagtgagagagaaaggaggaaaggttggtagacaggataaatagtagtgcatttgaaaatacagcctctaaagaaaatctcggggaaggtggattgtttggcctgcaatgatagaaattgataggtaacctaatatctttgagcatatgaagttttatgtacatggtgctaactagtcttctctagctactcaaaaaatagaataaaatttcaaacggccacagttaaatataccaaagaacttcctaaccgtgagcagtgaggggtgatcaactctggaacatgtaaccaagagagtttgcaaaatttctgttctcagtgatctttaaaaatagagtttagagaggtcagctgagaaagcagagcctgccgcctctgtcaggtgtctctctctgcctgtgattccttcttttctgttgtttcttgatatcttcagtctctcaccctatctctccacctccatttccaaaactccttcccactcctcttttcagccagtgctgcccctatccatccccatgtcctgcacatctgactcctgacaaatcttcctggagctgatggtgttcctgagatcagacttccactatcctttggttaatagtagcaagtctgtgcaattgaacagctaaatgaagtcctgccaatgatgccaatgatagtattaccaatgataatcaaattctaaaaagaatcatgaagtgacccctaagtctgagtttctaatagtcctttggactcagatcagaacctcctttttgaagtcttgcctgacctgtttcagcatttggtctgcctcattaatgtggcactcttaatatcttagaacattttccctactatgctgggctccttgagaactgtttatttctgtgtcctctaatctatttggaaatatggtgcagaaaagggattataagcatgtccagctcttcagcaaaaactagatggctgacttggtgtcattgaagtctctagaactccctgaaattatactcctgactatacagtcttgacagtaactaactccaaatataacactgaatcctgtgttttaggaaagaaggcagggccacctgggcccaacggccccccaggacctccaggacctccgggaccccagggacctccagggattccaggaattcctgggattccaggaacaactgttatgggaccacctggcccacctggccctcctggtcctcaaggaccccctggcctccaaggaccttctggtgagttcttctgtctcccaccccttagaaaacttttcattgcttttgtagagtagaaacagataatcttcagagaattttcaaacagtggcaatgtgcagtaagaaatccctagtctagtgtagaggtggaaagtgaacaagctctgatagtgtctggcctgctctaagtcttgttgagttcaagctgcgccagacaggccatctgttcttgccccatgccaatccttccatcccattccatctttggctctagtccttcatatagtgagccaataagctcatatgagccaaaaacagaggtatgagaaagaggtcccagccattcactggagttcctgtagatatagatttggcttactctgatttccagcatagagtaccacatgacatttgcatggaaatagtttgtgggaggaatgttggggactggacaaaatgacaaccctattataatgtctttccatgtactttgagactccttgcctagtggtgtagaaatagccccttctagtcgagtggttagaaatgtatgaatcactcaagctgtgtctaacaaaaccagacaccaagaccaccctgtccctaagccaaatgtgtctcacactagacccttaaataaccatgctgctcgtttaaatgccattccatccctttgcctttttctcctagcgcccagtggggcatgcaacaggtatagctgcagatccaatcctacctaattagagttgacaggaggaagacggcctgaactcatgctacttgttacatttttctcctgctcccctcctctatcttgaggttttcttaaacttaatttccccaggtctaagaattcagcagcaggattcagattctttcacttgtaattcaaacaggctcagcagtgttaccatggccacaagagataaaagtttttttttaaacccaatcattccacaaatattaattgaacaatttctgtgtacaaagagatacattgctaagtggtccctgttctcatagagtttatttcctagagtcaaagagacacacttaaagaaacaagatctttataaatgacagtggctcttgtgaaatcagtaagaagagaacaaagagctagaaaagcaagtgccattgttttaaggacatacaatgacacacatagcctctctttcctctctgtgggtgctcaatggggcttgccttgagccaatattggccagaggccaacttccctgctgggatctagaccctctgaagaagatggtcggtagggacaggaatgggaaggaggggatactctctcccatcaacagccccatgttgtactatgactccctccagctgtaaggcctggagaaggaaattcctacagggctggctgtggaatccaggctctggagccctggctgctgaaatgggaaagggaagtagaaaagagcacagcactctgactgccccatcctattttgcaggtgctgctgataaaactggaactcgggaaaatcaggttggctggggattactgtcttcctggggaggagggatggcctcaggcttggggtcaccttgaagtcctttgcctatgagattcccagaggctttatttgatgtcgtactggagggtctgaggttttcacgggcagccgttgccgatacctatgaattggaaaggttcgccctaaggatgtgcttttagctaaaggaacacaagtcttgcctggaccattttactcatttcgtgagtgacagagggtcatggcagccagatccaatagtccatagaaataacctgcctgtcaggcatatgtgtgtgtgtgtgtgtgtgtgtgtgtgtgtgtgtgtgtgtgtgtgtgtgcatgtgtatatatacctaggcctctgacttccaagccacctcagatgcctgaagctgcctagaatctgaagctgagagtttgtgtgtccatgaaaagcagccaactagctgtaggctgaggccagcctgggcttcccccttaatggccttataggttccttcctagtccttgagttttccaatctgtgtcttttggcaggttctactgcctagcctccttaccttgctcctcccagcaactagcctcactacagttatttggtcacaatgataaatctacagagttgcacaggccttacgtttttgtaggcaattttatattcactgccttattagatctcacactgtgagagtgaccagcagagagtcctatagttcccgctttacagttgggggaggtaaagctcagcagcctcccacttggctgaggtcggagtgaagacgtagagctcttactatgttttaggagaaatagagctagggatagctcaagacagagggagggggccagaaatgggctacaaagtctagaagccagaggtaaaaacacaggactgcatgacacggcaagcagtcattatagtgactctcttcttctcatcttctcagccagctgtggtgcatctgcagggccaagggtcagcaattcaagtcaaaaatggtaagaatcaaagtagaatgtctccctcctaggagtttctcccttccctcattcccagcctccaaataatcagccagcctaactcctccctagtccctgaatatccttggcatagaagggcatttcctactccgtcgtgccctctactggttgtccgaagtaactgcttgcaccaagaccagatgctacacccaaattgcgtttaattttgctttttgcagtataagagggcaaacccggggcctcgtgaatgctaaccaaacatactacctttgaactacatcctcagcccctaaattacattttgaatccactaatgcgggatctgaaaaggacttgggaaaccatctacctagactgctttgatgtttatatcagccaccatggaaatatgtgtaatttgataagcactttcacagtggaaactaaggaagttagaactatattaaataaattatcttgtctgattgctctatacagaaaatggctggagagagtgcttctcccagagaggggacatgttagtgtctaggaagtaagagacactaatgtctatcaaaagcaaaagcatgttaacggggcttagaaatgctgattttatgttataccctcatttatgagatggggggacagagttccaaagagactagaaataccaaagaaaaccatactgtagccttgtgtttgcgtggtgctttagaattcccaaatggtttctctttttatttaaccttcacaaccactctatgaggtaggtgttgcaatgctcctttgttttgttttgttttgttttttttaacagcaacagaaactaaagctcagagaacttaatttaagtagcccaagattttgtagtgaagttaggagctgagattcaaaaccatatcttcctagctctcagcgctgtgctatgctgctccagtgatgtgtgtgtacactccactgaatgatttggttcattttcttcccccaaagagacatgaacattcattaaagaacagcgcttttaaataatgtccagtctccagggtgcccaaagcctaaaatgcatgaacccccaggagtcttggaaagcagcaagccagctaacatagcagctacttacagagcttggagtggaagggaggggctgtgagcagacactgtaaaggaaggttacaaaacctctacttggggacagcttctaagagcacagtcagtcctgaagtgcctgtgctgagttcctctcaccattgggcttagctactcccttgactgtcacttgaatacccagcctaatagcctcgcaagtacaagtcggagtagaggaagaggaaaacactagcagccctgtgggaggccaagcactgtaggacccagggtcttaggtgggcgatcgtcaccatccttcctggaggaatgtggtcagacagaaaatagatttgtttgggtatctaagtggtggccttagaggtcattctatagcagaagctgttcaaattgcccccactaccataaaagagcaagataatttccagtccctgcaggcaaattcccagtagtagtatctgctgacaggcagacaagaggagcaaggccacagtgagaggacactaggcagagcagtccactgaagtactggagccaggacttagatggctttcttttctccatgcatcagagaggcagaccttctgagactgaccaagaatggatgcttacaacataatgtttttgtgtgaagaacaaatggctgagagaaaatgcctctgtgaacttagtttgcctcttcttattgtaggaaggagcaactttctatctgcaggatgagaggagaaatatacctccatcctctcatgcttctgtccccagcgtccccagctgaattaaggatataaaacaaaggctttgccaaggctgcctcaactcctaggcaattcagtctcctgaaacctggcaggctctcccccagcattgtaaagctcaccctctctggggcctggttaccggaggtcactatccccagctgccatggggtctgagtgccaggggagcctgatactgaattatcaccaactagttctctagacagatggattgtttgattaagtggtttcctggggccctcggaggcttcccagaaaggagtgggtgtggaggagccataaagaagaatctattaagaagagacaaaagcacaggaacctctgagacaagagaggaattcgggtgatattgctagcaaagtgaaattgaatacaaagacttagcctgccactcagtgtctggactttgtctgtgcagtcaccataacaacaaagaaaatatggttctgtgcctactctcctctttcaccatcgccacctcagattccaactagaaggtaaagagctttattgatggaacggtcaagaatgcaaggacaaagactgatacgtaggtccataggtccccaggccagcctagaagccactttacaaacagtacacctttcctgcttccaaatgttcttttaaaatcttggcccttgaaacttttgtggtcattggtattagatagggttgatggggaggggggtggttactgttggtatttatttctgttgcccgaattattttgacatgtactgagtgactgcccttctctcatactgagatctttcaggtggagtgctcaatgactggtctcgcatcactatgaaccctaaggtgtttaaactacatccccgcagcggggagctggaggtactggtggacggcacctacttcatctatagtcaggtagaagtgagtacggtcttaggcctaactcttcttatatccagggtgcagatatggtgcaggccacctaggggcactgtggagcaagccaaaaccatccaatggctaacttctcgcagtgctggggaaaggcgtggccgatttcacactgggagggagttgaagggagggaagaccaataaacccatttcatttttcccctagaaaactatcactgaaaaactgtaaagaggcctctccaacaccctgctgtctgatcccctcttgcaggacccaaggccctcatttcccctctgagttgtttggttccacagacgaacctgaccttgctctaagtttttaagactaagttccagagctgcagagacccctccccacaatactgctagcttgggcatgataatgaacagtgctcctgtgaaccttctctctacctcaagaagatttctgactgtctttccttcctctttctcccatttgtttctgtctgtttctgttgttgtcacctccttcttactgtcattctcccagaccttgctcccctccacttttgtccttctcctgtcctgggcccattccccacaggtctgccagtggccattcatttccatccctcattgcgtgcctccatcggggctctcctcagagctacaagtacataggccttgaggtcagggttaccaggaggtaggcagcaaaaggagatgaacagaaggactatgcaactgtcaaacagctctcaagaaaaaaaaaatgaatagagaagttgggttaaccagcactaatctggcacacagagtatccgttcattgcttggtcctgacccaggagatgatgtgccatttaaatatgttacttccaatcaaagagcctgtggagtcacttttatgaagtgatttaaggtatcaaatgaaggacagtccccattcctatggggcactgtgggcataaccccaatatcctgtagactaaattccatttagtagtggtgaaaaattggagctgagggtgggatgtgctggcgaaaggtaatgaaggatgaagattaaatgtctggactcaggagaggattaggagtgaagtccatgtgagctaagaaagtctctatgaggccaggccataggctatacttcctcctggccacagaatgaagttaggtgcctaggatttgcatccagtgtctcactatataggccagctccccatctctcaggatctgcttcttcagtcagcaagagaaagggccgagctgtgctgagtctgggagaggactgcaggacagaagagtacactgtgagcttaggaagctcctgttcacagcctagagaagtgagaagtcaggacttcgacctccctggggcaccggggatctctaagtgtattcctaaattgtctttagtgtgggaactggaagttggtgtgtcccgagcattgattaagcacccaaggagtgtgaagcactgcttcgcgccagggttatggagtggagccagtgaaatggctcataaggcagctctcggcctcagggagtccgtaagaaaggtttgctcagccctctgaacccatggagtaggggaagggcagtgtgatcctgtcaccctgctgttccctgccgaccaacaggcacagtttcgggtggcactgcccctgcacagggtatactggcagctcatctgaggaggttctatctgctcaccaggggagggccctaccctcttttttcctctctcccccaatcccttcttgttgcctctcacccaggtctactacatcaacttcactgactttgccagctacgaggtggtggtggatgagaagcccttcctgcagtgcacccgcagcattgagacagggaagaccaactacaacacttgctatactgcaggcgtgtgcctcctcaaggccaggcagaaaatcgccgtgaagatggtgcacgctgacatctctatcaatatgagcaagcacaccaccttcttcggggccatcaggctgggcgaagcccctgcatcctagattctcccattccatcctggcccatgcccctgccccaggtttgggagccaggactcccagaacctctaagtgctgctgtgtgtggaatgaggtatactggcgttgcagccacaaagagaaatgccccatgctatttattccccagtgactccaggatgacaaggcctatgtgacttcccagaaagaccttgagttgccaggacagttgacggagccccagggttgtcaagaagcagaaccttcttaggctccctgctgactggcttatggtgactcctcaacccttaggtccctcatcagatgtatcatttgttgcactaaaatgaggatccaagacagtaggccacaaaaagaaaaggtgcactccagattctaggggtgatggggggcttcttctctcctggctgggggtgccattaggttgcaacttaaggagagggtcaggtcagaagaaggcaagtccttgtggcaaagacctgggcaataacctaccaagtcaatatccttgacagaagaggcattcttgctgcattgcactataacctactagaggctcaaagaaaacttcccactcaggctgagaggtatactgtggcagcttgctggactccagagctgggaactttgctttggcttggaatcatgcaggaatgaccacatgcatgcctatgtaagaagctatatttggggtcatgcatgtctcattgtgtttacagctatgttccactctcagaaaactacctggagtcttcccacctgtcaccacccaccccagtctgactagaaattctatcttctttctcctcggtgcctacctctgctttagacaggtgcttcacagtgtactctttaaattacttgggcacaaagaattttccatttattaggcatacaattcttctaattctaatcaaactgtgtctgggaacagatggttaaactggataacctccaaaagccccttagagtttgaagatcggtggcactcagcagttacctgccacagtaaattttggaattcccaaaccctacactcccttgggcatcagcacagtatagcttttctacctttcccagggagggggagaaagtggggatagaacaggaaatgttgtccacttttgttgagacccaagctcttatctgaaagagcagcaggccatggcccactagcccagtctttctgcggtgctttcctagagcatctgtctgctattgagcagggctctcacacctacttcagatccaaaggcacctccaccagttttcctgcattgtcttatgctaggttcatgagacttctttccaattgcctagcttcagggtaccaggcacagcctaaagctggaaggatcaacctggtccagccggttcctcttgctcctgaaatgtatttctttttgaggagatgggaaatgcatccctgaaatgcatcaagaatatcaggtactgagttctcagctgtacctccatttcccagtagccacattgcttggtccttcacgggtcaggacaagaggtggtaggccaggactcttttatacagtgctaatgacagccttacaaccagaaatgaggtcgattttagacatgcatctgcccttggaggccttgaacaatcagcagtggtagcaagaactaacagaccctctccttagtgtttgaaggttgcttcctcttaatttcctttgaagaagacggggcagagaattatcacagttaccattgtataggtacggctgggagagaaagcactttcattaagaactcacccataagtcacagaccttagcttttagtgaggtctgactcccgagctagtgtcttaccacacacttaccacacactgtgtggaatttgggttccgaaagaaaaattaaaagtgatcacatggaactgatatcatggcagagtcctagggagaaacctagcaatgctatggtactgcctagtctcttggctgccacaggctctgtggaagaagtcttggatgttttctaatcctgagttgagctctgggacccacagaacttggagccttcatgacctttcacccatctgataaaagcagcaaccatcacacaacgagctgctatgtggggcaaggtcttctgtcttccattcctgaccctagctactagttctgggagccagtctgcttcctggggttaggtgtgactcctcctctcctcctgccatattacaaaggccttaatgttgccagaacatcttcctctgttgatgttgagaggttgccctcccgagaatggagggaaaacctaagagcaccattccaaagccacatggctatggagaaatagaggaagtttcctaactgtgcccctgcaggacatgccaaccccatcatatgctctgtgcttggagatcataggggaagtgggcttctcactaccctgtcttcatcctgaatcctcacaaggagccccagatgcagaaggctgggggaggaaataagaaagaatggggggcctgctgtgctgtactcattggcaaagtaatgaagcatttactgataggaaaatagggatatagatttacagtttggaattgtcatgatgtgaagttatcccaaggttagcatagagaatgggatggggacatgtttgtgtaagcagatgacatgttagaagaaaaattgcaccgcaggagcctctaccagctgcttgagcttcaaaagccaagctggcacaaaattgtacctgctagatgttatgtggctactggttccctggaagatgtatcattttgccttagttgcccctggacccatcctgagcctaatctctgcagcttagtaagaaaaggctaaggaccctagagatgagggctttggtcctcatgtgagtgattgcattttatgcgtcttctagtggatgcaaacagatgtagagaaatctttgacctagaaaggcttttagagggaatgcagcccaacctacatcccatcctgttactcatatgcaattgatgtccagacagggaaactggcccacctaggacagtgtgcaggcaggcccccacctccagactcagcaggagaaggaggcaaagcaacctgtcccatggggcctcctctttcatacacccacagaatcaaagctagaagtgtttatctcccttcaggagcctggtgaggcagggagtgggtctacaatctccatcacaacttgcctccccacacatagtcccccaagatatttgtgcacctcctgcctctgggctggaagctttaggctggctctgagccagacagattttaggcttctcttgtgttgcctgaggtcccacccttgcctgggctttccctgggccatgcctactacagaacctgatttgttttcttaattcatttcagggctctctccaggagagcgtgaggtgtgtcatttctttcttcaaaaagcttccagctgatgaggataaggggagaatggcctggagcaggcccaatgctgctttggggaatcagcatcctgtgtgagatactgtgtatagaaactatatatataatgtatataaacagggatgtaagtttgtgtaaattaatggtttattctttgcaaataaagtgctcccctcaccatc

SEQ ID NO: 575 - DNA, 425198 bp, mus musculus; identical to SEQ ID NO: 574

SEQ ID NO: 576 - DNA, 2576 bp, mus musculus
gaacaggaggagggacagagggatggggaaggctgcacaaaggaattcctcacaccaagccccctgactgccagctccagagagtaaagaagccgacctcctctccagctagctcactcgctcatcttcccaccatgactgtgctcgagccatagcgcctctcccggccttccaagaggacccacacttcttcctgtaggtggcaacagtgacacctgtttgaccagtgaggctgagccagggactgcaagagggaggaggcagacaactcggagaggagctgggaggcagagctgcgggcttgcttgctcactgtgtaaaaggtgtgagggctcgggaaggctgggggctaccgctggggagccgggaagcaaagagcggctcaagccgggagggatggagcccagggggctatgcagcacccctgtcagattccctgctccgggtctttcagactggccagatcctgattccatcttccaggcaactcttgagggaggtaggactctggaaatctggggtgcccgggtatgaccctagacgaagcaagggatgtggattggtgctcagggcaggatactgtagcccagttccgggatggggagaagcaggggcctctctttgggttgaccagtcagtatagtgggaagggacccagctcccacccctccactacctagacgggaccctcctttcctaaggagaatttattaagggggcatctttaagagcagacacaccttgcgttcttgcaagagctctcacacagagtgaaaaagcgacaccgttcctttgtacaggacagttagatgagagagagagagagagagagagagagagagagagagagagagaagagagagagagagcagagaggagagaaagagggagagcatagagggagagagggagagagagagcagagaggagagaaagagggagagcagagagggagagagagagagagagagaggagagagagcagagaaagagagagagagagattatccagaggctcctttacatagtcattttgaaacccattttactgggagccacaagtccactagtgcacacacatgttcatctgctgatacatgacccacagtcacaccctgcttattgcttacgttggtagttcagtagtagacttctcacctgctgcaaactgcacaccctctcaagtagaatcacactcacaagcccagtctggtttgtagatctgcttagtctcagccgtactgagaaccacaaggcacaggaataccctgctccagaacaattcccctgccgccgccaccaccccccccccccgctacagacacgcacaagcagacacgcacacatgcacctttgccctgtgtgcttaatgtactttaaggatagctcagagggtggggcctctgggacggggaaggtgggagttgggtttctatttggggtggagggtgactgtatatgatgtctgggaaggaaatgataaggctaggttgtgggggcgggggggagacttggattttctggactgtgcagacaggaatgaggttcctttagaaggcagtgatccaggcagcctgctcccctcaagtcttctattttacagtgcccctaacccctgagaagtggacacagagaatcttttagtcaggggctttgtggtttgttcaatcccgtatccatagcaactagtcaactggctgtgtctctctcagcctggggtcagaatgagaacctcagcttcaggttgactcctgctttctggggtgcaagacagcaccaggctgcctcaagctcaggcagatctgccttaacttgccgaactgagtttgccccaccctgaggcaatttctcctaagttactctgggcaagcactccaaagccagctttggatgtcattaaataggaaggatctggagagagtgggtacacatatgacgcctacaaaaaggctgggccactgacctcccaggtatcaaaaataaggggcaactccagaaacggttcctcttttctgggtttagaatttgtcacctcatgaactccagagctccgggtctgctctgtgacagccaaccttcctgctgagcagcatcgaaggcttctatctacctgccccaggctcctcagatacatggaaagggagactgagatctgtcctctatgtgggtccctgatggtcaaatgtccttttcccccaggccttaaccatggcagattcccccggctgctgctccatctgggcccgctgcctccactgcctgtacagctgccactggaggaaatatcctaaacagaagatgcaaaccagcaaggtggagaagggatgggggggtgacaaatcagaaggctgcttggattcataggcagctgggaggaagggattttctctcccccaggaagaaaatctccctcaaatactggaagaacagctcagtgcagggcaggaagctgagctgccattctgggggcctctcagcatgaaatggggatcagctgagagcttctctcctgctcctttgcagtgcgactgtatctggtttggcctgctcttcctcaccttcctcctgtccctggg

SEQ ID NO: 577 - DNA, 2576 bp, mus musculus; identical to SEQ ID NO: 576

SEQ ID NO: 578 - DNA, 9583 bp, mus musculus
cgagaggggaggaggggcgcccgtcgccctccgcctgggtcagagggcggggcgtacggctggaggccgcgctcggcgcaccaatggttgtccagctggctggcaggctggggcgcgccttcgtacagttcacctcctcacctgggcctccgctggcccgagccaatcaaacacctttgtttgcataaccggctccgcccactcgcccctgcggagggcctactagctgagaatacaaagatctccatatgggtgtgattctattcctgaatcccccatcccaagggctcagtatcaccttattttgatgaagggaaataagtgggacctccatgatctcttaggaaatcggatttcttactctctgaagttcttctaactgagttactctttcccagggcacactattcccaacgaccgcctcagagccctaaattcccccctctgtctttcccatttgccctaaaatctcttagtggtgtttctcgtgggctgctgcccactacaggcttcctgcagtactgcattcctcatctgcaagatcttagcactgcttagattgatgctcccaaaccaccatagctaccacactgtctagagggaaaaggaaataagaggttactgcaccagaatatcgcgaacctggtcaaatggctttgttaccgacggtgggagaagtcaatgctaagcatacgttgaaactcatcatctttctccaccttcccttctcttaccttcaggtctatactgggccacaatggtgactgactggccagcccgtttcagagcagccgctgcttgctcgtgggtagcattcctcaggttgactccatttacctgtccaaagagaggagttgtgagctacctcaaaggcaagagagagagagagagtcccccccgcccccatagcagttataaagaggatgtacagcctatctctcagcctatttggattggtcttccacaaattccatcctgtccccacaaattaggcctaaaggatacaatacctctggggtaataattatttttgtgggagtcaaatgccaatcaaagttaagatctaaagacattcatttcttcctccagcataagtctagtcttgttctcttttccctaaagatatttataaaaacaatttacattttcttcaggtctcagcccttccctccgtcccaagaaacactttttggtggacacagggactcccctcctcccttttacccatcctcccacccggactttgtctcaccgataagatccggtctccccttcgcaactccccacttaggtctgctgggcctcccgccaggatgaaggaaacaaaaatgccttctccatcttctcctcctacaatgttgaagcccaggcctgtagaacctttgtgcaggatgatcttgcggggctctctggagagaaataaaagaagataagaaaaggtggagtgggcagtcaggaaaggatgataggaactgttgatgctgtgaggaccaggccggcacagaacccatacttgctgtaggaagtcaagactctaaagggcttctctaatgtgatgccctgtgcttcccctttgactcctgaaacttgcttggctgctcttttatgccaggtgccaagtttcagttccttgtccctccttcgtaaagtctcctagtcaatttcccaatgggcattcctcagcactctcaggtccacaaaaacgtcatccagaactctggagcccaaacttcacagcccactccctcattttcttccctgagtcttctgttctagtcagctctgtgaaaggccctggactgaaagagaaacctggtaagggcagtggagtcaccctgggttgatctccctgaccatccaaaagctactctcaactatatgtccctttctaccttcccccaacatggcagcctccactgaccaatggtggtgtggaagaagaaatagatgaggatgaggaaatcccaggtcccaaaataggttaaacttaagagaggagaatatatatatatatatatatatatatatatatatatatatatatatatatatatacatatatatatatatacacacacacacacacagtgccacccggtaagtggaaattatctgcatatggatatccatacaactagcccgactccccagcacactgtcccatcctgccatcttcatttggtacaagcatctttcctgagagaaagcccaggtctcaagtgagcctcttcctttcttgcagttccgagtcttggggttgatgcttcctacctggcatcccctccaggccgcagggaacggagcggccaggcccacctctgcgaagccctcctccaggctgaagcagaggccgagcccaaacccagggccaagcttgagcctgagaacttgcgagccgtctccatggctcctctggttctccccgggtcagcctactcttctgtctccaccactgctggcccagcagccacctaggccccaccctgcaaacctgtccccctgcaaccctggccggccggcctgaccagttcaacggccccggcccgccgccaccaccatggggcggaacccttcctcctgcggtcccgggctggcttggaggcctctctgactcccgccaaccccgtcagctaaaaggccttcttcagcgactatggatggctgccgaagagaggattgatactgtcgcagggcaggaagacccccgctgcccccacttcctcagccccctagacgcttcaccccaccccggatctgcattttcggatctgggccacttgcttggcactccccctgacggcggtaatcgtccttgcagccacctctgtttctgaagtccgaaggcctcacagagaagggccccagatcttactgctggggatgatgagggccttgcccttttgccatactacaagaaggcctgtcaacagccagaaaatttattctcaccccctctaggttgaaagaacaggagagtgtcttacctggtaaagtcttcctcagccagcatgtgtctgggaataggagagtaacgagtagggggcacctgaggtggagcagggtaggtgaccttgctctccactgccccaagataacccaggctggaattatggcttatgtgattgtcagccaaggcagtgaaagctgaggtggagagagagagagagagagagagagagagagagagagagagagagagagaggtgtccagagatgttccactatagaattttttcccaaccccctcaaaggatttttccttacatcctacctcaggtacaaaaaggaccaaggaatgccgattccctaggccactgctccctgctctacccactacccaccctcaccccagggttcctcctcctctgtccctttctaaaccctaggcttactcctgtgagtcttagaaagagctgaagtcaaagcagtctacaaagaaaggcatgactagaggtgtgattaataataataataatcccttacatctctgaagcctaatagttttccaaaggctttctcatccatgatctcactcaatccttgcaccagtcctatgaggaaggcgatacacacacacacacacacacacacacacacacacacacacacacacaccattagcttatttggactaaagagaaaaactaaagttgtgaaaaggtcttgtccaagggcacccaactccaaagcacaaggctggcacctgaactcagttatgacaataccatcagtactagttctttctgaacaaaggggccagacaccgtctccactgaaaccagggccaaagagcaatgagtacgtactgctggcatagtcagggggagcatacatatcgttgaggtggatgctgcctggcttggccaccttcagatagaccatgtctgatgtgttcttgagtgaggccacagcttcctcatgcctcacatcctgcagattggtattgttcacctagaagaggagacaccctagggtgggtcttagaagggaaaacttctccggggcactcaaaggagtggtctttcagcatactaacaggtaccagtcgggtagggttaaagggataatatataagcatggttggccccaccatgggaaaaaactagggccttgttagctgagtaagaccaactcaggtgatcttgaaattgccaaaatgccttatcctgaggtgaggttttgatggagtgagacggtttaccagagctgatcctccctaccctactgtttgggcatccccttgaaggctatctcaccgcaagcagccggtccccaatctgtaggcgtccatccttctgagcagctcctccttcaatgatcttggtgatatagatgctgttgtctcctgggatgtgctggttgccaatgcccccagcaatgctgaaacctaggcctaaatggcagccagcaggaagtgggagagagccacagggagaagttagcacggttcatccattttgaagccaatcccctccctctgccctctccaaaagcttcaccatcctatcatcccaaggtcagtaaggattgaaatcggaggtcaagaaagaaggctaggatctgggactggagtaatcatgccaggagaaaaacccctcccttccattcacctatggggcggccatgaacccaggggctgggggtgggttgctagagcacgggaaccaggagggccccaccttttggccctttgagcaggttgacctccatgatagtctcaggtgggggctgtcgcctccgcaccaccaaccgcaccacagggcctgcctccttcagtgcctccacggcccggctgtgcaccacctcggacacgtccacctcattcacccgtagcacacagtcattcaccctgtagggaaagcccaagaggcatgacagtgtgtgccgcccctctattgtcgcctgtatcttccctctcctcggctctcccttcctcctttccctcttcttctccaatataatggaagggtcatccttgtccctcatctccatcctgtcccttccacccacagccctgcttccaggccatctcaccccagcctcccatccatggcagctgctccaccaggaatgatcttggtaataaagatgccagggtcatcagggacatgagggttgtcgatgccacctgcgatactgaagccaaggccagagttgccctgaaagggggtggaagggcacagtcatttcattctgagagcacacaggagggttccatctccttccatatcccagagtcggttctccagattccaagggaagggtggggcacattcatcagaaacctagcagtttctcagtctatgttcaccattttggtggagaggcctcagcaaaccaacccccaccccaagtttccaggcctcagtcaacaagatcaatatttgtgagttgattggtagctgcagtgatgtggcttctgaaggccctgtttcctcataccctcagtataggctcccccgtgagtcttgaaatgctgctctaggccctcccctctcctggatgtaaactttgccccctgtttcccaatctccctcctggaaaacttacccgttccagtactatctcctcatacttgaacatgccatcactgccattcacctaaaagaagacagtagcacttccttcagtgtcttctgcccacctactcatctgccctctcatcagtttactccttccccactcccacaaagatcccaagcacacgacaaggcatctctagatcacagatggggacaggctgaccctgagcgagcacatccctccccttgtatccaaccatatcagtccaaaaccagttgcttgtttagcccagatcaactgtctgagactgagccaaccagtggtgcactcaccgataggctgggctccagggcctcggggttcactaggaggggtgcagggctggcctaagggggatggcagagatggagcatggtgggcaaactgtaccacacccaacatccataggaagcctggtgagggaacctctccatttctgaacaacagttccccctgactttgggatcatagagtcccacaatgtcagatatagaaagacaacatataccactttcacatgacaattgaggacactaaggcccagagtggttgtggggtgtgccaaaagcacactgggagttaggatatagaacttgtatctccaggtactctttggactataggaggtttcaaggccagtggtaatttggctgatcatcccttctccatgttatttccatcagagttatttcccggaagtcctatttttacacgtccttcaaaggtcccagaaatacaagttctcaaatggacaggagtgaaaatcctaatccaaatttttttccaaagcaacttttgatttgaaccctttctgtgctccagaagaaagggtcagggtgggaactggccaggagtctgaggacaaatcagggttaggacaggactggggtagacaaaatttcccatgacggggaacctgatgacccatagacagtaggatcagaatttgtgatcttaagcacacagtagccatggcaagacaggctagtaaggggttcaaaaaaaaaaaaaaacacaggttgttttcagcaacaaatagacattgccttccagacaggacatacttgtggcctttgttcaagtggaaatctgattctgcacagacaagtacacctgcttcctcattcccacaatcattttcaagactaaaggaagccccttgtctccctcaccaagtgtcccagcactgatccacatttctctggctgtgttacacccttctgaagttgtggccccagaagagagcacacagggtgagtgttcttctaacatagtctgctctgcctcccccttcccaccttcatcctctgcagcactggcttcaagagtgctgactagcctcccctctctctcccccttcatgttctgtggtcttaaggagtcagtggggagggctccagctgcagcctcaccctggtcccaggaagaaaaatcactgcttcatcagagacccccccccccgcaactaacacagccaactgaagtgccatacaaccgttacagagcaaaagagagcccatgcaggtacactctctcgtgtacctagtgtaccatgtgtgttccacatgtgataagccatgcccacctagtttgggtggcacctggaggtttcagctcccagtagtccaccctctagctctggtcccacttccactcagggaccttgcctctagggtcaggagccatccaaagatcacccaacaggcccggccctggaattggcacctatttctcactaggcaggccaagcatgagcgtgtgcttataagggaggggcaaaaaagaggggactcactggagagggcaaggaaccaaggctagggacataggaagaggtgtagacagacagacatacagaatggataattctgatctccaagaagccccctcttttgcttctaggtaaaagcacatcctattctccgaagaggacaggggtgaccagatggtcaccagcttgggacagtcagcaccttccatagagagcaaagcctctcctcctctctttccaccctgggggttgcagaactgaagaactagacaggccctccgccatgcgtgccagagacctggctctgctggcccagcctccattttgctgtttctcccacagacgctccttccattttctaagctggcagttcaggctgggagtggaagccggagttgtgcccagcacccaggggctcccaagctgtgccaaatcagagctggggagctaagctctctcacatctgtgggtacccataagggccatgtcccactcagagaagaccctgcattagggcagctaccctttgcctggttccaggcaatatgcctgctttggagcaagaaggcttgtttaacaccccctgccccccaaccccccgcagcacacacttcagagcagcttggacaaaagagtctgtccttctcagcagcatctcagccttgcttgggatgtgtcttgccccccccccttttgcctgttaagcgcttctcatcagggacaacacacacacacacacacacacacacacacacacacgtgtacactcttgaagccacatgcttacacacatatacatggagacaccctcgggcgaacacagctatccctgcagcctcatcgacagagacaccttcacattcagagacacatcctcacatatccatgtgcacgttcacacacaaagggactgggatggagagggactcatggtatggagagatgacgctcagccatctgggcacatgggttctgatacatacattcacacaagctccattgctttcttccacacaccccaacatacatacaaacacatatgtcccccccacgcagagcaccatgccccctcctcccctcctatggagacacacaccacatacaacccccgcagaacctcccgccccctgccagacacagagacactgccacccccccgccctgcactgagacaaacccaaatcccccacactagaaaaatgtgcccctccgccataccatcaccccctgatacaaacagctcctcccaatcccctccaaacggagaccccctaaacagacacacatagaagatgtattttcaacagtctctctttggtcagctgctaaaggctcagatccatagacttggagccccagcaacctctactgctccccagacttcctagaccccaatccctagtcctttgggttgtcccaccagcctcccctcctcctcatctgccggtccttacctgctcataccagtcccggttggtacaggtgcactcgggccaccagccggggccactgccgttgagttttggggtgctcttgccggggactggcttagggggcactggccccacatctcggcctgtggggatgagcttggccttggtgcgaggggtgggggtagcccctgcctgtgaaggcagggtctgcgagctgtagcctccataaccggagctagccccattgcccccacttggcccataggggtccggcacctgccagtccccgtagccaggaggctcaagacgccgcagggcggccaggcgggtcacctcatagcactcggggcacttacagcagtgctggtgcttgtgcatggcactgccccccgcggctcggaccccccagcccacgccagtttccacgccgccgccgccgccgccgggctccctagcacactcgcactgctcagaccaagaaggagggggcacccgtgggggtgccctggctgagcggggcctggggccgggcgggcgtcctggggcctctgcccccacgctgccccgcacccatggctccccctccagcactggcggctccgtgtcgcccgttgtggcttctgggccgaggcccagcggcaaagaagaatcgggcgcccaggcaaaggctaggtgcggcgagaacctcttctgctcaggtccccaggatggatctgagtggagtcaagagcatctctccctggctcccttctcaattgattccagccaatcagagcgcagagtcaggcagcggcagcggcagcagcaggaatgctaa

SEQ ID NO: 579 - DNA, 19950 bp, mus musculus
gcgtggtaggagagggggtggggagtggggaaccaacactaaggattatgaaaaagccataaggagcctactattttatgagcttattaaaatatgatttaaaaaaagacttagaatggaggtatcctgcactgcacagggagatgtttctcccaaagccccaggttgtttttttgttttgtactcctgcctagcaactcagaccaggatggcctctaactcagagacttgcatacttctgcctctcaagtgtttatagaaactatctggatgcgggttttgtttgtttgtcaacttgacataagctagtcatttgagaggcgggaacctcaatggagaaaatggctccaaaagactggcctgcaggcaagcctgtagggcattttcttaattaatgattgatgcaggaggacccagccaatcgtgggtggtgctagccctagggcagatggtcctggagtgtaaaggaaagcaaactggtggttggagcaacggctcaatggctaaaagcactgactgctcttaggttcagtccccagcgcttgctgcagcacctgacaaacatctgttactgcagtaaaaggaacctgcctgatgccctcttctgcccctttgaagattcttacacaaaatacaaatataaaagaaaggggatggcggtggacaccttgaatcccagcagtcaggaggcagaggcaggcagatctctgagttcagggccagtctggtctatcgagagatttccaggaaaaccaagtacacagagaaaccgtgtgtgtgtgtgtgtgtgtgtgtgtgtgtgtgtgtgtatacacccatatatatgtatatatacgcacacgtatatgtatacatatgcatatacatatgaatgaaagcaggcctaacaaagcagcatggcccctgattcaagtttctgccaccaggtttctcccctgacttcccttagtgatagagtgtgatctttgagttggaaggtgatctgtgagttggataaactgtttcttcaagttgtgtttagccatggtctttatcacacaaatagaaacctaacatagaagccataggttattaaagaaaaccctagtggcagatgtgggataacaccctataagttgttggtcagagaggccccagaggcccccaaagcaatgcagattggtggccttgttggttacccaccagaactggatggtaagatcctactgctgaagagaccacacacttttagtcacaggccatggagctgagttgatagcttcctcctagctggctagttttcatagtgctagaaagtgctacccaggctttgacaaggaaggttatcaaccgtctcaacccagctgtgaaccctggaagctacaataaagaccagcttggcaagacgtcctcgttagtgcaatcatggcatgaatactgtggactagttaacacgctgtaagtggatgtgaagcccactccacacggggaatccacacttagtactgtaaacctagtcaagagctgggggctggagaggtcacaggccctttttttttctggatgaacatgtgttcaaatagcctttggagcactcatgtttctgtccataagtcagtgccgtgagctttcatcagaaaagcttctcactgcaccggatggtggttaatgaagagactcctaactgacagaagtgctgagagtaagggatgttcaagttcagccctaaatgcgacagcagcagaaacccatttcccaggcttgggaatatcaagatgggtgaaaagggaagagctgggggctggagaggtatgctgtcaaaaaagcctgaccacttcacgaacaaactcattgcaactctgcttatctacgtaagactggtacaagactggggagagccaacaatttttcatcctgggagggggaagggctcatgaagccccagccccacgtggagctatggccaattaacggtggcacagggaaggggggtccctttctttaaatgatgtgatgattgatgataaggtgctcgtgctccagtaaataacctcccacccatgttcacgcaaggaactctaattaaactcagtgggggcccccaagcaaaaggacatgaaagggctcagcaggggagggaaggggaggggaggggaggggaggggagggggagtgttaggaggtggcaaagtttgagattcattctatgcatgtagaaaactgtcaaaagaatgaaaataaataaaattactccacattagtgagaagttttttggggtgtggggggggggggcttatactgcccatagaggtaaaagctaatttgaaaaaaaaatgcatcaaaagcattaaatatgttcatatcctttcaatgaataattccatttgaaagaacatattctcaggaaataattatagattcaaagaaaccttgtacaaggatattcattaaggcatttttagaagaacaaaatcttggggggagggacctaaatatccatagccactaacagaagaatggttacctgaattatggcacacatatgaggaactatttgttaactacttcaaaaaatttttcaaacaatatataatgacctaagaaaatattcatgatgtagtttagaataatggaaaagaatataaaaactgcctcaatctaataattccatttttaaagctacagacacattgcatgatatataaaatataaatatatatggtttgaaaagaaatatacaaagatgtgcatgcactagtcagttgatttgaactttttgactttgtgttttcaaaatattcagttgtatgtaaatctagtatttctatctccaggaataaaacttaagggatccgagtaaggagacacactgagcagaccaacggtaagccagggcaaagccagcatacacttgcactagaaatttcaatctacactgctcctaacttagcaaccagatgcaaacaaatccacatgagcacatagcgttataacccaggcatttagagccttactgaaatctccatcgaccacagccatacttgcctgacccataccgcagtaacccacttccactgagagaattcgagcaagctgccctatctgactttggtacttaccactttcttcttcggagcagttataaaacactagaaaaatccagtttggaatttaaccccacatttacaagattctttctcttttttgaaatccaaatccttaaagtacattatttatacaaaacatgttatcttaatttttttatctaacaaaatatttcataactcaatgttgtcaaacagaaattcaaaacatctctggggcctttgcttcgaaaggagctgtgaaatcagtgagcagaaacctttctcaggaggataaaagcctactcaagaaagacgggggaggaggacctttattaaagcaaagtggttattagttcaagaccatgtgatttaataagtacaaacaaaaattcataaattgaactaaaaactcacttctactcatctaacacagaattttagcaaggaaacagatcacaaaacattttatataatctcattttagacattaggaaactgagtccaagaattaagaatttttattcatttagagaaaactcagaagtggatctgagaagcttggcttctctgatatagatagataatacatgacctctatatcatgtatgtaggagcctaatgtctatatattgtgctaatggatatgtatgtgtgtgtgtgtgtgtgtgtgtgtgtgtgtgcatgtatcttacacaagagtactaaaaacagtagttttaatttcagtgacagtggcagtcccaaattattctgcctctgttcctttttataaagcaacaggacatttaccctaaagtgttctttctttaaaaaaaaaaaatcagtgtcaatatcaaggtcaagatttcaacacctaacacaatagacagaaaaagaagctgtcaaactctaccattacattaagaaatcacccattctcattactacatatcattgtaatcattccacctagcaggaagatctgatattttacaaagtgcaaagctcctaagattttgactcacaccacctagcaaggacaagaaagcacctgtctagcgaggttcaaaacaccgtgccaaatttcactccaatgtccttgggctacagaaacacagaagacagaaaagcccaacacaaacacacagtcagcttcaggggacaaaactgtgaggaaggagagcttcaccttccctcctaagtttacaaaactgggtgggcctgaaagggtgtagtcactttaagaagtctggcagtgcctccaaaatgtcgttaccttctgacccacagcaattttacttctaggtgtaaatacaggcgagcagaaaacatctgttcacaggaaaacttcttcaggaatgttcctaacagcagtattcgtaacagtaaaagagcgaaaagaacacgagaatggagaaacaaaacggactctaaccgtagactacgttattatcccaccctagaagaatgaggaacagacagacacgtgtcacaacatggctgaaccttgaagaggttacactaagagaagctgggcaccagaggccacacattgcaatgtttacatgaactgcacgcaaaacattagaaggtgcctagggctgtgatgagagaaagagccagggggaaacacgactgctaatgggtcaaggcttctggagtgatgaaagtattctaaaactgactgtaataaaaactgaaaattgcagaaagaactgcaatgtatatcttaagtggacatgctcatattatggcatgtgaattatatctcaatagcctgattccaaaagaaggtggaccctattatttttatcagatcagcatttctagcttaagcaccgtcactaaagccttaacccacccccccccacccccccccccgcagtacactcagccgataggactgagctagcgaccctctggttccttctaatcaccgaagcaatagcatgcctggccctatttattctccagttaatttgtaaacaggatgagaaccaaatcaaagcaaaattgaacaacaaataataagcccttaaaatatgctcaacattactactggggaatgcaaatcgagaccacaaggagataccacttcacacccagcaggatggtgacaaccaaaaggactgacgagtgttgggaaggatgcagagatggtgcaggcccagtggagagcagcctggacagtcctcaaaggggaatggtaatgagatttgagccagagaatatgtccaagaaatatgtaagtttatgtccactgaaagattgcacattgacggtcatggagtattactgataacagttcaaacacacacacacacacacacacacagagattatttatctatagaaggtaaagaagtaccacactacatgctataatataaattaaccttgatcatgtgctaagtgaaaggagccagtctcaaaaggccacatagcatgtaatttcacttacatgaaaaattcagaataaacaataacttcgtaagcatcagaaaggcgatttgtggttgcctacggctgagagggataagaagtttagggatgatgtttaaactattaaactccatttatgtgtagccttgaattaactgttgtcataaaaatgaatgacagccaggcagtggtggtgcacgcctttagtcccagcactcgggaggcagaggcaggtggatttctgagttcgaggccagcctggtctacaaagtgagttccaggacagccagggctacacagagaaaccatctcgggaaaaataaataaataaataaataaataaataaataaataaataaataaataaggggaaagcctaaataaataaataaatgacgaatgacagggttgggggggtcactcagtggcacagcccctggttagcacacatgaagccctggataccatccccagtactcaaaaggaatgacccaactccagttgaagaaatgagaaatgcctacttgcaccattaatattctagacctggtcacattcgctattcaattgaacaaagcaactccccctccccaacacaaccattccctgtgggaactcacatgcttccagaaatctcttccctactactacttctcttcgtacaggactgtatgatcgcctcgactgaaaagctgagataaacaaggtgtagtagcacacacctttaatcccaccagtatttgggaaggcagaagcaaggtctggtctgccaaccagcgtgatctatacagcaagttccaggccaaccaaagccggataatgagaccttatctcaaaaacaacacaacaacaaaaacacacaaagacaggcaggcagtggtggtgcacacctttagtcccagcacagggaggaagcagcaggagaatttctgtgagtttgagactagcctggcctacagtaggggcccaggaagccacgattacagagaaaccctgtttggaacccctcccccaaagtatgttaaaagcccagagattgcatggcatccaagccctacctgggagggatgcattaggaagcgagtatcttaaccctatcactctcccaaagcttatccctgtctttgtctattaaaaagagacagagaaaatcccccattcctcccctcactagagccctaggtctttcgcttccattaatttgtctcttgtggctaatttatgtaaatgaaatcatttaatatgtctcgtttctttttgtttgtgttgtctttgtttggtttttaagacagggtcttactatgtagccctggctgttctggaactcactatgtaagctgggctggcctgggattccaagatctgcctgcctctggagttgttggtgggactaaaggtgtgcctggctttcttttacttaatgttttcaaggttaagctgtgttgtgacaaccagtttttactctgtttatggcagaacaaaaaagtcggtctaaattagagtattttgtttacccattctaggttcgatggacatttaggttctttccaccttttcactctgaggattcatcttccccttgcctgagccttgctttaggaatgcaggaatttcaaaactttcttttgccttgatgcagtttaatctctgccctcgtgagagatcatagtgataggatagctatgtttacatctttcattcctaaatgtggggaaatgctgtttaaaaaaataaccttttggaaccttcatgatatcagccctgatttcctagctcttccagggcttatgtggaggggtttctgtgatgagcccatcgggcaccttaaaatggaaagagaatcctctcacttagcacacttctaccctatgtagatttacatcccagtaaaagaacaaaacccaaaactaaaactgaaccaaaccaaaaacaaaacttcacaaaggctcagtccccagttgggctactttaaatgatccatttctggctcaattattgattgagagatcaggtttccacttgaaaaacaaaaggtctttccacaaaaacactaggtcagttgataagctggaagggagtaagcaggggaaggcgtggatctcaaactgctgtaacgccaaggccatctctacctgcctgctgcagttccatgggccagtgacaaagaagacccatttccaaacagtctgcttctatttctatttaatatttccaaaacttcatcatgaaaacacttcgtaaagcacctgtgctaggcacactgtaaagctccaatagatagacccaatttctatacctcattatccacactaagcaagccacatataccaaaaatttctttttaggagcatgtctaagttgccacccagccctccccccccccccccccccgcctgcatgctcaagggagagaactgggaagcaacttccaatgcttgtccctctttatgtattccaaggaatggaggatcatgaaatgttctaaatttatctgcggcaacacaggcacaactctgtgtcactgaactatagacctacatgtgggaagtgaatgctattatgacttatatctcatttaaaacattttaaaaggcagaaaaaaaaaagttcttatcctgactgttctaattagccaaagctatttttaagctctcatgctaactctgatgtagtcaaagggggccctggaatggtgcctccgcagtctccttccatccactgctttctttcccccattccctctctagttccctagctcttatttcttcccttctatccttcaactctgaactagtcttaggtctccattgctagaaccactctatgtgtccccagcggacctcaaaattaaatagtttgcttatcctccacaactttccctgagtgacctcaggccagttgagttctagttctcccgggtagctccagtctgcacagcagggatgcacagtgtgatctgaccccctcccgtgctcacattctatgagaaaatccaaataatgaacggctgcttagccaacaacatcagaagtctctgccacttttgccaacacatgaacataagttagattattcaaccttgcaaacggccaccaggatgcaattctccaaagagccatagttaatgtatttgtacaattatccacatgtaacccttactcttaaatacaaggatttaatttaagagaagtatggatttaatgaagaatgtttgatggcctatctataccagcacctaaaagtccattttcaaatgaagaaaaactttgcttattgtggctctgttgtatggagcaaaccaaagaaaaaataagactggggaggcactgcttagcgcggtgcttcacctaatttctgaaaggcggacttgagcaacaaggagtagaaagacctgacacagacagcatctcagtctgcatcctaaactccactgagagagcaggaaccactgcaggaatgactttagccactcacggctttttatgcagaccagttgcattccccaaaccaaagtcatagaaatatttagtcaccagttttccagcatactgccaccaggcaaattctcagtattgtttccatgtgcccagcatcagaaagaataaccattttctcttacacacacacacacacacacacacacacacacacacggcagtgtggggggggggaacaggcagacaggcagacaggcattgagaagccatttcctttgcagaatctactcttaaattgagggcaaaaaaaatgataaatattagttgctaagaaaaatcctgtggcgaagcctctcttcagaagcaaacatcataagcctgattcataaaaaaaaaaaaatatccctaaggagcattccctgtcaggaagccgaaagccaaacatggagagaaatgatttgaagtgtccttttgcatctctctctccaattatcttagaccaacaagctctcctattagttatcctgcctgcactcctgtcttgcatcaagcctggtagaaaaggtgacagggccctttctcttagggctcggagggcatggaactaacgtgggggaggggcgggaaggacaaaggtggtcgcttttgagccttcttagctttgtcacagggatcctagcttctcccgttcttcttgcactactagagcacctgttagcaccaggttcctcctccacagagcttacaggcctgcagggcctgggtgtccaaggaacccaggcactgcagccctaaggggacaaaggccaggattacaagagggaagagagacgaaagatgtctggtaaagaatgaaagccttgagaagaccggggacacaaaaatcctaaactagttgctggagttcctagggttagggagagaaacgagcatggggggggggggagatttaaaattcctctgagggatcgagggcagctggggactcagcaggaaggaggctgtgggctgcactgaggctttaggacgaaaaggggcaacagttgatgggtgagaagaagtgatggcacggaggtaaaagctagacgaggttcagagggcgcagagccccttgcagagcagtcgaggaagccaaggtggcggagaaggggcctcggggtgtacagcgcaggttttagggaagaggacagagatggggcggaatgttggaaaagaggctgagaacagaacagtggagagactggggggactgcgagggggcctggcccccgtccgtcccacctcacctggcgctcagtcggagtccaggtctagttgtcgagaaagcgccggctccggccggtccctctgtcccgcgcgggagaccacggacacaaagcggggcgcgcgggaggaggggagaaggggaggagggggaggggatagaggaggagacgccagaggcgagaggggaggaggggcgcccgtcgccctccgcctgggtcagagggcggggcgtacggctggaggccgcgctcggcgcaccaatggttgtccagctggctggcaggctggggcgcgccttcgtacagttcacctcctcacctgggcctccgctggcccgagccaatcaaacacctttgtttgcataaccggctccgcccactcgcccctgcggagggcctactagctgagaatacaaagatctccatatgggtgtgattctattcctgaatcccccatcccaagggctcagtatcaccttattttgatgaagggaaataagtgggacctccatgatctcttaggaaatcggatttcttactctctgaagttcttctaactgagttactctttcccagggcacactattcccaacgaccgcctcagagccctaaattcccccctctgtctttcccatttgccctaaaatctcttagtggtgtttctcgtgggctgctgcccactacaggcttcctgcagtactgcattcctcatctgcaagatcttagcactgcttagattgatgctcccaaaccaccatagctaccacactgtctagagggaaaaggaaataagaggttactgcaccagaatatcgcgaacctggtcaaatggctttgttaccgacggtgggagaagtcaatgctaagcatacgttgaaactcatcatctttctccaccttcccttctcttaccttcaggtctatactgggccacaatggtgactgactggccagcccgtttcagagcagccgctgcttgctcgtgggtagcattcctcaggttgactccatttacctgtccaaagagaggagttgtgagctacctcaaaggcaagagagagagagagagtcccccccgcccccatagcagttataaagaggatgtacagcctatctctcagcctatttggattggtcttccacaaattccatcctgtccccacaaattaggcctaaaggatacaatacctctggggtaataattatttttgtgggagtcaaatgccaatcaaagttaagatctaaagacattcatttcttcctccagcataagtctagtcttgttctcttttccctaaagatatttataaaaacaatttacattttcttcaggtctcagcccttccctccgtcccaagaaacactttttggtggacacagggactcccctcctcccttttacccatcctcccacccggactttgtctcaccgataagatccggtctccccttcgcaactccccacttaggtctgctgggcctcccgccaggatgaaggaaacaaaaatgccttctccatcttctcctcctacaatgttgaagcccaggcctgtagaacctttgtgcaggatgatcttgcggggctctctggagagaaataaaagaagataagaaaaggtggagtgggcagtcaggaaaggatgataggaactgttgatgctgtgaggaccaggccggcacagaacccatacttgctgtaggaagtcaagactctaaagggcttctctaatgtgatgccctgtgcttcccctttgactcctgaaacttgcttggctgctcttttatgccaggtgccaagtttcagttccttgtccctccttcgtaaagtctcctagtcaatttcccaatgggcattcctcagcactctcaggtccacaaaaacgtcatccagaactctggagcccaaacttcacagcccactccctcattttcttccctgagtcttctgttctagtcagctctgtgaaaggccctggactgaaagagaaacctggtaagggcagtggagtcaccctgggttgatctccctgaccatccaaaagctactctcaactatatgtccctttctaccttcccccaacatggcagcctccactgaccaatggtggtgtggaagaagaaatagatgaggatgaggaaatcccaggtcccaaaataggttaaacttaagagaggagaatatatatatatatatatatatatatatatatatatatatatatatatatatatacatatatatatatatacacacacacacacacagtgccacccggtaagtggaaattatctgcatatggatatccatacaactagcccgactccccagcacactgtcccatcctgccatcttcatttggtacaagcatctttcctgagagaaagcccaggtctcaagtgagcctcttcctttcttgcagttccgagtcttggggttgatgcttcctacctggcatcccctccaggccgcagggaacggagcggccaggcccacctctgcgaagccctcctccaggctgaagcagaggccgagcccaaacccagggccaagcttgagcctgagaacttgcgagccgtctccatggctcctctggttctccccgggtcagcctactcttctgtctccaccactgctggcccagcagccacctaggccccaccctgcaaacctgtccccctgcaaccctggccggccggcctgaccagttcaacggccccggcccgccgccaccaccatggggcggaacccttcctcctgcggtcccgggctggcttggaggcctctctgactcccgccaaccccgtcagctaaaaggccttcttcagcgactatggatggctgccgaagagaggattgatactgtcgcagggcaggaagacccccgctgcccccacttcctcagccccctagacgcttcaccccaccccggatctgcattttcggatctgggccacttgcttggcactccccctgacggcggtaatcgtccttgcagccacctctgtttctgaagtccgaaggcctcacagagaagggccccagatcttactgctggggatgatgagggccttgcccttttgccatactacaagaaggcctgtcaacagccagaaaatttattctcaccccctctaggttgaaagaacaggagagtgtcttacctggtaaagtcttcctcagccagcatgtgtctgggaataggagagtaacgagtagggggcacctgaggtggagcagggtaggtgaccttgctctccactgccccaagataacccaggctggaattatggcttatgtgattgtcagccaaggcagtgaaagctgaggtggagagagagagagagagagagagagagagagagagagagagagagagagaggtgtccagagatgttccactatagaattttttcccaaccccctcaaaggatttttccttacatcctacctcaggtacaaaaaggaccaaggaatgccgattccctaggccactgctccctgctctacccactacccaccctcaccccagggttcctcctcctctgtccctttctaaaccctaggcttactcctgtgagtcttagaaagagctgaagtcaaagcagtctacaaagaaaggcatgactagaggtgtgattaataataataataatcccttacatctctgaagcctaatagttttccaaaggctttctcatccatgatctcactcaatccttgcaccagtcctatgaggaaggcgatacacacacacacacacacacacacacacacacacacacacacacacaccattagcttatttggactaaagagaaaaactaaagttgtgaaaaggtcttgtccaagggcacccaactccaaagcacaaggctggcacctgaactcagttatgacaataccatcagtactagttctttctgaacaaaggggccagacaccgtctccactgaaaccagggccaaagagcaatgagtacgtactgctggcatagtcagggggagcatacatatcgttgaggtggatgctgcctggcttggccaccttcagatagaccatgtctgatgtgttcttgagtgaggccacagcttcctcatgcctcacatcctgcagattggtattgttcacctagaagaggagacaccctagggtgggtcttagaagggaaaacttctccggggcactcaaaggagtggtctttcagcatactaacaggtaccagtcgggtagggttaaagggataatatataagcatggttggccccaccatgggaaaaaactagggccttgttagctgagtaagaccaactcaggtgatcttgaaattgccaaaatgccttatcctgaggtgaggttttgatggagtgagacggtttaccagagctgatcctccctaccctactgtttgggcatccccttgaaggctatctcaccgcaagcagccggtccccaatctgtaggcgtccatccttctgagcagctcctccttcaatgatcttggtgatatagatgctgttgtctcctgggatgtgctggttgccaatgcccccagcaatgctgaaacctaggcctaaatggcagccagcaggaagtgggagagagccacagggagaagttagcacggttcatccattttgaagccaatcccctccctctgccctctccaaaagcttcaccatcctatcatcccaaggtcagtaaggattgaaatcggaggtcaagaaagaaggctaggatctgggactggagtaatcatgccaggagaaaaacccctcccttccattcacctatggggcggccatgaacccaggggctgggggtgggttgctagagcacgggaaccaggagggccccaccttttggccctttgagcaggttgacctccatgatagtctcaggtgggggctgtcgcctccgcaccaccaaccgcaccacagggcctgcctccttcagtgcctccacggcccggctgtgcaccacctcggacacgtccacctcattcacccgtagcacacagtcattcaccctgtagggaaagcccaagaggcatgacagtgtgtgccgcccctctattgtcgcctgtatcttccctctcctcggctctcccttcctcctttccctcttcttctccaatataatggaagggtcatccttgtccctcatctccatcctgtcccttccacccacagccctgcttccaggccatctcaccccagcctcccatccatggcagctgctccaccaggaatgatcttggtaataaagatgccagggtcatcagggacatgagggttgtcgatgccacctgcgatactgaagccaaggccagagttgccctgaaagggggtggaagggcacagtcatttcattctgagagcacacaggagggttccatctccttccatatcccagagtcggttctccagattccaagggaagggtggggcacattcatcagaaacctagcagtttctcagtctatgttcaccattttggtggagaggcctcagcaaaccaacccccaccccaagtttccaggcctcagtcaacaagatcaatatttgtgagttgattggtagctgcagtgatgtggcttctgaaggccctgtttcctcataccctcagtataggctcccccgtgagtcttgaaatgctgctctaggccctcccctctcctggatgtaaactttgccccctgtttcccaatctccctcctggaaaacttacccgttccagtactatctcctcatacttgaacatgccatcactgccattcacctaaaagaagacagtagcacttccttcagtgtcttctgcccacctactcatctgccctctcatcagtttactccttccccactcccacaaagatcccaagcacacgacaaggcatctctagatcacagatggggacaggctgaccctgagcgagcacatccctccccttgtatccaaccatatcagtccaaaaccagttgcttgtttagcccagatcaactgtctgagactgagccaaccagtggtgcactcaccgataggctgggctccagggcctcggggttcactaggaggggtgcagggctggcctaagggggatggcagagatggagcatggtgggcaaactgtaccacacccaacatccataggaagcctggtgagggaacctctccatttctgaacaacagttccccctgactttgggatcatagagtcccacaatgtcagatatagaaagacaacatataccactttcacatgacaattgaggacactaaggcccagagtggttgtggggtgtgccaaaagcacactgggagttaggatatagaacttgtatctccaggtactctttggactataggaggtttcaaggccagtggtaatttggctgatcatcccttctccatgttatttccatcagagttatttcccggaagtcctatttttacacgtccttcaaaggtcccagaaatacaagttctcaaatggacaggagtgaaaatcctaatccaaatttttttccaaagcaacttttgatttgaaccctttctgtgctccagaagaaagggtcagggtgggaactggccaggagtctgaggacaaatcagggttaggacaggactggggtagacaaaatttcccatgacggggaacctgatgacccatagacagtaggatcagaatttgtgatcttaagcacacagtagccatggcaagacaggctagtaaggggttcaaaaaaaaaaaaaaacacaggttgttttcagcaacaaatagacattgccttccagacaggacatacttgtggcctttgttcaagtggaaatctgattctgcacagacaagtacacctgcttcctcattcccacaatcattttcaagactaaaggaagccccttgtctccctcaccaagtgtcccagcactgatccacatttctctggctgtgttacacccttctgaagttgtggccccagaagagagcacacagggtgagtgttcttctaacatagtctgctctgcctcccccttcccaccttcatcctctgcagcactggcttcaagagtgctgactagcctcccctctctctcccccttcatgttctgtggtcttaaggagtcagtggggagggctccagctgcagcctcaccctggtcccaggaagaaaaatcactgcttcatcagagacccccccccccgcaactaacacagccaactgaagtgccatacaaccgttacagagcaaaagagagcccatgcaggtacactctctcgtgtacctagtgtaccatgtgtgttccacatgtgataagccatgcccacctagtttgggtggcacctggaggtttcagctcccagtagtccaccctctagctctggtcccacttccactcagggaccttgcctctagggtcaggagccatccaaagatcacccaacaggcccggccctggaattggcacctatttctcactaggcaggccaagcatgagcgtgtgcttataagggaggggcaaaaaagaggggactcactggagagggcaaggaaccaaggctagggacataggaagaggtgtagacagacagacatacagaatggataattctgatctccaagaagccccctcttttgcttctaggtaaaagcacatcctattctccgaagaggacaggggtgaccagatggtcaccagcttgggacagtcagcaccttccatagagagcaaagcctctcctcctctctttccaccctgggggttgcagaactgaagaactagacaggccctccgccatgcgtgccagagacctggctctgctggcccagcctccattttgctgtttctcccacagacgctccttccattttctaagctggcagttcaggctgggagtggaagccggagttgtgcccagcacccaggggctcccaagctgtgccaaatcagagctggggagctaagctctctcacatctgtgggtacccataagggccatgtcccactcagagaagaccctgcattagggcagctaccctttgcctggttccaggcaatatgcctgctttggagcaagaaggcttgtttaacaccccctgccccccaaccccccgcagcacacacttcagagcagcttggacaaaagagtctgtccttctcagcagcatctcagccttgcttgggatgtgtcttgccccccccccttttgcctgttaagcgcttctcatcagggacaacacacacacacacacacacacacacacacacacacgtgtacactcttgaagccacatgcttacacacatatacatggagacaccctcgggcgaacacagctatccctgcagcctcatcgacagagacaccttcacattcagagacacatcctcacatatccatgtgcacgttcacacacaaagggactgggatggagagggactcatggtatggagagatgacgctcagccatctgggcacatgggttctgatacatacattcacacaagctccattgctttcttccacacaccccaacatacatacaaacacatatgtcccccccacgcagagcaccatgccccctcctcccctcctatggagacacacaccacatacaacccccgcagaacctcccgccccctgccagacacagagacactgccacccccccgccctgcactgagacaaacccaaatcccccacactagaaaaatgtgcccctccgccataccatcaccccctgatacaaacagctcctcccaatcccctccaaacggagaccccctaaacagacacacatagaagatgtattttcaacagtctctctttggtcagctgctaaaggctcagatccatagacttggagccccagcaacctctactgctccccagacttcctagaccccaatccctagtcctttgggttgtcccaccagcctcccctcctcctcatctgccggtccttacctgctcataccagtcccggttggtacaggtgcactcgggccaccagccggggccactgccgttgagttttggggtgctcttgccggggactggcttagggggcactggccccacatctcggcctgtggggatgagcttggccttggtgcgaggggtgggggtagcccctgcctgtgaaggcagggtctgcgagctgtagcctccataaccggagctagccccattgcccccacttggcccataggggtccggcacctgccagtccccgtagccaggaggctcaagacgccgcagggcggccaggcgggtcacctcatagcactcggggcacttacagcagtgctggtgcttgtgcatggcactgccccccgcggctcggaccccccagcccacgccagtttccacgccgccgccgccgccgccgggctccctagcacactcgcactgctcagaccaagaaggagggggcacccgtgggggtgccctggctgagcggggcctggggccgggcgggcgtcctggggcctctgcccccacgctgccccgcacccatggctccccctccagcactggcggctccgtgtcgcccgttgtggcttctgggccgaggcccagcggcaaagaagaatcgggcgcccaggcaaaggctaggtgcggcgagaacctcttctgctcaggtccccaggatggatctgagtggagtcaagagcatctctccctggctcccttctcaattgattccagccaatcagagcgcagagtcaggcagcggcagcggcagcagcaggaatgctaa

SEQ ID NO: 580 - DNA, 102 bp, mus musculus
ggttttgatggagtgagacggtttaccagagctgatcctccctaccctactgtttgggcatccccttgaaggctatctcaccgcaagcagccggtccccaat

SEQ ID NO: 581 - DNA, 283 bp, mus musculus
tgacaaaaggaacggcatcctttggaaagcatcccaaaaacaggcacacattgtaccgccggtctccgtggctctaaggacgaccactatcagaaatctatctgtggcaaacgtggctaccctgccaagcgcaagcaaaagtctaactgcagtgccaaggctaagagacgaagtactgcagagactgggcggatgagacaccttaaaattgtctatgggagattcagacatggatttcataaaggaacaacaccgaaacccaaaagggcagccgttgcagcaa

SEQ ID NO: 582 - DNA, 6401 bp, mus musculus
aacttcgctgaggagacgttcggtgatgggagcgcaatgtatgaggggatacggtgcctcaggtttaaaagagcaggaagctgagtgagagggtgcagaaagtgccttcgctaggcggaggttacaggtggtgcctcagagcgctactctgaggctgcagcccggactccggaggggatcggagaacggagtgaaagggacagtttaggagctagagtccggagacgagggagaagttcgtgactttctgagaactggaaagaatgtgtttccccccttgggggaggcatggtgagggactgtggcaggctccactgatcgctgagctgcagaggttcgaccccacgtatggatccagagaataagaagtcagccacaggggctgccgcgatcctagacctcgatcccgacttcgaaccccagagccgtccgcgatcctgcacctggccccttcctcgaccagacctcgctacggagccacacgaaccgtccgaggtggagcccagtctgggacagaaggtacccacggagggacactccgaaccgatcctgttgccctctcggctcccagagccggcagggggcccccagccgggaatcctgggggctgtaacaggtcctcggaagggaggctcccgccggaatgcctggggaaatcagtcatatgcagaactcatcagccaggccattgaaagcgccccggagaagcggctgacactcgcccagatctacgaatggatggtccgcacggtgccctacttcaaggacaagggtgacagcaacagctcggcaggatggaaggtaagtatgactcccttaccttcacgccatccacccttggacccctctagttactctcactccggggccccccattaccgcctttccacccctttggaaagcccaaagatccacctttaatcttcagttagacaggcatttacttagtacatagtatataccacactctgagcagcttgaagcaggaggatcggagatgaataagacactgtccctgctctgaggaaaatcgaattctctactcgctactcagcactttggcttgagctgctccaaacatttattcccacagagaagtctttatcctatgtacagcaggaactgtgtggattctccaccggcacctagccttccctcctccctcccctcccacccaacaccttttggcccattcctgcgggattactcggattccctgctcgcctcccaatacctcagtgaacagaactgttctacgattgctctgcccaagagggagtgggcggtgaaggggggcaaagtggttggtatccatggggaaaggtagcgaccttgtgcactaaggaaagaggcccgcaagctgctatctgcctcagtttaccttctcctgacgaaaatccttccttgtaaggcgctctccaaactcacggggaaagtctttgttcaggaatactactcatggagaaaggaggtatcatatagctttgactttcgagtccaagttggtccttggtctttcttgaagaaactgggaagatctcaaacggtaactctgaaaacttcgccagagaaatacggactctaatcacaaaactaaggagggttcagcccgtatccatgccttgtatctctctctgtaggtggtttgtgttagtgtaccaagtacagcggacagaatggaccttcacgtagacgttagagtgagggagcagatctacaatgtgcggaggggccagactgaacagaagatgggacagctgaccgagacccttggcgctatttctgggtagactgccatgccacaatctgaagctcacaaagagcttccctccttggacgcagcctgcacagctgtttttcttttcccttaagttgattttccagggtagaatgaccacgagtgcttgttacactgggagtagtcccttcttatgacttacacgtaacacggcctttagagtttatgaagtctttttttttttcctccccttttgattctaggaactgaacccagggccgcatggttgccactaagctaaatccataaccggtgaaatctaagaatttttttttcatttagttagtccgccttggcagttcggagtccacattttgcatctgaggaaatgaaggcccagggaggttaggtaatgagtctaccctcaagatgaggacttgaggacaagctttgctacagaccctgcttctctgaggaaagcgtggtttgctttcattgccaaacctagtcaaaagggggccacaagctcccagagtgtcccccctccccacgcaggaagcttaatacttccctggtgttgtgccagggtcactcccaccccaccagggggcggcactcacttgaacaagaaagcttaagttaggtgactttgtgaacagtttatctgcacacatacatgtgcgcgcgcgcgcgcgcgcacctgcgcacctggaaactgacctctgccacttgcttgtaccgaggcctcctggagaggggtcataggtggaagtgtagctcagtagtgaattcctttcacaaaatatgtctctgagcttgacccgctgcagccgccgtgtgcatgtgctcacactcgcgagtgcgcgtgttcgcacatgcgcacacagagacccccaccccacctcacccctacacacacacaccacatttacttcactagacccagaattagagaaaaagaagggaggaaatcacagagctagaagacacaactgtgctccgttactaagagccaggggtgattggatctgcacagagtcaaggaagtcttgctaaaggaactggcacaagaggctgctcaagccatgctcttcaagaaaagggtcaccttttttttttttttaaccagtgagctagaagtggtttcccgctgtctcaagcctgtttcttaggggctcctagcatgtctgaacttcctcctgaatttatttctaaactaaagagctccatgcgggaggggaggtcaaatgacctttaaggtagagcaattatgctcaaattcttagaagacttccaaggagaaaaactgggaaggagcgggtgtgtgtgtggggggggtgcgggtgcgggcaggactgatggaggtacatcagacaccatagaccaaccagtaaaaataaaaataagtaccgccagaaagaggctcaggaagtatcaacgtccatcttgcaccctgggctactagggggcaaaggatatattaatgtgcatgtcaacagtaaaagaagaatgaataacaggacccagtacccaaggcactggagttggcagaacctcaagggaagccttactatacatctagggcctacctaccagttggacatataggggacagttgcacataatctcacccagtctatatggcatttatggtttcatgtatgctcttgctgtcctggaactcactatatagtccaggctggcctcaaactcaacagaaattccccctgcctcccaggtattagatttcaaggcccagtgtgggatctattgggggagagaatgctcttgagcctggcaactctgtgtacagtcccttgtctcccacctcactctacctctccttcctggctttgacaggtgatgctcctgttgtgttccagcctctccttagattagactgctgcccaccaccctccgctatacatatctcacgccccttttctactatctctctcccatccagaactccatccgtcacaacctgtccttgcacagcaagttcatcaaggttcacaacgaggccactggcaagagctcttggtggatgctgaaccccgatggcggcaagggtggcaaggcaccccgccgcagggctgcctccatggatagcagcagcaagctgctccggggccgcagcaaaggccccaagaagaagccgtctgtcctgccagctccaccggaaggtgccacgccaaggagccctctgggccactttgccaagtggtcaagcagcccttgtcctcgaaatcgagaagaagctgatgtgtggaccactttccgtccacgaagcagttcaaatgctagcaccgtcagcacccggctgtcgccaatgaggccggagtctgaagtgctagcagaagaggaaatgccagcctcggccagcagctatgcagggggggtccctcccacgctcagtgaagatctagagctactggatgggctcaatctcgcatctccccattccttgctctctaggagcggtctctccggcttctctttgcagcatcctgggcttgctggccccttacatagctatggtgcctccctctttggcccaatagatgggtctttgtcagcaggagaagggtgcttctcaagttcccagtctctagaggctctgctcacctctgatacaccaccacctcctgctgatgtcctcatgacccaggtagatcctatcctgtctcaggctcctacacttctgttactgggaggaatgccttcctctagcaagctgggcacaggagtcagcctgtgtcctacgccgctagagggtcctggtcccagcaacctggtccccaacctttctgtgatggcaccacccccagtcatggcaggcgctcccatccctaaggtcctgggaacccctgtgctcgcatctcctactgaagattccagccatgacagaatgcctcaggatctggatcttgatatgtatatggagaacctggagtgcgacatggataacatcatcagtgacctcatggatggtgagggactggacttcaactttgagccaggtatagcacccctgattcaccccagcatctttgctcttgaatattcaactaattctatgctctgagccagagggagccttacagcagataataggagtccctggggaggtggaaaggtggatgtcatactagaatagcaaaacttctaaatggggacctgtgggctcctcatcacagaagggggagctttgggggagggaagggtgaaggggtgcctctggtatgactctgctgtcccaaatgaatttcttagcttgtcctccatttcttttgttccacagatccctgagtcacagcaagaagctttgtcccctgcttcggaggtggaggtggagccaggcctgtccttatccacttttcctccttgagccctccccaggagtttgggaccctactttagagctaaggattggtggcaacacactcaagtgttgaggaaattataaagataaatctatgacatgtagggattgtagaggagggtgataggaggagggagggaaaagggctttgtctcactgtgccaattagggggtagttatggtcctttctcaggggccaccattgatttcctcattcccacctcctaggcctgtagcaggggccagcaatgctgttgaaatgtgaagtcaccagtggccttattaccctgcctttgggagcaggattattattttttttggtagagagtcttactagagctgggccaggctgggttgagcctggatttttatgcagtggggtgggtgggtggggggggccgggggacctaaaagggccaagttttgagcactggagtggctcaccaggccaaatcacttttggaaggatgcagataacagacaggctttttataaacttttaaagaaatataaacacaaatatagagatttttaacagtggtgaggtgctagtgatggggagaaggcttttttttttctttccgaaggctttgtcatagtgacatgatacaaacactacagactctatggaggagacacaggaagctagggagaggtgggtagcaagagttttaagcaaagaaacctaagtcaggtccccacattctgttcacttgtgcctagaagagagtgctgttgtggggcaagcacactcttatttgaccagtgcaggttagtgctcccagagagagcatccaagtcctgaaattggcttggggcctgggaggggcgtgaaagaaggaaggatttagggtagtaaagttaggtacagagacctcgctgttcaaggcctgggacagctgtccctgcccttcttccctgttgtggtctgccagggttatgtggaaggctgtgtagcagcaagcagggctgtggagaggaacagggaagggagagcctgacgagtttggctgagggtctgggaaatgagcagggttggggggaatgtggatcaggtttactagcacctgccagagaggccatctggggctcctccaccccagcccccaagcagcccctcccccagcgcctttgcattgtcccctcccccactcctgctgtgggttcccatcatttcctgtgtcagcgcctggcctacccagattgtatcatgtgctagattggagtggggaagtgtgtcaaatcaataaatgagttcaataaatgtctataatcaga

SEQ ID NO: 583 - DNA, 14552 bp, mus musculus
agaaagtagttccggcttgtgttgtttcggtcgaggagccctcgccgccatttcaagacagtgagaggtagatgtctaccaagagttcctaagattcgagttcagtattctgtgccgccccctgagcccttcaaaacactgatacggctgctgccttttttctgctacttctagaaccattcttgtcagtagtggcggcagtagaagtcaattaccccttgttctatctcaagaagctccagatggcgtcttccgtgggcaacgtggccgacagtacaggtactagtgtcccattctactctggcagacgtccctttggggtctggcgccgtcttgtatctttcattacttccctctgaccatccccattacatcagtggcattactgagctctcgagttctactgctatctgatcgggtttggtgctgccgtccgttcgtaaacattctctagttgcttgcttgcattttgcttgctttgggggctttttcgttgttgctttatcccatcagtgttgtagccttctctctcgggacgaatctatagcacacgtgcgcgcttagtgtgtcttggaatgggctgcattggaatctctgcaatttctgtctcccgtcgcaactgttttctccctcaatttcagcccgtcgctccctcccgtgcgcttccacctcctccccaaagcccctttcccttagccacatttggtcctcctttgccaggctagggcggggatgctatttcggtgtaatcctagcctcactttgcatcaggcatgactagcgaaggctcctcggtgtgcttccaagtagcaccaagaagagctacttgagcccgcaccccgccggggcagcgccttgtgttcttgggttgagcggccccgatttaggttggaaatttccaggggttctcttagccatcacccaattgcacccgctgccccagtacggagtttcctaccctggtcagccctccctgcttgttgcaaccacacccttcctctgcgaacgtgccagcccgacagtcgtttcttatcctcagggaagaaaccacctcggtgtgttgcttggcggcgaccaccctgcccgccctcctaattctctttctttgtgttactttctctatgtattcctccgccatggcctctgggttttcatccccattctttagcccagtatctctttatccatagggtgtgcattattatttcttttttaagtttccatccttgcttgaagagtttgtaaagcaactggagtgtagctgcacaagtgcaaagcggttgcctcttttcaacgatgcatctccaagcctttgctacagaaaataagaaaacaaccaaattgtaggagtgtccttcaactgcctttccagattgaggctgtttggggcgggaggggatggggaaccaggctgcagctctaaggttcccgagaggttattgtttctcagtgtctaggttttagttgacgattttgaatattgtgagataaatagatgactctaaaatagtatctcatccttaatagatgggaatgggatcaagatttccacctttctgtttccccatcatgattttcaaaaatgtaagattctgtcgtaggtttttgtaagaacttgctcttttctgactgttaactttatttgaagaaatggtcatttccagtattaaaagagcagatatgtgactttggaaagtgataggtaatgtgctaaatttaggagctagaaagtgctacgttcttgtctaacatgtaattttctagttgatcttctagctccaacctcagatttggacacaaatatttttggtctttgtttttgtggttagctgtgcagaaattgctctggtatgggaaagcctggctcaaatttgagcttgtccccatgaccttggttaaaattaagtaccaggtctgtggtttcccattctaatctctagagtgttatccttgaattcctaataatgaattattgtggagataaatgtttacagccgagccttaggcgagcacctggattttggcttttattatgttaactaaatcaagtccttcagaacaaaagcattttttgttatttattatattttatcccgtgttttatattattgcagcatttaaaagcttttccaattgtagattgttgcctggttattgaatagggttgtttttaatgtcttagtacttctgtgagagccatgaacacagcagaaaatgtaaggcagcgtgggtgggatttagctaatttgggctcctgagtcctctccagaagaggaacaacgtttgggttttttgtttaaaatgtttggcgaacccattatgaaatgctttagcccttgactgctaagtcatcttgtttatcagctgcttgctttaaaagtaactctttggctttcagccggtttctttaggctggctctttttaaaaaagaaagctgtaaaactcacaaacatcaatataaagagttaaagagacacctggtgtccccacccacaccgagagagttagaatacactccaccttgaaatgtgagatgaagtattgttaagcgataggttattctgacaataaatccttgtaacttctgcagatttcatgtttaatgttttgtgtcagtatactaagtttagtgattttagtgaatcttcctatgatttgtaagaaaaagtacaaaatgtaagaaaggaatcttttctggaagtcaatattactatggggtttagaaaaggaagcattaacaatgggcagatttgaaagagatcaattctgtagactgggttttaaataaaatgcagaacactctggtgctttacatagtttcaagcattttcatctttaagtttaatttaccatatttttacattttttggtttgcatttctaacttttgttttcccccctccttccctcaaatgttttgatgattctccagaaccaacgaaacgtatgctttccttccaagggttagctgagttggcacatcgagaatatcaggcaggagattttgaggcagctgagagacactgcatgcagctctggagacaagagcctgacaatactggtgttcttttattactttcatctatacacttccagtgtcgaaggctggacaggtaggagatgccggggtaacctgcctcttggtgctgagcttaaaaatgctaattaaatatctgaacttcagagttttccagtgctgggtttcatctgagccaccaacgcaacatgtgcgctcttgttcacttttgacatgcctggttgctagttttcccccgttttgcgggggtgaacatatcatcagtatgactagggtcttttcccccagattttgtcacttgaggatattcttttcaggtaattattcttagtgtacatctgagcatccagacctgtcagcttgagggactctggtaggaggggcatatgtagctcagattggaaatacccttattaaattgttgttgcttttagctaattaattgaattaatgaaaagagaagaatttgtgctatggatatcttagtaaattatcattttggcacatttaacatgaagatgtgtgtttttaaatcttttttttttctgaaacagggttgtgtctttaaatcttgccaacaaatggaaaatgagactcatatgctttttatttttaatcttaatgatgttatacaatgtggcagtttggtagtagattttaataagaattttcatacataagaaccagctttcttatatgaaatgtggatactgtaaccttaggaaagttttagttttcaaacttttttctgctgtttgctagttaaaggataatgttccatagcacaagattttccattgcatatgagccatgcctccttttctctgacatgcatatccatgcatcaacactttttatttttccagatctgctcattttagcaccttggcaattaaacagaatccccttctagcagaagcctattcgaatttgggaaatgtgtacaaggaaagagggcagttgcaggaagcaatcgagcattatcgacatgccttgcggctgaagcctgatttcattgatggttatattaacctggcagcagccttggtagcagcaggtgacatggaaggagcagtacaagcctatgtctctgctcttcagtacaatcctgtaagtaaacgtttattagttgctttcctttcacagcactccagaaaacaaacaagcatcgtttgatacttcagataataggggtttttttcatgaaagtcaagagttgagagagatgtttatatacttgaaatgatgaaatagctttgacttagtctgcatgacatcaaaaaaaaatcgattctatttaggaagttaaaaagcataaaaatgccgggcggtggtggcgcatgcctttaatcccagcacttgggaggcagaggcaagcggatttctgagttcaaggccagcctggtctacaaagtgagttccaggacagccaaggctacacagagaaaccctgtctcgaaaaaacaaaacaaaacaaaagcataaaaattatccttaccaaaaagtctgaccagttatttctaatgctaattaaaacttaacacacgtgatttttttttttttttaaagatttatttattattttatgtaagtacactgtagctgtcttcagacacaccagaagagggagtcagatcttgttatggatggttgtgagccaccatgtggttgctgggatttgaactctggacctttggaagagcagtcaggtgctcctacccactgagccatctcaccagcccgtgattttttttttaagatttattttatatctaaggacactgtagctgtcttcagacacaccagaagagggcgtcaggtcttattacagatggttgtgagccaccatgtggtttctgggatttgaactcaggaccttcagaagaacagtcggtgttcttacccgccgagccatctatctctccagccccatacgtgatgggtttgtgtgtgtgtgctgttttaatgaacttggataaattctgatgggtatttatagcagttagttgatttttaggaatgatggataaaaggtcttaatctgtaatataaaattttttaaaggtgctagaatattagtaactacaaaacgttctgaatacctcccctcagtatagtcacaagtaatagaattaagacaattacagatctagaccagactttgaattagctcttcaatttttttaaagtctaagttacatgtgttttcgtggagaacaagtattagagtctgtgaaagatcaaaatatagtgtgtaaaacaaaacaaaacaaaagaaaaatttaaaaagctacaggatgtaaaaattgccctggaaactgttgatggtaatgaagggaaggtggctgtaagcttttaagaggtaagtagtaggggtgggggatgggtcttggcatgcacttgagttaagttgacattgagcatggaatcaccctcgaagtgcttaatgattaactgccattattgaaagtcttctacaagctcagacactgctgcttcagataaatgtcctctgagtctttaccatgatcctttggtgaggatggcattatttctagttttgccaatataaaatccccagtaggctttgggttatgtaaggtttttgagatcacatagctagctagcaatggagaagtggatgttgaaacttgaagttgaattatcaaagcaaatgttgacatgaatgaaaaatgaaagctaaaaagggccttctttgccccaaagcagccattgagcacagcctggaaaccattagacatataagcctgcctcttgactctaattttatagtttaggaaactgaagcttattttagtagtttgccaaaactctgtgatcatttttcatcttaataactttttagtaatcattttgaaagttaattttgaaaattaaattctattgttttatttcaaaaaagaagattaaaaaatcactgtggaatgctattttaactttctagatgttctgtatagagcttgagtcagggcaagcactcatttgagtggctacctttagttcagctaaatggcgctttttttttatttgtgagttcattataataaacactttttattcattgctttttgatctagtgagaaattgcatagacttggagataattagagcaatttctcgtgtgttctttcagagatattcagtgtatatttgaacttagaatgtatttgtaattagttttaggcagctaaccttgaatgtgttgcctgtggggtttggacttaattcttcctaaggcacaagcctttctcttgtgtgcccagttgtcacaggatagtacattcttttcctttagtaatcaggtttttttgtttgtttgttttttgagacacggtttctctgtgtagccctggctgtcctggaactcactctgtagaccaggctggcctcaatctcaagagatctgcctgcctctgccccccaagtgctgggatcaaaggcatgtgccaccacgcccagcttcacggttttgtttttcctttacctcttgactttgtaaacttcagcttgacttctcttgtatagttgtaatcttggttaagttaactctgttaatttattttgagaggggatctttcaaataggtctctgttagtcaggttggcctccaactcaccaagtagctgagggtgaccttgaacaaggtagctctcccggccctcttccccagggctgagattatcgagcgtcacacccagtttatgtggtactgtagatagaacccaggactttgttgcacagtagataagaacttttccaccagagctagatccctagggccctggctcaggtttttcgttgcctgtctgtgtggtagagcagttaactttgttgacaatataacacaggattatattgagaagggaaaattaaagtgagagaggaagccgtactactttgtaaatatatgctatgtatagtttatgttattaaatatctgacctattaatgaaacagtgtacagagaggtgcttctttatttcgctgttcttcacaataataatgaaggtggggttccgtgaactctctggatctcaccgaaatgcaccacagtggttgtgtttaaagttttcacatatctaatcctaactagatgaaacttcgtatcaagtgcccgttaccagctcagtgctgcctgggttttgagtgtttcttacagtgtgttctttgtgctttatgcattgatactctggtatgggctggaatcggtggtgctgtttacagtctgaaaattaaagaaactcaggttattttggttctgtagaagtgaaaaattaaagcgtcaggctcattttactggttttcagcagtgcttcttttgtaagtttatagatgaaccaaggtaaaagctagtttgtgacttgattatagaagttagagctgtttcattttttttttcatatttggaactgccttctgtaatgctttatggcttaatagatttgctgaaactttagcttgtcatattttaaggtgctgtttcttctggtgttctcttagaattgcccgtacttggcaattcctttacaaattatgcatacatttctttgtgtgatagctgtgagcctgaattgctgttgctaagctgttgagaagctgtttctgctttgatggtagacacactgtgctgagagccgctgccatcccactgtgtagtagtatcctgttggttttttttgttgccagagtcctagctagctaatggtgaggaaacctttcattgctacttgtctccactctgctttttgttaaggttgtttggctagggtcacattggaatattccagtgccgattgttgtgtccgaagcttggggagagattggagaatgtgttctggaggggttatcatgtgagacagacctgacccatgaaggagaaaaaggatgaaaactccttgggtgattattgttggagagtattaatcagaaggttcccttgagaggctgctaagaacctaagcattctgtaggatggtaaacagtaagtagactcaccaggctcaagtgccgagtcaagtaacgaggagtgagtgtagtagagcagagtcgattggaagatctcaaaaagaatagaggctgtggagtttgttttttgctttttgtttttttttttcgagacagggtttctctgtgtagccctggctgtcctggaactcactctgtagaccaggctggcctcgaactcagaaatccacctgcctctacctcccaagtgctggggttaaaggcgtgtgccaccgctgcccggcacagctgtggagtttgagtttaatttgagaggcagttgagaagcactgtaggttcttactggcctggttttcctctatgtgtacatatgtagaggaatgttaagggggtccaagaggtggaacattaagaggaaaattgggaagcacttatattagggagggataatttctgattctttctttaccttcacacatactgggtttttccttgtttttgataccctgttccttttttttgttttgttttgtttttgtttttttgagacagggtttctctgtatagccctggctgtcctggaactccctttgataccctgttcctttgttaagtctctactcagctatgaaggcccagcttaaatctctcctttgaatgtgtttaatttattttccttggtattaggtatattattaaatcaaggttttcatgaaagttactaaggatgggcagaacaagccaggtttaggaaagtgattctcttagtattattttgatttgacagataaagctgaatctgatgcagagttctgaatggattctttttgagaattgtagctttcttatatttattacatgtatgtatgcacatgaatgaatgtctagatttggttttcatggttatgtttactttggtttttaaaatactgttatgtgtatgtgtgttatatctgtggacatgactgtagtgttcttggaggctggaaggaggtgtcagataacctggacctggaatactagacaatttatagctgccttatatggctgctaagaattgaactcagtcccctggaagagcagcatgtgctagtaaccattgagccattctgccagtcctgttttgctgtttttgagactgattctcacttagtgtaagctagccttgaactgattatataactgagaatgaccttgaatttgtgattatcctgctcccatgtgctgggattattgacaagtgccaccatgccaattgaaagatagttattttgtttgtatttgtaataccagggatcaaactcagggcacgtgttctgccctggggctctacttctttcagccactctacccttttacttaataggacatgttttgccttttcttttctttctttttttaagacattctaatatcttttatatatatatatatatatatatatatatttatttatttattaggtattttcctcatttacatttccaatgctatcccaaaagtcccccatgccctcccccccactcccctacccacccactcccactttttggccctggcgttcccctgtactggggcatataaagtttgcaagtccaatgggtctctctttctgttgatggccgactaggccatctatgttttgccttttcttaaagtggacttactattttactgtaaccttgaaggtatttatattctcatctttttacagctctgaagagcaaacatggggcctttggcatgctagttaatttttctaccaattgacctacattgctagtccataagataatctgtttttgttgtagtatactgtgatgaatgtagatgagataactaaataaatatagataatcatccatctaagagtttgtagaaatgaactggtaaaattatgtaacagtgggtaaaaatatatagatgaggctggagagatggctcagtggttaagagtactgatagctctccttgaggtcctgagttcaattcccagcaatcacatggtagctcacaaccatctgtaaagggatctgatgccctcttctggtgtgtctgaaggcagctacagtgtactcacatacataaaaaaatgaataaatcttaaaaaatacagccactagacagttgttatgatgattctgaaatttatggctccgagcagccatagaaattggggaaagtcaagagatgcttattacccgcaaaagtagaaggaacttgtataaacacattggattggatatttaaacatagcctgacaaagagagggttacctttaaggttcaaaggaggaagcctacacaaagtagatagtaagattataaaattcattatttctcagaatacaaataggattccaaagtgcttaaagtaatcacagaagatgattagactgtaataagattaaaggtacctgtgaattgttcgattattttttcattcattcattcattcttcactcatctatttagagtgtgattctgtagtgcaggctagcttggaacttaatatggtaactcttagagtgagggtaggggcttgaactcacgacgatattcctgcctcagtttcccaagtgctggaattacaggtgcatgctacggtacctggcacacattgatgatttggggattaatgtcagcctatgcttaaggttgtgagaagatagacctactcttcaaagcatcagtcactgcctgagggacagcactaattaaggtggatcatggaattgtcccagtttagccagccattatgttattggcagacttcttggttcatccagcgtttgacaatgtacagtacagaaacagcttcatcagtaaagctcacccattctgtaacccattatatacagttgctagaaaaataacatacatgataattctttggactatttggtaaaatttcactttgtaggatttagttgaaggttctttcacccacatgacagttcgggatgataaacgtccttcatgttgccatcatctctgcttgttagtgactgaaaaattccactgacaaaagcagactttgcaagtaaaaatttcagcttactgtctgttgagcatggcatactgatgaacggactggtaagtcagaggactagcaacacaattgagctgctaataaaaagcaaagtcaaccgcttttcattattcacccactcagctctgatggcacttaatattaatgaggaatctagtggcaggtggcaggattgaggctgtggttggatggtaatccttctgcctaggcatgaaatgaagtcaaggtttctaaataagcctgagagccaaagggttggtttgttgacaggtaatcacttgctaagtggagcactgtgtctcccccccccccctggaaaatttctggtccttgatataggagtgattcatcataaccttgaataaaacagttgaataaatattcaatcatttttttttccaaagggtgacgtttggagaggagagaggctctagaaaggtcttgtagtcttgtgtttgaaactgatgaggccaaatgcatttgaaaggatgctagacaatagtgtcatatgcagatctctcagccaggacctgaaccgcagctgatagcaaaacacatttatatctgtgcagctaaaggtagtattcagggctggagagatggctcagtggttaagagcactgactgttcttccagaggtcctgagttcaattcccagcaaccacatggtggctcacaaccatctgtaattggaaccaatgccctcctctggtgtgtctgaggagaaccacaatgtagtcacatacataaaataaataaatcttaaaaaaatgatagtattcatactaagaagagaaatcaattctgtaaataatgtattttaagttcaggttaggattttaccatccaattagttttgcattttctgggaaatagatgattagctgtgggcctacacttacgtttgtcaagtgctgcttttaattgacattgaaacaacagagctcgatgcatagatgtaattgttggggtttgtggatgaggaaacagcataattaatgatactgtctctgggtttctaggatttgtactgtgttcgcagtgacctggggaacctgctcaaagccctgggtcgcttggaagaagccaaggtaggtgtttgctagaacacatttaagcattagttatgaaaacctgtaccttttgccaagtcttcaactcttcattgagctatcttcacaaaatagtcctatgaaactgagaaaaactgttggcatgacttgcctcagactagagcaggactgggcttttggcataatctgttctaaatctgggggtaaagcaagaccgtgagcattgtggagcctttctactgagttagatcatctttaataacattgggctccatcatgatcttatgtgggaatcaataacattccttcaaatctgaggcttgcctgctagtgacaagcagagtgcctgtgatttggctcaagacgcctatatgatgcaggtgccattgaaaacgctgctcttctaagtcctttgtggcttgtaagtggagaagaatttcatccaaatgttaccctgtaatactggcatttaaaattcttatttaaccttcctcccttcatcttcctcacccttttacagtggaagaaaggctgttaaaacattgcaaattaataattggaacatcctgcccctcttgtccccacttcctcctcaaattcctttccccctttcccccagtcctagttgtctatctttttttttcttcctcacttccttttcttttatcctcccccaccccacctcctttaaaaaaaaaaaaaaagtcagaaggacaaagctggtttgtttgggaaatggactgatcgaaagaaaacttgccaaagtggcaaggtggcttttagcattctgtgtttccaaataatgaatttgaacaccaggttgggttaattaaagcttttggtataatttacaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagcgtagctgtctgtttgactgctcatccagggagggcgaaggcttttcagcagcacctaatgtttaaaaaggcactagttttaagtgcataacttcatcaattctgccaacactgtggattaaccttctgtaggtttccagctgataaactatgttaatttcaatcttagctgataaagcgattggtaatttcctgaacaaatatttgctatgctcctatcaattgtcaccccaccaagcggacagctaacatgaattgcacttcactgcagctttagacatcggtttaggctgagacgttgcgcctgccttaggttgctgacttctttatttcagagctctggagacacctagtttgaaaaatgtcattctgttttttttttttgttgttttttgtttttttgttttttgtttttttttttttttgtgagaacttagtaaaccagaaaatactcttgagtgaaatgcaatgtgtttcttttgtaatcagtgcatttgaaaattcaagccagcatatattcctagtagatggaatcaaaattaagttgtctttaaagaaagtgaagagcctttcttccagcaaaactccctgctgtatgcaatagccctgattaaccctctcccttctgcatgtttcccatgttacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaaaagaatgttttatactatagccacaattctgtcaaaaataagtaaaagttaattaagatattaaaattattagataatttactagtaaaagcttctaactcttcttgttgttcattttttttcctttttcttctttgtttggattgcagcattctgctcttctgatgatgcgctgtgaccctgcagtagcgcaaaggctgcgcagcgttaatgcgcattgcgtgcgaatgagcccctgtgaacggttgactagatgagtaatctgattgactggctctcacagtcctattctgtagcctttttggataaaattgggttttaacgtaccttgagtccaactaatctcattaagcaaatattct

SEQ ID NO: 584 - DNA, 14552 bp, mus musculus; identical to SEQ ID NO: 583

SEQ ID NO: 585 - DNA, 14585 bp, mus musculus
ttgtgttgtttcggtcgaggagccctcgccgccatttcaagacagtgagaggtagatgtctaccaagagttcctaagattcgagttcagtattctgtgccgccccctgagcccttcaaaacactgatacggctgctgccttttttctgctacttctagaaccattcttgtcagtagtggcggcagtagaagtcaattaccccttgttctatctcaagaagctccagatggcgtcttccgtgggcaacgtggccgacagtacaggtactagtgtcccattctactctggcagacgtccctttggggtctggcgccgtcttgtatctttcattacttccctctgaccatccccattacatcagtggcattactgagctctcgagttctactgctatctgatcgggtttggtgctgccgtccgttcgtaaacattctctagttgcttgcttgcattttgcttgctttgggggctttttcgttgttgctttatcccatcagtgttgtagccttctctctcgggacgaatctatagcacacgtgcgcgcttagtgtgtcttggaatgggctgcattggaatctctgcaatttctgtctcccgtcgcaactgttttctccctcaatttcagcccgtcgctccctcccgtgcgcttccacctcctccccaaagcccctttcccttagccacatttggtcctcctttgccaggctagggcggggatgctatttcggtgtaatcctagcctcactttgcatcaggcatgactagcgaaggctcctcggtgtgcttccaagtagcaccaagaagagctacttgagcccgcaccccgccggggcagcgccttgtgttcttgggttgagcggccccgatttaggttggaaatttccaggggttctcttagccatcacccaattgcacccgctgccccagtacggagtttcctaccctggtcagccctccctgcttgttgcaaccacacccttcctctgcgaacgtgccagcccgacagtcgtttcttatcctcagggaagaaaccacctcggtgtgttgcttggcggcgaccaccctgcccgccctcctaattctctttctttgtgttactttctctatgtattcctccgccatggcctctgggttttcatccccattctttagcccagtatctctttatccatagggtgtgcattattatttcttttttaagtttccatccttgcttgaagagtttgtaaagcaactggagtgtagctgcacaagtgcaaagcggttgcctcttttcaacgatgcatctccaagcctttgctacagaaaataagaaaacaaccaaattgtaggagtgtccttcaactgcctttccagattgaggctgtttggggcgggaggggatggggaaccaggctgcagctctaaggttcccgagaggttattgtttctcagtgtctaggttttagttgacgattttgaatattgtgagataaatagatgactctaaaatagtatctcatccttaatagatgggaatgggatcaagatttccacctttctgtttccccatcatgattttcaaaaatgtaagattctgtcgtaggtttttgtaagaacttgctcttttctgactgttaactttatttgaagaaatggtcatttccagtattaaaagagcagatatgtgactttggaaagtgataggtaatgtgctaaatttaggagctagaaagtgctacgttcttgtctaacatgtaattttctagttgatcttctagctccaacctcagatttggacacaaatatttttggtctttgtttttgtggttagctgtgcagaaattgctctggtatgggaaagcctggctcaaatttgagcttgtccccatgaccttggttaaaattaagtaccaggtctgtggtttcccattctaatctctagagtgttatccttgaattcctaataatgaattattgtggagataaatgtttacagccgagccttaggcgagcacctggattttggcttttattatgttaactaaatcaagtccttcagaacaaaagcattttttgttatttattatattttatcccgtgttttatattattgcagcatttaaaagcttttccaattgtagattgttgcctggttattgaatagggttgtttttaatgtcttagtacttctgtgagagccatgaacacagcagaaaatgtaaggcagcgtgggtgggatttagctaatttgggctcctgagtcctctccagaagaggaacaacgtttgggttttttgtttaaaatgtttggcgaacccattatgaaatgctttagcccttgactgctaagtcatcttgtttatcagctgcttgctttaaaagtaactctttggctttcagccggtttctttaggctggctctttttaaaaaagaaagctgtaaaactcacaaacatcaatataaagagttaaagagacacctggtgtccccacccacaccgagagagttagaatacactccaccttgaaatgtgagatgaagtattgttaagcgataggttattctgacaataaatccttgtaacttctgcagatttcatgtttaatgttttgtgtcagtatactaagtttagtgattttagtgaatcttcctatgatttgtaagaaaaagtacaaaatgtaagaaaggaatcttttctggaagtcaatattactatggggtttagaaaaggaagcattaacaatgggcagatttgaaagagatcaattctgtagactgggttttaaataaaatgcagaacactctggtgctttacatagtttcaagcattttcatctttaagtttaatttaccatatttttacattttttggtttgcatttctaacttttgttttcccccctccttccctcaaatgttttgatgattctccagaaccaacgaaacgtatgctttccttccaagggttagctgagttggcacatcgagaatatcaggcaggagattttgaggcagctgagagacactgcatgcagctctggagacaagagcctgacaatactggtgttcttttattactttcatctatacacttccagtgtcgaaggctggacaggtaggagatgccggggtaacctgcctcttggtgctgagcttaaaaatgctaattaaatatctgaacttcagagttttccagtgctgggtttcatctgagccaccaacgcaacatgtgcgctcttgttcacttttgacatgcctggttgctagttttcccccgttttgcgggggtgaacatatcatcagtatgactagggtcttttcccccagattttgtcacttgaggatattcttttcaggtaattattcttagtgtacatctgagcatccagacctgtcagcttgagggactctggtaggaggggcatatgtagctcagattggaaatacccttattaaattgttgttgcttttagctaattaattgaattaatgaaaagagaagaatttgtgctatggatatcttagtaaattatcattttggcacatttaacatgaagatgtgtgtttttaaatcttttttttttctgaaacagggttgtgtctttaaatcttgccaacaaatggaaaatgagactcatatgctttttatttttaatcttaatgatgttatacaatgtggcagtttggtagtagattttaataagaattttcatacataagaaccagctttcttatatgaaatgtggatactgtaaccttaggaaagttttagttttcaaacttttttctgctgtttgctagttaaaggataatgttccatagcacaagattttccattgcatatgagccatgcctccttttctctgacatgcatatccatgcatcaacactttttatttttccagatctgctcattttagcaccttggcaattaaacagaatccccttctagcagaagcctattcgaatttgggaaatgtgtacaaggaaagagggcagttgcaggaagcaatcgagcattatcgacatgccttgcggctgaagcctgatttcattgatggttatattaacctggcagcagccttggtagcagcaggtgacatggaaggagcagtacaagcctatgtctctgctcttcagtacaatcctgtaagtaaacgtttattagttgctttcctttcacagcactccagaaaacaaacaagcatcgtttgatacttcagataataggggtttttttcatgaaagtcaagagttgagagagatgtttatatacttgaaatgatgaaatagctttgacttagtctgcatgacatcaaaaaaaaatcgattctatttaggaagttaaaaagcataaaaatgccgggcggtggtggcgcatgcctttaatcccagcacttgggaggcagaggcaagcggatttctgagttcaaggccagcctggtctacaaagtgagttccaggacagccaaggctacacagagaaaccctgtctcgaaaaaacaaaacaaaacaaaagcataaaaattatccttaccaaaaagtctgaccagttatttctaatgctaattaaaacttaacacacgtgatttttttttttttttaaagatttatttattattttatgtaagtacactgtagctgtcttcagacacaccagaagagggagtcagatcttgttatggatggttgtgagccaccatgtggttgctgggatttgaactctggacctttggaagagcagtcaggtgctcctacccactgagccatctcaccagcccgtgattttttttttaagatttattttatatctaaggacactgtagctgtcttcagacacaccagaagagggcgtcaggtcttattacagatggttgtgagccaccatgtggtttctgggatttgaactcaggaccttcagaagaacagtcggtgttcttacccgccgagccatctatctctccagccccatacgtgatgggtttgtgtgtgtgtgctgttttaatgaacttggataaattctgatgggtatttatagcagttagttgatttttaggaatgatggataaaaggtcttaatctgtaatataaaattttttaaaggtgctagaatattagtaactacaaaacgttctgaatacctcccctcagtatagtcacaagtaatagaattaagacaattacagatctagaccagactttgaattagctcttcaatttttttaaagtctaagttacatgtgttttcgtggagaacaagtattagagtctgtgaaagatcaaaatatagtgtgtaaaacaaaacaaaacaaaagaaaaatttaaaaagctacaggatgtaaaaattgccctggaaactgttgatggtaatgaagggaaggtggctgtaagcttttaagaggtaagtagtaggggtgggggatgggtcttggcatgcacttgagttaagttgacattgagcatggaatcaccctcgaagtgcttaatgattaactgccattattgaaagtcttctacaagctcagacactgctgcttcagataaatgtcctctgagtctttaccatgatcctttggtgaggatggcattatttctagttttgccaatataaaatccccagtaggctttgggttatgtaaggtttttgagatcacatagctagctagcaatggagaagtggatgttgaaacttgaagttgaattatcaaagcaaatgttgacatgaatgaaaaatgaaagctaaaaagggccttctttgccccaaagcagccattgagcacagcctggaaaccattagacatataagcctgcctcttgactctaattttatagtttaggaaactgaagcttattttagtagtttgccaaaactctgtgatcatttttcatcttaataactttttagtaatcattttgaaagttaattttgaaaattaaattctattgttttatttcaaaaaagaagattaaaaaatcactgtggaatgctattttaactttctagatgttctgtatagagcttgagtcagggcaagcactcatttgagtggctacctttagttcagctaaatggcgctttttttttatttgtgagttcattataataaacactttttattcattgctttttgatctagtgagaaattgcatagacttggagataattagagcaatttctcgtgtgttctttcagagatattcagtgtatatttgaacttagaatgtatttgtaattagttttaggcagctaaccttgaatgtgttgcctgtggggtttggacttaattcttcctaaggcacaagcctttctcttgtgtgcccagttgtcacaggatagtacattcttttcctttagtaatcaggtttttttgtttgtttgttttttgagacacggtttctctgtgtagccctggctgtcctggaactcactctgtagaccaggctggcctcaatctcaagagatctgcctgcctctgccccccaagtgctgggatcaaaggcatgtgccaccacgcccagcttcacggttttgtttttcctttacctcttgactttgtaaacttcagcttgacttctcttgtatagttgtaatcttggttaagttaactctgttaatttattttgagaggggatctttcaaataggtctctgttagtcaggttggcctccaactcaccaagtagctgagggtgaccttgaacaaggtagctctcccggccctcttccccagggctgagattatcgagcgtcacacccagtttatgtggtactgtagatagaacccaggactttgttgcacagtagataagaacttttccaccagagctagatccctagggccctggctcaggtttttcgttgcctgtctgtgtggtagagcagttaactttgttgacaatataacacaggattatattgagaagggaaaattaaagtgagagaggaagccgtactactttgtaaatatatgctatgtatagtttatgttattaaatatctgacctattaatgaaacagtgtacagagaggtgcttctttatttcgctgttcttcacaataataatgaaggtggggttccgtgaactctctggatctcaccgaaatgcaccacagtggttgtgtttaaagttttcacatatctaatcctaactagatgaaacttcgtatcaagtgcccgttaccagctcagtgctgcctgggttttgagtgtttcttacagtgtgttctttgtgctttatgcattgatactctggtatgggctggaatcggtggtgctgtttacagtctgaaaattaaagaaactcaggttattttggttctgtagaagtgaaaaattaaagcgtcaggctcattttactggttttcagcagtgcttcttttgtaagtttatagatgaaccaaggtaaaagctagtttgtgacttgattatagaagttagagctgtttcattttttttttcatatttggaactgccttctgtaatgctttatggcttaatagatttgctgaaactttagcttgtcatattttaaggtgctgtttcttctggtgttctcttagaattgcccgtacttggcaattcctttacaaattatgcatacatttctttgtgtgatagctgtgagcctgaattgctgttgctaagctgttgagaagctgtttctgctttgatggtagacacactgtgctgagagccgctgccatcccactgtgtagtagtatcctgttggttttttttgttgccagagtcctagctagctaatggtgaggaaacctttcattgctacttgtctccactctgctttttgttaaggttgtttggctagggtcacattggaatattccagtgccgattgttgtgtccgaagcttggggagagattggagaatgtgttctggaggggttatcatgtgagacagacctgacccatgaaggagaaaaaggatgaaaactccttgggtgattattgttggagagtattaatcagaaggttcccttgagaggctgctaagaacctaagcattctgtaggatggtaaacagtaagtagactcaccaggctcaagtgccgagtcaagtaacgaggagtgagtgtagtagagcagagtcgattggaagatctcaaaaagaatagaggctgtggagtttgttttttgctttttgtttttttttttcgagacagggtttctctgtgtagccctggctgtcctggaactcactctgtagaccaggctggcctcgaactcagaaatccacctgcctctacctcccaagtgctggggttaaaggcgtgtgccaccgctgcccggcacagctgtggagtttgagtttaatttgagaggcagttgagaagcactgtaggttcttactggcctggttttcctctatgtgtacatatgtagaggaatgttaagggggtccaagaggtggaacattaagaggaaaattgggaagcacttatattagggagggataatttctgattctttctttaccttcacacatactgggtttttccttgtttttgataccctgttccttttttttgttttgttttgtttttgtttttttgagacagggtttctctgtatagccctggctgtcctggaactccctttgataccctgttcctttgttaagtctctactcagctatgaaggcccagcttaaatctctcctttgaatgtgtttaatttattttccttggtattaggtatattattaaatcaaggttttcatgaaagttactaaggatgggcagaacaagccaggtttaggaaagtgattctcttagtattattttgatttgacagataaagctgaatctgatgcagagttctgaatggattctttttgagaattgtagctttcttatatttattacatgtatgtatgcacatgaatgaatgtctagatttggttttcatggttatgtttactttggtttttaaaatactgttatgtgtatgtgtgttatatctgtggacatgactgtagtgttcttggaggctggaaggaggtgtcagataacctggacctggaatactagacaatttatagctgccttatatggctgctaagaattgaactcagtcccctggaagagcagcatgtgctagtaaccattgagccattctgccagtcctgttttgctgtttttgagactgattctcacttagtgtaagctagccttgaactgattatataactgagaatgaccttgaatttgtgattatcctgctcccatgtgctgggattattgacaagtgccaccatgccaattgaaagatagttattttgtttgtatttgtaataccagggatcaaactcagggcacgtgttctgccctggggctctacttctttcagccactctacccttttacttaataggacatgttttgccttttcttttctttctttttttaagacattctaatatcttttatatatatatatatatatatatatatatttatttatttattaggtattttcctcatttacatttccaatgctatcccaaaagtcccccatgccctcccccccactcccctacccacccactcccactttttggccctggcgttcccctgtactggggcatataaagtttgcaagtccaatgggtctctctttctgttgatggccgactaggccatctatgttttgccttttcttaaagtggacttactattttactgtaaccttgaaggtatttatattctcatctttttacagctctgaagagcaaacatggggcctttggcatgctagttaatttttctaccaattgacctacattgctagtccataagataatctgtttttgttgtagtatactgtgatgaatgtagatgagataactaaataaatatagataatcatccatctaagagtttgtagaaatgaactggtaaaattatgtaacagtgggtaaaaatatatagatgaggctggagagatggctcagtggttaagagtactgatagctctccttgaggtcctgagttcaattcccagcaatcacatggtagctcacaaccatctgtaaagggatctgatgccctcttctggtgtgtctgaaggcagctacagtgtactcacatacataaaaaaatgaataaatcttaaaaaatacagccactagacagttgttatgatgattctgaaatttatggctccgagcagccatagaaattggggaaagtcaagagatgcttattacccgcaaaagtagaaggaacttgtataaacacattggattggatatttaaacatagcctgacaaagagagggttacctttaaggttcaaaggaggaagcctacacaaagtagatagtaagattataaaattcattatttctcagaatacaaataggattccaaagtgcttaaagtaatcacagaagatgattagactgtaataagattaaaggtacctgtgaattgttcgattattttttcattcattcattcattcttcactcatctatttagagtgtgattctgtagtgcaggctagcttggaacttaatatggtaactcttagagtgagggtaggggcttgaactcacgacgatattcctgcctcagtttcccaagtgctggaattacaggtgcatgctacggtacctggcacacattgatgatttggggattaatgtcagcctatgcttaaggttgtgagaagatagacctactcttcaaagcatcagtcactgcctgagggacagcactaattaaggtggatcatggaattgtcccagtttagccagccattatgttattggcagacttcttggttcatccagcgtttgacaatgtacagtacagaaacagcttcatcagtaaagctcacccattctgtaacccattatatacagttgctagaaaaataacatacatgataattctttggactatttggtaaaatttcactttgtaggatttagttgaaggttctttcacccacatgacagttcgggatgataaacgtccttcatgttgccatcatctctgcttgttagtgactgaaaaattccactgacaaaagcagactttgcaagtaaaaatttcagcttactgtctgttgagcatggcatactgatgaacggactggtaagtcagaggactagcaacacaattgagctgctaataaaaagcaaagtcaaccgcttttcattattcacccactcagctctgatggcacttaatattaatgaggaatctagtggcaggtggcaggattgaggctgtggttggatggtaatccttctgcctaggcatgaaatgaagtcaaggtttctaaataagcctgagagccaaagggttggtttgttgacaggtaatcacttgctaagtggagcactgtgtctcccccccccccctggaaaatttctggtccttgatataggagtgattcatcataaccttgaataaaacagttgaataaatattcaatcatttttttttccaaagggtgacgtttggagaggagagaggctctagaaaggtcttgtagtcttgtgtttgaaactgatgaggccaaatgcatttgaaaggatgctagacaatagtgtcatatgcagatctctcagccaggacctgaaccgcagctgatagcaaaacacatttatatctgtgcagctaaaggtagtattcagggctggagagatggctcagtggttaagagcactgactgttcttccagaggtcctgagttcaattcccagcaaccacatggtggctcacaaccatctgtaattggaaccaatgccctcctctggtgtgtctgaggagaaccacaatgtagtcacatacataaaataaataaatcttaaaaaaatgatagtattcatactaagaagagaaatcaattctgtaaataatgtattttaagttcaggttaggattttaccatccaattagttttgcattttctgggaaatagatgattagctgtgggcctacacttacgtttgtcaagtgctgcttttaattgacattgaaacaacagagctcgatgcatagatgtaattgttggggtttgtggatgaggaaacagcataattaatgatactgtctctgggtttctaggatttgtactgtgttcgcagtgacctggggaacctgctcaaagccctgggtcgcttggaagaagccaaggtaggtgtttgctagaacacatttaagcattagttatgaaaacctgtaccttttgccaagtcttcaactcttcattgagctatcttcacaaaatagtcctatgaaactgagaaaaactgttggcatgacttgcctcagactagagcaggactgggcttttggcataatctgttctaaatctgggggtaaagcaagaccgtgagcattgtggagcctttctactgagttagatcatctttaataacattgggctccatcatgatcttatgtgggaatcaataacattccttcaaatctgaggcttgcctgctagtgacaagcagagtgcctgtgatttggctcaagacgcctatatgatgcaggtgccattgaaaacgctgctcttctaagtcctttgtggcttgtaagtggagaagaatttcatccaaatgttaccctgtaatactggcatttaaaattcttatttaaccttcctcccttcatcttcctcacccttttacagtggaagaaaggctgttaaaacattgcaaattaataattggaacatcctgcccctcttgtccccacttcctcctcaaattcctttccccctttcccccagtcctagttgtctatctttttttttcttcctcacttccttttcttttatcctcccccaccccacctcctttaaaaaaaaaaaaaaagtcagaaggacaaagctggtttgtttgggaaatggactgatcgaaagaaaacttgccaaagtggcaaggtggcttttagcattctgtgtttccaaataatgaatttgaacaccaggttgggttaattaaagcttttggtataatttacaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagcgtagctgtctgtttgactgctcatccagggagggcgaaggcttttcagcagcacctaatgtttaaaaaggcactagttttaagtgcataacttcatcaattctgccaacactgtggattaaccttctgtaggtttccagctgataaactatgttaatttcaatcttagctgataaagcgattggtaatttcctgaacaaatatttgctatgctcctatcaattgtcaccccaccaagcggacagctaacatgaattgcacttcactgcagctttagacatcggtttaggctgagacgttgcgcctgccttaggttgctgacttctttatttcagagctctggagacacctagtttgaaaaatgtcattctgttttttttttttgttgttttttgtttttttgttttttgtttttttttttttttgtgagaacttagtaaaccagaaaatactcttgagtgaaatgcaatgtgtttcttttgtaatcagtgcatttgaaaattcaagccagcatatattcctagtagatggaatcaaaattaagttgtctttaaagaaagtgaagagcctttcttccagcaaaactccctgctgtatgcaatagccctgattaaccctctcccttctgcatgtttcccatgttacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaaaagaatgttttatactatagccacaattctgtcaaaaataagtaaaagttaattaagatattaaaattattagataatttactagtaaaagcttctaactcttcttgttgttcattttttttcctttttcttctttgtttggattgcagcattctgctcttctgatgatgcgctgtgaccctgcagtagcgcaaaggctgcgcagcgttaatgcgcattgcgtgcgaatgagcccctgtgaacggttgactagatgagtaatctgattgactggctctcacagtcctattctgtagcctttttggataaaattgggttttaacgtaccttgagtccaactaatctcattaagcaaatattctctatgggcctgtctagtagattaatggaatctggttggccgtttgctgc

SEQ ID NO: 586 - DNA, 14585 bp, mus musculus; identical to SEQ ID NO: 585

SEQ ID NO: 587 - DNA, 2084 bp, mus musculus
gccactgccactgcctctactgttgcccctgcccctgttgctgttgcttctgctggcttatacaagataagtccaagaaagaagccagcccaggaaaagccatctcagtgggacacctcaagaggacccgtggcgagaatcttcccaccatggggacagagactcaaatcagctactgtagaaccagccactttccccccaatctcaggggttgctctgctagggaaggcaagtaaatgctcactgccttcagggcccaaagagttcaagtccgtctgcactgggaagaaatccatagcaaagaagacaagggagccacaggcagggcccaaagaagataactcaccgagagatcctggtctgcaggcccaagtgagtagaccatgccctctctcctgtcaccctgcccttccccttcccggcacatacgtttgtgctgctccccctgcccctgcccctgcccctgcccctgcccctgcccctgcccctgcccatgccttggcttgggaagttgtcagtggacactcatcctgattaggatgtctagtgtggagtcctggtggtaaataagggtggatatcaagggagcctcagttaggggttgcttcctgttcccttccctgtgcatttcctctctctaaccaggtctggggagggaaatgtgtctggctgtcagtttgggtggttgctgtccagagagcccctacagtgtgggctgaacaacttgagcatatagccagtcctgagggcctcctggctcctccctggctcctccccaaggaagccaggccaggacctgaggcttttcagtgtctgtgggctccttcctggctgagctctgcctcctgagctgagggtgactgaggacaggaggtgcagaagggatgagcctcccaagcctccattttgttaccccctttccctcagcccctcaacaacatatactcagtgataagtattttgtgtgtgaggttccactacacagggcagagcagccttccgtgtgcatgcatcgtggagaaatgagcagtggagactccaacaccagagcccctcaagttccagcaaacccacagttcttcttgatccagagatgtgccagacccagagcaccacctgcacctgctggtgagactttggggcttggagaacagtgggggaggctggggagagggaagcaacctggggctctgttcttttgaggattgcagccttgcttcttaggcttctctgatgaggtaggtagggagtccacaggagactgggtatggtcagggctgacctcaggtcacgttgggaaatgagtgagattgtgggatgcatgactttaaaggtagggcaatatgagttccatcttgaacacgacagattttgctgctgagccctatacatgcactgagctcctagcttctagccatggtggtagtcctgctagcatacactcagtgccactgtcttaggggctcacagcacctttatgctgcctctgggctgcagtaagggcaagaatagagctagatagaggtgaagacttaccaggtacaaggtgctgccagcagagggcactgcggcctcattttggaccccattagtcccttccaacttatataatcctgtttctcatccccactcctgtgtgtgtctgtgtgtgtttgtatgtttcaggtgaccaggaattacctctacgtctgccattcccagttggcgataggcagcatcaaatacaagccatagggggctgccaacaggtaaaacttttatcagctctctgaaatgctagcctcaggtagaccctgagctgactgtcaaagttaacctgacaattaacctcctgtgccaactcctgtcccaaattgcacgggggggggggggcacctgcttgctcttcaaggtttttgccagtcttatcccaggactgtggatagtgggaggtgtaatgataaagggcacgtgtggatggagcagagaagaagccaggacactgaatattaatctctctttttctttcatgcctgctgggctagtgtgagatgttacagaaggaaatagatgaactcaaggaacaactcggtatggcctacccc

SEQ ID NO: 588 - DNA, 2084 bp, mus musculus; identical to SEQ ID NO: 587

SEQ ID NO: 589 - DNA, 242674 bp, mus musculus
agtgtgcagcccgcggggagccggcgctgcaggctgtgaagccgcctgcccgcacagccgcccgtgcctctcgctcgcccgcgcccgcgtcccgggccctgctccaccaggaccgccgctgcctctcaggattcccgagtgccacaaggctagcggaccgggtcggtccccgcgcccgcgcccgggatgccgttctaccggcgcactgtggtgccccagcgtctgtgcccgcgcaaccctccgcagccgctggctgagctccgcgacgtgagccacctggccgcgctcagtctgctccgccagctcgcagacctctgcggccactcgctggctctgctggaggacctcgaggggcacctgctggctctggggcgccgcaccgacagcctgtaccggcgcaccgtccggctccgccgccgccttccctgtcgcctgcttggcccggaggatgatgaagaattgctaggtaaaaggcgcgaggcgcccgcgaccctctcccacccgcctctggggatgtcccgctgggtctgcccgtggccgcccctcaaagatcgagggacacggcctccaggacgccctcccgccgtccgatccttccgggatccgctcgcccggtcccgagtggccctctgcttaggtctgggggctgccgccacctctggagtgcttggtggagagggaggggatccgtagggtcctgggcggcgcagaccaaagagtcccggtggctccgggaaccgaatggccgtgcctgcgtctctcctgatgggccactttggaaatcgcgcccgagctgcccgcctgcctcccgggcggcgggggccgctgcagccagacccgtgggacctcgtgccggactgcgaacgggcttcccgcgcccagccgtctccgagctcccttcccgctcgcttctccccgcacactccgcgttgcctcgctgggagtggccggcagggggaggggagactgcccagggcttagcggattccataccccaaacccccgccccagccgctaaggtccggctgcccagatttgcgggagagaaccatttaaagagactgtcatcggttttcttaaaaatgtgctcgccagccatgcccgagaaacgccaggtcccgggagtttccttactgaacactaggaacctgtgagactggaggcgggcgggagctcaggctctttactactttggatctcaacactttggatagggaggacctcttctgcaaaaaacgcagcgttcccttagaatgtgggacttctcttaaacggggtcggggctgagtatgtttaaaaatgctgagagtagaggaggaatggcaggtaacagggccaattgccacctagggaaggctaggaaggggtgtcgggggagcagtgtgccagaaagtttcagaaggaggtggaagatggctacttgctgacttttgagggaggccttgggagagaattgtctgggtcagcctttcttccttgcagactccacccctaacaaaatgacaggagtcagaggttctggcgcccctcttccttcataaaggtctctgtcctttgaggtagatggcagaggtcactgctagagaaaaataaactgaatcctttgagcaaaggaaggtggaagacacagatgactgccagatggaatgtggccacgggaccagaagcctctgggaggtaggggaccaggcaagccaaggcccagggtctggctccttctcagttaacaaagagggtaagaaggtcattgtttttctttccctggggtcccactgattaacaggattagtctaggagaaacttgataagacttggagaatacttttccaaatctctgtacagcctgcggtgtacagcctgcggtgtacagcctgctgagagccacctactgagttcagcagggtaagttgaggactaggaggaagctctgcttttccaaagtatagctttctgtttgctgagtcagacagcccttcccatgggctggggtgttgggatagcttcactaagtcacttgggggcctaaccctttctagtgatctattgggttagaaagagatagttttatgctgcaggtatattgttaaaggggggaaatgacacttaagataagtgtcattgagttagcctcttggaagcttgcaagagctgagaatgggtctatctcttttctttagtgtggtcacttacctttgagaacattcatgttgcttggccctaatgcattccaagaactactgcacacaccaaaccttctgtgagtctctaagaagagctgcttttctagtttgctgccctagcctcttattgagattcccagtgtgcacttttcagtcgctgggatgaggcacaagtgccaagtgcaaagagaggtggggagcataatcagagagagtaccatctggcacccccttgttgctgaggcataagcttcaacgaggtgtccagcaggctggatattacattctgatcataaacaaacaagcagacattgtgaggtctagtcctctttgtttattctttctcgtaccctttcctccctgcatcctcacacctttactgaccgtcatgctgagggtcagctcttcccgttaacagtttaccctgtagactgcctatctagcaggacttaccttcatattcttcctctagctgtttcttccaatcctagtgggaaagaaatctgggaaggagggaggtttggaaccatggccagagtgaatgacagctgacagaccagcagcttgttggcctccctgctgggacaacttggctgccactaaaggactgaatagtgacaagtcacactgacccacagcatgcaggctgggctggggctctgggaagcagcaggggaggacaggacaggagggaagttagaagaggagaaagtggatgcgaaaggatcacccgcttctttacactgtctcaggtcaagctcccaccatcttcaaggttacaggggtgggactggactagcttggttgcctggcaacactccccccaaaggctgctctttggtaacttgagcccctttgagactgccctagaaactcttgtaactggcatggggcaggggaagagggcccactcagctctgaaccaggtctcttgtctatgaatctatggcagttgccataccaaggcatgaccttgcttctaaatagtcccactttcccctccccacatatggctttggatgtgacccattttgttgcatcctgtggcctttactctgtgatcttctcaaacttgttatggtcaaagccagtgggaaatagctccatgtctgctgccatgtgctgagtcaatccaagcaatcctattcctccctcagagatctatttaatgtttgtagatgcttacatgatgattacaaaagcaatcagggcatcagcctaggggtataatatctcctttaagatctaggtagtaaaacactatatagctctaggtatgtttagtttagtttattacattttatttattgtgagtgcacatatcacagagagagagagagagaaaaagaagaaggaggaggaggaggaggaggaggaggaggaggaggaggaggagaagaagaagaagaagaagaagaagagaagaagaagaagaagaagaagaagaagaagaagaagaagaagaagaagaagaagaagaagccgccacagtgcacatgtggaggtcattgacaacttgtggtatttggttctctcctcctaccacatgagacctggcaatggaactacagttatcaggttcagtggcaagtgcctttaccttcagaggcatctccatagcccctctagttatgtttcataatactggagagctattgtttctcactagcccatgtattttctttgagaaatatgctctattgaatttttgcaattattttggcttgactgcagtcagtgagatccacagcagaacccccctctttgttaaatacctctgcctctcaatattccaacattgtggcaaccctggctgcaaaccgtaaaggacagctggcttattttgcttgcaattatagtctggagcatgttataactctgcgtcgggtgaaaaaacaggaagattgcacctcttgactacacaagtttgctatgagatgagatgttacactgttcttgcttagaagactgggacatggtctctggagtcagatggagcttaggggatcttgggagacttgagacacacttttccaggactgattttgtctttgtcttgcttgtcatccacagaagttcttgggacagtgggttgacagaaggggttcgggggtgggaaacaaacctactttctttaatttttttcctccccttcccattttctctttaaataccatgaaaatcttggtctgcttcatggtattttcatttgttgaaaacatcttctctggaaatttgaacaccaaaatgtccactagaatttcctctcctttagaaacaagaaatgtaatcttctccattttagacacgcggacagctaaagtgacaggagcgtcaggatgtgaggccaggagaataccagaagacttgagctatggcttctgggctcacatttgactcagatgaaggtgatcaggtttcaggagaagagtggcgccttgctggcatctgtccctgtctgtacctctctgccttcggaagagtctgttcccactatatgaactaaaaactcagtcattaaactattgtgagcatcatagcgcttgacagctaagtttcactcaggaagagggaaaggacctgtccaaagtcacccagacaaatcaagcttcttagtagcatgggcctcagattagaccagtcattggttggcctcccccacaagttctgtgccaccattgccccagcacatcttgcaggcaggacagattgtagtttgaaggttgagtactaagaggattttagtgcctccacatatgtgaaaagggtagaaccttcaaataaagcattagtcttttgaaatgactcaatgatcaatgtttaaattaaaatagtttcttactagattaattttctccctctcctctctcttttgtattcctgttgtttgtgatctacaaatgtattcattctgccagtgtggcaatgtggcagtggtcaagtcacagaaaaagtcagtgacaaaagttcttgattcagaaggggcttctgacattctaaaccagtgttctgacctctgccatgacattgtgttccaagtcagttcattgagaagccctgctctggcattttctttagctggaatttgtccagggtaaggaatgattcccgatcccatttactccccgagggatgctttaaagaacagcccccaacccatggttgtagggcaagctggagctggagaggaaggatgcctaaccctgcatggcacagagagcaggtgggaggcaatgaacgcccctgttaaacctttccgtttggagtgaagtttgctctggagcaatgctcctcagatgggaaatggtagttagcctcggacacactggattctgaagctcacctttctaccagggcttttttgtttgttttgtcttgcttcctggtccttctgttgtctttattctggctaaccacctttggagattgcagttctgtcacgagtatgaggctacatcttggctattttctgttgctgcagtagagagtttagttggcacttcaaaaagcatgtttattaaaaactaaggggaaaaagaaagtcaaatgattgccagaaatgcatttagcatacgtgtttccagggatggattgcttatcctgctgtgtgtaagtagcttaacaggcttactgcctttgctcttctgtactctttcagaggccaaaattcactttttctttaaactttgcagctttgaagagtaggcagaagtttgttttggttcttactgttgtgctggattctagaaactgacaggcaagtagactgggtctctcccttcagagtgctcctagtctgcagggctgggggccatctctgttccacactgtgtcagcatggaaccgggagtggaagagagcaaaacaaaacaaaacaaaacacaaaacaaaacaaagccaaaaaacccaaaacaaaaaaccaaaccacccccccaaaaaaaaccctgataaaacaacccctccaaaaacaaaacaaaacataacaaaaccagtcttctgaaagctgaagaaagctaacaaacagaatcaagatcccacctcacaccccagcttcaactcagtctggtttggggctcaaaaatggagttagggcttccagagtcctccatggtaacaattaaaccctaacacaatagaatgctatcaacaattacattttatgttcaaacataagaatagttggctattcagcacataggcaatgcttagtgggtctggagtcatcacaaaccttctgtggtagcatagccttctagatatgttctgctccttctgctcctagttgggaatgacaaattttatgttcttggtttaaacaagaaataagctctttgcataagttcattaaggcaaatttattttatttttatttattttaatttttatttgtgtttctctctctctctctctctctctctctctctctctctctctctctctctctgtgtgtgtgtgtgtgtgtgtgtgtgtgtgattatgtgcaggtacacatgtacaaaggccagagatcagccttgagtgttgttctctttttatcctctcacttgtttttgtttgttttgttttaaaataatttagttttataattacataattttccccttccctttcctccttctaaaccctcccatttaacccctccttgctctttcaaatttaaggtctcttttttcattagttgttgttacatgcatacacacacacacacacacacacacacacacacacacacactcctaaatataacctgctcagtctatataatgttacttgtatatacgctttcagggctgaccacttagtattgcataaccagttggtgtgctcttccctgggaagactatttctcccactctcagcatcccttagtttcctatagttttgtttgttttgtctcgggttggggcctcctgagctttccccctttcatgttagcacgtttatcagtctcatccttgttcagcctcatgcttagacagtcattttggtgagactttaggatgttttgtttaggttttgagacagggtctctcattggcctggtattaccttctgaactatcatctccccagtttacttttaattaacccattaattaacttggtgaagttggggattgaacccgtggcttcatgagtgataggcaaatggtctatcactaagttatattcctggtccttaggttttattttctttattattgtgtttgtgtgtatgatgtttatgtggaggtcagaggacaccttttgggaggtagtattctctttccaccatgtaggttttggggtttaaactcaaattatcaggtttgtatggcaaatgcctttacccactgagacatcttgctggccttattatataaaaaatattagataagagtgtgataattcagttcatgtgtacaatatgtaatgataaaaattaaggtaggtaacatttccatctctttacccatttaaaatatttattagtacatagtaattgtacatatttatatacgatgatgtgatagtctaatacatatatttagcatgtactgatcaaatcaaggtttttgtttctgtctctttatccttagtctgtgtttggagacttcaagagcctctctcctggatattaaaaaaaaatacatataaagggttcttgtgaactgtagtgccccctctgtgctgaagaacattagaacttaatccttataattgcctgcattttggtgtatattgcccagtttccctgtaaaactcctcccccatcatttccaccccctggtaatcactgctttacatttagcactttaaaaaaaaaaaccttgtatgtatgagtgagagcacgcattgtctttctgtgcttggcttatttcactcaagataatgctctctgattccatgtttactgcaaatgacagtgcacggaggatggcagcatcctaatggacaaggctactttgataatgccacagttgggtgtgacaagtgtgtattggtataaatagcttacaggaaagcttgtgtgtgatgggtgttggggctgggcatgcaggagacaactggataccaagccctttaacatggaaagtttgtgcactcaaacagctctccatcctttcttcccacccttccgacagctcccttctctggaaattataagcgcctcaatatagtgtaagacctttgagggtacggatacttgtgcgttcactgctgtttctccagctcctaagtcaggatttggcacctagggtactgtagctgatgagatgaattccttccttcctcttttctagccttggcccatcctgtgatagtttctggtaggtggagatgaagtagaatgcaggtccccagcccattgggaggaatgattctactgctgtgtagatgaccgaaggatccagggaaggtgaaagagacacagcagactcagtgcagagatgtgtccaggaggatgtgatgtctatgtctgaaagacagtgtgcattattgtgacaggggaagaggacaatgtggacttctagttcaggaggttatctaagctagtatagggatgtaagagggagctgatgtggggagaggattagctggagagattcaggagagaacacaaggccccatcacagcagcagaggtggggtgagggaactccttacatcctgtttgttggtcagggagttagagagtgttaggacggtaaaacaaaaaggtatggttaaattgaagctgtacttttgaggcagatagggctgaggttacctggcagagccacagtatctccctccctatacccacccccagcccccaaagtctctagcaggagggaccttaagaaaaagaaagaaaaaaagtctacctgcttatgtgtctctggcccttgagaccgaaatctattattcatgccagttttgctgtgagttggggcgtttgactgcatcttgcgttacttttttttccctaaagaacacagattctttggcgtgatcagcatgttctctatgggaaaacaagaaaaatagttttcttccctttttattttgtggtgctgggaattgaacttatatagggcctacctcatgctagacaggcactccacactacatcctagtctaaacaaaagcatctctccctttggaaaacagattcaaaggaaggataggtttttaagatccattcctttttttttctcttcctttgagcagattcatttgctgccgagagccgtgtaattatcctcctgacaatttagtctggttcctcagtataagcaaagtaccaaacaaattattccccccaactgggaggctgtgaggtgactgaggcctcctaatgttactatactcagaggctcccttcccttgcaggaggtagcactgcagagctgctagccagatagctcttgttatttatgatgtgcctcattttgcccagcaattccatgtcaggatcttatgctaaagaaaaatcagatattgcaccaggagacttggaaggatcttagctatgtagtttgttgtttgtgttaacccaagaaatgaaacgttgactaacagtagagtgcttatgtaacttttgctaggtctatgagagaagtgataaaatagtatacagctatgaagaaccatgctgcgaactaatatgtcttagttgactgatgttctgagccacaggtctttatgtgtaaaatggggttaatactacctatttcagggggttatttccagggtctaataatgtgtataaagtgcttggtgcacagcccacaatcacacataccatcaccagatactacccagaaaggtacaatttttttgaagttgttatttatttatttggttttgatctaggatctcacaacgttgcttaggctggcatgaaactttctgtcctcgggcctctgccacatgagcgctggaattacacccatttgccaccatgtctggctgctttgaaggtttttgaaacccctagatggagatcctgtcaagtctgttataagaaaaacgtttcctagacagctccaaattacagccattcttctatagaacttgtggagaagtctcatgtatgcacagaggagcgcatctcacttctggggctgtcagctcatctctcccggccctgggattttgcttccctttcagtccttccttcattctcccccactgaatttgttcaacacctcactgccaatcaagggtagggggcatcctttgtaattgaagcaggctgtctattgagaatgctggcagccttgggatagtcattggtatagattgatgcctgctgacctcagacccagctggctaggaccctggaggggcattaacaaagcagcagagtgtagattctgatccaccagtctagtagctgcctttgcgagtgtcttgttagctctgttctagtctcctggtatggggaggggcatgtgtcctggttttgctcactagttttgcagaatcaacttggctaagggtgaagaagttttttcctcctaaaacatactgagcagtttgcctgaaggttcaacaggtctatctttcaccagtgcttatacggagtaactcccaatctcacagccaagcagccttgagttcacaggaactccttgaacatttgggcattgtctacaagatgcccaaaccactaggcaattctgtcatctccttggacgtgccccacttataaccagaagttctagggaacggtgttcaggaaccagtatgttttaaaagtttccaaatggttataccatacagctggggatgaagacttgcattatagatggctaagatagatgtcaccaggacagagtttgaccacacaatcttcctcgtctttctgctccttttccttctctttctttgctctgctaggggatattttgtgcatggttaatgctgccagtgagctacatccccagtgcttcactatagtgttttatatattatatttgtggatagataataagcatgaagtataatgtaaactgaggttaagacagggggcaaaatggtcacacgtatgaatcaatcacaaacagccatgcctccaaagttgagtaatatactttttaattttataagtgaaggaagataattagaaaaaattacttcatcagtaaaaagagtatatgctatagcaaaggaaaagagctttcatctcatgttgctttgctcatgttatcaaatccttgaacattttaaatgaagacaacgtttttctttatgttatagctacatagcatcacattttatgacactgggctgggtctctaccttcaatcaacttttcaacaaaatagaaaagatttttgtttgcatacttttttgggaatccaggcaaaaggaaagacattttcactttatagtttcatgcttcaaattaggccaggcctgaaagtacaaactgaagtgaaatggttgcttctgcatggaaacaggcagttgactccatgctctcctcatttggtagtccagaccatgcatataggttattgtatcatatggcataatagaacaactgaataaacatgttcagtattttcaaaccatatttacttgaacagtttcgatttatctttttcatgttttattttgtttggttgggggtgttgttgttgtttttgagacagggtctcctgtagcccaggcttaacttgaacttaatatatatatatatatatatatatatatatggatgaccttgaactcctgatcttcctaccttcacctgctgggattacagacatgcatcaccaagccctgctcaaaagatgcaatttagaagacagaatagctgtcctttcttcatgatacctacagaaatacttttagaatgtggatcctggccaacagccacccagagaaagaaggaagcctggtccaacagcatcttcgatgttagtggctgtatttgggcttcctatttggaacctcctctgtagctattttggggtcccaagacttatttgattctgtcaacagtcactgggaaaatactggcacagagggtataagggggagggggacactttgagcatgctcatctcagctgtgatcagagaagaggtgctataaagggaacccccacaatctctctctcaagcagccctgaaccctggggatgaagacaaggcagaaagaaggattccaaaagtattcaccaggaggaaatggtggctgtttagagagactgaggcccagactcacagataaaataagcgtcttgcgctgtacacacatcccaaagcacttcgtgatactctagttctatgtataatttctgtgctttcatcagttaagattttcaattttcaccagcaaaagcacacactttaagtttaaaaaagaggaaggaatctatttatgaaggttgagaagtaggttttaaggcactgttccgctcaaagtgcgacaggaaaggtcccttcctgtgatgtgggaacagtgcagctcagtgagcagaactgggaactaattttgtgaggatttgggggtagtgaaatctttccgtgttccagattctgggccagattacctctttgaataacaggttacataaatttactccccgttgtgaaaatgcccagtgaaatcttttccttataactccaagttaatgaaaacagtagaattagggaattagggaacgagtgtcaatcgtgtgcagagagcttttgtattttgtgcccagggcttcctcactacctgaggcatgtgaagagtgagggaggaggaaaggagtccaggtggtgaatctctttgtcgtagggaacatttatggaattccaggtgccaataggggctgctagcatatgtggcagataggtgtcccctgtgggtagaggggtggcaaaaacagtgcctcttctaggtgggcaagttagggagacattcctttagagataactattaaacgatggatcagcatcttggcggacccaagcttaaaagctgtcttctccattacaactaaagaaaagtacccttcttccatgggcagtcagacagacaggacaaccaacttcactgaactgtggccacaatttgaaactccttttcaggagccccctccctatagaacaacactgccaggttctctgaagcaccagggacagagattggtcagatagaccccgtttgaggaatttccaagcttgcccctccaactcctatcttattgaactagcctgatcttctgccagttctcctgctgcccatccttccaggcacagtcatttggtggtagtagactggctatccctcagatgcccaggtgccagctacagtttgagggaggcatcagccattcctctgtctgtggctctactctagaatgaacaaccagggctacttgttaactgtgactaaaacactgctttgagatcctggatgggaaaatgccactatcatttcttccttcacaatggtttaaaaacttgactgtgttctcttgaaatgagcttcaaagtgggagtttagagtctcgtgtggtggtgacttaccatgcaatcttagcacttgggaaggctgaagcaagaggatcaagagttccagaccaggcctggactctataacaagacactgtctttaaaatggctgagtttgggcatagctgagatattttcccttttcatgttcttgtcccttaataaaagaaagcagtttatctctaatctggtgatttagagttggctccaaaaactaattcctaccccgatcgtcacactaagcctgtgctggcctctgtgccagatattgctgatacgtaattcttaagagttgcctttaactctggagtcttaactctcagggagatagtgcagaaagcagtgttactgcagacacccaagtcctgcttggaaagcactgggcacaggggcagggaaagcttccatagctctttcctcttgttctccagaacatttattcatccttccagacccacactcagctcctgccagttctttccagccttctgactccctctgctgtgccccgactccagtttgcagccacacttcctccagtgggggatgctagtccatgcagaggctgccaatatgtactgacctttctcgaaccccacttttatttccttccctttactacctcttgaatgcaatgtaaccctcagtcataggaacttggaagaacactctggtaactcctttcttcagatgagccaggagctggaagttagagcagtctctccctggtggaggtaaatcttgtcttgatggtggtagggacttggacatagcatgcagctgctggagcccttcagatcctgagggcttgggacgaattccaagtgtctccctgagccagacttcagtcaagtggttgtgggtagtgagccacagaccttttggggaggaagaagccccgttgtgatggttgtgaagtcgcatgcctttgcttatttggcctctgataggagcagagtcctggtatcagctcacaggagtaacttttagttccgagcctctatttttcttgtcaggaagagcagaaatactcctctatggaaaaaaaaaaacctttggaaacaaaacctcatgcctacaatgttacatattatccttgaggaaaaggacagtggctgactcatccatctgtcttcaacatctagttggaaagtagggatgatgcaagtgtttgttgaatgactaatggctgcttaggagatgggtttttaatttttattttttatttattaactttggcttactacctaataaatcctctgtatcaatgaatactttctcttagacaaagtattagttactttttaattgctgtgataaaacaccatgaccaaggcaacttataaaggggagggtttatgtgggcttacagttctagaggtattggaatccattggcaccatagtggggaatatggcagcaggcaggcgtgacattagagccacagctcatgtcccgatcctcagacaggaagcatggaacacactaagagtgccacaagtctttccctttttccatttgttattagcttatttttcacacaatatattttgaccatgtttccccctcccccgactcctcccagctccccttacctacccaacttcatgttccttgtctctctcaaaaacaaacaaggaccatctcccttcctggctcaggattctatgcagagggaggaggtggaaagtctgtcagggtctgaggtggtggggtgactcctaaagagcagcagcagccagactcagaaggactggtgcatggatgaactcacagagacagcgacagcgacagcgacacagcagcaggcacaagacccgtacaggttcaaaccagacaaagttccagccttgagaagggaaagggacactaaatcccacccctcctgctgggagagggaaagtcagttttctccaggagctgggtgtgtcaacttcaccccagggcagaccccatggtgaggagtacttagttaacacaaaacaaactctgcactttggttttgggtgttgcctttttgttttgaagcttcaagcccacccccacctccttcaatacacctccaccaacaaggccacacctcctactcctgttgccctaactgggccccagtattcaaccatacgagcctctatggccattttcagtcagaccagggcagctcctttgtaacttctgcggttaccaatactgtgagtctcacaggactccaatactcaagaggacattgatgggctctttgctattttgcctacaataagacataccgctgccatgttaatggtggcttccaggctgtggccttatttcatttcatttcatttcatttcatttcatttcatttcatttcatttcatttctttctttttttttttttttactgtgtttgggtattttatccatgtgtatgtctgtgcactgtgtttgtgcctgattcctgcagagaccaaagtaggacattggttctccttagaactagcattacaggtggttgcagaccactgtgtggctgattgtaatccaacccagttcttctggaagatgctcttaactccagagcatcttcctagccccaactatgaccttttacaagctcaggtctcgaaccagtttcctccaggctgcgtgtcccttccatgcccatgcccccaacccaaccacagtgtgcagttttgctcaatacccactgttaccagagtgtggcagttaggctgcctccccgcagcccctgccgccgcctttcattgtgctggtggttgaacctagagcagaacacacggtaggcgaatcctctagttgtgagatacccccagccatttaaaatttcttttttaaaaactttgatacagagtctcacaaagttatttgagctactcttaaactcactgtgtaggccaagccatccttacatttatgattctcctgtctcagctgtgccagtgggccatgtaccccatcttatttttgtacaccttttctaaacatacatttatatctttttatttagcataaacacccccaatttttaaattggaaaaaagccctttgttaataaaagcatggctcatattctgatgtttaagagcaatatgtgccttgccaacccattttatcctcaagggtttcatgacagagtcagccattgtcatctccatcttgttggtgaggcaacagtctcaaaagagaggaagtaatttcctcaagggtcagaaggactgagagttgcagagactgtgggcaagtctatcagggtattgtcttaattagtgattgatattaggtgtggcacggggggcggggccactcgtgggcaggtggtcctggagtgtataagaagtcaaggtgagtgaagagtggggagcaagctaggaagcattgctcctccatggcccctgcaccatcagtccctgggccttgctgccttgacttcctcctctgataggaagcttgatttttctatgtaagagtagcacttttgcacattgttttcatttatgaagtgtctttacatatattttttcatatgggcctcctgtgagaaatggaaaaaatggattcagagagattgggactggcttgctcatggtggcaagggaaaggctgtgaggaccaagaaccatttgcaccgctttagatgccagagatacgagtatataagatgggcaaaaaaaatctttgacctaacagagtgtataaaatgaagtatgtgtttcttttcatttatcctgcctgtcaggcaagcgatatcgattttcgtttttgatcttggctgtgtgctttcgacccacctggcatgcttccataaaaacaatgatgtctgagggcaaactcatgtgtgcactcaaattttacagctgctcagcaaggagtgagtgtgcaactgagcttgagaaggcttggctttgagcagtgattcctgaaatcaccttgggagccaggcgtggtgatgtacacccagagtcccagctagttggcaggctgagacgagcaggaaggataatttcagcccagactgtgcaacacagcaagcacttgggaggcagaggcaggtggatttctgagttcgagaccagcctggtttacagagtgagttccagaacagccagggctacacagagaaaccctgtctcaaaaaacccaccaaaacaaaacaaaacaaaacaaaacaaaacaaaacaaaacaaaacacctcatctcaaagaaaagaaaagaaaattagagtcaagtaccgtcctcctaagactgcagaagcagcagggtgtccacatgcaaaagaaggcagttggctcctcatctcataccacactcaaaatttacctcaaaatgagcaaaggggttaagtgtaaagactgtaattataaaacatatttaaaaaaaaaacaacaacaggaagagttcgttggactgggcaaccaaagaaaaagagataaattggactgcactaaaattcaaaagagaagactccttttgcgaacttaaaaataaaacataaacaagaagcaggcagatctgtgagtttgaagccagcctgatctattgagcaagttccaggacatccagggctacacagagaaaccctctcttaaaaaacaaacaaaaaacaacacctcccaaaaaaaaccccaaaaaaccaaaacaaaacaaaaaaccctgaaaaataaataaacaaataaataaaacctcttacccctcaagcacacgggtcattcattcattcatttcattctcacaacaaatatttgagtacccattgtacccatgtaagttcctttcctttcttgggttcttgttctcctctctctataaactaagagaatggggcatctctaaggtctactgcaactcagtcttataattctgtcggggaccggcactggaagtgaacatagtacacaaggtccactcttcgaatcttggccttactaagcatgtccttgatactagcgtatattttgtttgagagacaggagggttttttgtttggttttttgtttgtttgtttgtgtttttgtttttgttttttaaatgtgtagacaagtttttcttgtcttgttttctattgctctagtaagcagacaacctgtaaggagcaggtatattttttccttctcactcaccagttttctgacaccaagttgaccacacagatggctgtccaagggcagcatcaggggggagagctcaactggatcagactatgaaagttaaacagaggaaagaaagcaaaactgtgtgcctgcagataaaagtgctcactgagtacacggaggaaaccctaacagaaagcctaccacagtctctcttctccagctttcttgttcttttgctcgtacatctgtgcatatgcaggccagaggctgaaagcagttgtcttcctcaatcacacccaccttagtttcaaaagctgttttaatgctatgtgtatctgtgagtgagtgtcacatctttgctgttacccttggaggccagaagaaggtgatggatagatacttggagctggatctacaggctgttggtggtgacctgcctgacatgattgctgggaaccaaagtcaggtcctctagaagagcagggagcatgctcaagcgctgaaccatctccctagcccttctaccttatcttctgagacaaggcctctctttctaacccttgagctcatatatttagctagattggctgtccaggaatctccagaggtctacctgtctccgagtccccagtgctgggatttcacacatatgcctcagcactcggctttttatatggggactggaaaactcgagcttgtatgacaagcacttcaactaagatatttctcagcccttgtaccttactttcctttgtacccataagaagagagatatggcatggttcaaatggtggttaagtgcttgggcttttgagtcaccctccctggggttgagcccttgttctttccttcactatgaccctggataagtagcctgacatcctgttgcattagtgtcactgtaagtaaagagttgtcataatgttatttccgagcccaaatatgaagattatatatgaagcttagccagcattatattttgtcatctaagtgtacatatatttaagttacttgcatttgctccttaatctttattttatgaaaactgagtattatttttttccagtttagtagataaataaaccaaggcacagagatattgtcactatgttagtactaactaggtcatttttgtaaccccaaaaagatagcctagtcagagtcaggacttgaccctttatgctcacttaaccacaggactgcacacaagccatggaattcatctcgatatttacagataagtaaccggagtcagctctagggatgctgagcagcgtgtgggctccacccgtggaaatctatactgtagataggggcagaagacatacgtgtaagaagggtgtgataacggacacatcctatcacaggagttcttactagctttgtttggctgtggcctaggtccttaacagatacagggaggggtttgcagccaagaaaagctgagtgagtgaggcggggatggaaggactctgggaagcatttgtgcattgggcaaaacaccttttaccatattgttggagcattcttgccaggccctggaaactcagtggtcaggtccgggaagtatctagtgctgtggacttcattttaggatcccatggaagtagctcatatagaagcacacagcgagactgtcttagatgcatagactttgagatttgagcccaaatttgtcatagcatacatgagaaaactgaggcagagagcaaaggatgatccctggctagcccacagcaactgtagtaggctttgccacgttaatatttccaacctgcatctgaaattctggaccattggctggagaaatccttcagtggcatcccgatctgttcccctactaacccagagatgttctttagaactctattgaaagttcctgcttcaggaccatgtggggtgtgacatgtatctcttaattgcagcccttgagaagcagaaacaggaagattatgaatttgaagacagcctgggctacacagcaaaaaccctgtcaaaaagcaatacaaacaaacaaacaaaaacaaagccattaagtctcctgcgacataaatggcctattctactacaaatgaagtcttgagcaaagagtttgatgggcttgccatggcatcacagactgagttgagagaaagacagaatagaggtcttaaaatgaggtgtcaacttcacccctaccatgaaactggcattttcaatctttcccagcattgtctcttagcctcagatggtggtaccaacctgtaatcccggcattcgggaagcagagacagatggatctctgaattcagggcaagtccggtctacatagcaaagttttaggccggccagggctacacagtgagaccctggctcaaatatatttctaaatgacatctattgagttgtaatatgagtatttctcagttctcccatttcaagtgtatgtacttaagtagcttaagatagtcatgaagttgtgcaaccatcaccagaatcagtttttaaaaagactaattattttattgtatgtgtgaatgcctacatgtatatatgtgcgctctctctctctctctctctctctctctctctctctctctctgtgtgtgtgtgtgtgtgtgtgtgcctgtgtgcccgtgtgcccgcacacccacacatgcgcaccaacacaggccagaagaggctgttggatccctgaagctggagttgcaagtagctgtgaagttgcaagtagctgtgagctgcctcatgtgggtgctatgaaccaaacctgggtcctctacaagagcagaaagtgctcttaaccactgagtcatctttccagtccctatcacaatcaattttataatactttcatttataaatttataacatttcattactcctaaaggtaagctctccttacccagccaagtcctcaggctaatctcccttttctcttctgtgtgtttgcctactctggaattttcccatttattattattgttgttattgttatgatgacaaggggcgcacatgccacagtgtatataccttttatgtatgtaactaagacaaagaactgctggctcgtatggcaactctatatttagacatctgaggaactcccacattgttcctcacagagctggcatcccttgatttttcctgccagcaatgtgtgcagcttcctgtttctctgcatccttgccaaatcaggtattatcaatatgtttggtcatagccatcttagtgggcatgaaatgatatgtcattgtggttttgacctggatttccctcatgactatgacgttgagcatcttttcatgcacatagcgaccatttcaattactgtttaaaaaagtctaattatatcttttgagctgggttgtgtgtttttgttttgtttttagtgaaatcgtaaaagttcatttgttttttgtttccttgcttttgtttttgcatctgagacagaatttgagtttgtaacccaggctggccttaaatttgcaatccttctaccccagcttctcaagggctagagcataccatccctagcttataggagttctttgtgcattctgtatattgatacctactcatatatgtgatctgttcatattttctcaattaagaagttgtcttttcagtttcttgatatactttaatacacaaagggtttaattttttataacaacttctattctcccctggctgttcattcttttggcagcatatataagaaagggttagctggagatgtagctcagtggtagaacattttcatagtatgcatgaagacctggttttgatcctcaactctacaaagagtgtgaaatttctgtttcagctcaggccatatagatttaatttgtttcttttcacagttttgtagttttaaacgcttatattttcatcttctagcccatgttgagttaacttttgtatatgttgtgaagtaatagtccatgttgtaggataaaacatcatctggacaccttttataataataataattataatgcctataataatattattataatattttgctgatattaatattattatgtgttaaatatgccatgtatatatatgacagtcagaagacaactttatgggcttgattctctccttcatcctatatgagcaccccagggatcaaccctgggttgccaagcttgtacaacaagcaactttaccccccaagacatctctctaaccatctccactcttcttacctttgctgaattatgttgagaccctcaccaacatcagttcattagagctggactcaattttgtctcattgctccatgtgtgggtcattatgcaaatgccacaatattgtgattattttggttagtcttgattgctgtgcagcagcttctgagattgggaagtattgatcctctgatcttggttttcactgctaagattattttgtctgtgcggggtcccatgaatttctacatgaatcttggagtcatttctcagtttcagcattaccttattttttgcacagttcttagctgtttgccaaggataacaacaagcatttattaaataatggctgaacacctaccacctgtgttaaattttggagttatcatggtgggggaaaataactgttaattctgccttcaggggactaagaatggagtgggagaggcaaacattaatcaaataatcaccaaaatagaggtgacatgaataataaattggctaaatcagaatggggttggggaaagcagtggggcaaggaaaactttcttcaggagatcagtaaccagaaaagtgcctgcagctagaaagccttcgggagcaagcactaagtagcagagaatgaacagcactaggtaagggtcacctctgatcctgcaggcctgggggagtacccagggggtttgtcctgaaagcaacaggaagtcgccaacacagagaagtgacatgatctaattttgctttcaaaatactagctctggatgctctaaggagaataaactggagatacaggccatggccataaagagaccgtggaagtttgggtcagggtggtggctctcgagacaaagtagaaagactaacagttacagatgcaagagaaaacaagacggtagaaagagtctttggttagagagtgggataggacggtgttgggcgggttggttctttttttttttaaccaagattaaaatacaacaacaacaacaacaacaaacaaaacaacaaacaaacaaaaacactaggtagctttgaggggatcaatgctttcaattttaaggtatcttctagacattttttaaaggctatgtgaccattattctgaatcatccctgcaaagaagccataaaacatttttctcattttgcagatgaggaaactgagtaccatagggttaagtggcaaagctagccaggatcctattagtctaaaaacatccacagtgctccttctgttccagggcactggggctgacttttctagaagagtctatttcaaatagtttcaggtaacaagagaaaaatcattcaaagcatgtctccccctgtaccaactcctctcagaccccagagctcatgttcctagggcagcctttactcctctttataaatctccacagtgtaacagccagccttcccttcaggatggacctgagcccccacacctttcattcctggacccagactgctgaccacgagcagaaaactacccgtttccttttcctatagtgatcacgctatctgaaagacgtcattcctcttagagaccattgtcaccagtctgtgggcaatgtgtggaaagctgagatgctaagacatggagccagaagttgggtggttaaaaaagaaaaaacaaaacaaccagtcaaggtgagctcagggtttttggtttttttttttttttttaatgtctaatggggtgtgtgagggcaagaaaatgaatggatggtgggaaatgaggtggaatgaaaagctaggagaaagaaagacaaatctaaaccttcatggaggaagaggaagagaaaataaagtgttcgaaggaagaaagttgaggaggaaacatcctgcttccaaatcaggaatctgacatttactagctggatgatgttatgcaagttactcagtgtctctaagtggagataaaattgcacgaactttatggggtttgtgtaaggattatagggaaggcatgtattgatgtcctggacacaatgtgtgctgcatgataagcacccgataactctcagctgttactctgcctgggcctgccctcctcattctcttgcctctgcccccagttgcaaggccagtttatctcactaggtctggatcaggcaggaaatagtctgtttcagcacacctagaagatacaggacctgtgacaacaattagtgtcacttccaaaggtgctccttggactctctgctgcctcggcttgtttcctcttcctttccttgtctcctccctaccaccccaccgttagctctaatctctacccagtcaccgtgctgcagtatccctctaggaaaaaagtcctgtcctttttcctgctttagacagtaattgcccagttgctgaacaatctcctcgctgtacttaccccatcatgacaccactgtgtgaaacctgctagcttggcttgtggattgcacccactgaatactgtgcttcggcccttgtctgtttaggatggtggctaagataactctttaaagtcccagacttccttaggaatcagccaacgctctaaagcctgctccggaaacgtctgtgaactcattgtcagccaggaaagagtaagttatgctaccaacaacaaataaccagggcttgctcatgggatccacacagagagctttgccttgcagttagtcactcagggatccagactagtggagaattttggacatgtgtttctatcattgttaaaacaggaagacgggctatatgctctgaattctatatttaaaagatcctcaactgctatgtgggagtgagctcggttgcagcaagggtgggaacagggaggccattgaggaaacttgatccagggtgagttgttggtaatatgagctgtactggtgtgtgtgtgtctgtgtgtctgtgtgtgtgtctgtgtgtaggaggtgatggatttggaatacagtctagaaaaagacaggcaagattttcctttagattggatatgaggagtaaggagaataatggagtcaaggctggtttttggccaaggttttggcatgaatatgtggatggagaacatccatccttaactggcatggaagtggcagaatctgagggtttttaagataaagcccagtaacacctgaagggaaccccagcttggagttctttttatggggagccctgccagctgttgcacaatgacttaaaaggaggaagatttttaaagagaactctttgataaaggacacacacagtcacagccacaggaacacaaacatgtccacacatatcatatgccacccacactgctggccagtcccttctggacctcacacagtactattccccaggaagttcttcaaggtctccaacgtgtcccatccatgtttttgtttctggtgggaatgaacattgtgctgatggtttctggttaaagaaacaacatccatggctacccccacaccagtgcttcctcttaggtcaaggccctccttggaggactcctgggagtagggttagcggtgatgcatgacctaggtggtctgaagaatcttttatcctttcaaagtgctttccaacctagggaaatgtggaaaacatactgatagcacatttattaaaccaatgtacatagtccaaggcagtaatctgtcactcttaggcaccgtttctaacaaaacatgtagtaccgttgcctggatagctcattagaggggatcggggttgtggaaaactggaaacaaagtgaagacgccttggccatggaccggttagatcctggcaattggttctgactgaagctcactttatagccttgctatttccagggtccccaggctggactttgcaaagggttgtaaagggctgcagtttaagttgccagacttctccacaaatggccagttggatagacagcatccatcaggctgtgtgcttgtcaggcagagtagaagaaaacagagctcctgagctgggagagatgagccttatttcagcccgggctgggaagcagcctgattgtgcaggaaaagcccgtgggatttgtaagaggccagaggcttcccttggctaggagtcaggattgtggggaaaggaatgactttccctcctgcccaagtaaaggagaagcttgtgagctgcctgtcttccaacctgtattgactgtgtcctctagaaatgtagaaagcctatataacttatagtagccacatacagctcttgtgagatagtattgcccacttattagagtagtaatggagccaagccacacaactaccaagtggctgtgctagcttttggatctagttggtaagctctggatagttacaagtgaagctgttccctaggtatacggacagactggctctactctgcatgcatagaggtggatcagagggccaccatctgtcagccagccttactgcttcctgtcattttcaggattgtttctagcccctcgaaccatcatctcctcaagtctctaggcctgttttcccatccagtaacttgggcagtgggtcagtggagagagcaaaagcctactggctttttgtatattgtgtttgtttttaatttgtgtttgtttggaggtggaatttttaaaaaaaaaaagttttccgagataaaatttagctatatagcccagattgatttcagactttctgctttagccttgactgtcaggaatacaggtgtaagctaccacccttcccagtacaagggatttttgttgctgtttgcaatactgtggactgaacccagtgcctcatgagtgccaggcagtaactcgaccaattaagctataccccaagttgtcccctgctccttgtgcagtgctgaagagcctttttgctcagatgtaactctgagcatctgcccagcctgagcccagcactttgccacgtgtgatccactgagccctaaggaatctcacagtggtgtttcgagggctgctgggagcagctctgctttcatatcatatgttggaggtgtataggtaatttcttttcaaagatgacacttgttgctgtgctgggaatcaaatccaggggcctcggtgtgctcagtaagggctctgctgctgatccacctccatgaccaaaggtgccacttgtgatcacaaaacaaaccaaccaaaaaccaagtgaaacaacgtttaacgccctgaagaagacaggaatgggaatgaatggtctgctctgctgagagtgccacaccggaggggtgtgtgtgtgtgtgtgtgtgtgtgtgtgtgtgtgtgtgtctgtgctcgcgcctgcgcatatggttgttttctgagaggagtttatgctagaacaaaaagaggaaaaccaaaacaaaagaatggggaaaaagtttgagtcagtgggatggctagttgccattttgaagaagaaacagtagaaaagagaagagaccagggtggggggggcactaccctcctggtacctgcccatgatccagtgtttctgcgtaaagtctcacttagaactcggcactcacttcccaccttgagcttcaagggcagatgccccttggctcaccgtggggttatgttcctaacaacccattgtaagctaaaaatactgcaagtggaaaatgcattaattcacctgatctttagccgagccgactttaaaggcactgagacacattaccttatggttgggcaagtcatctactgcagaagctattttatattaaagtatcaaatagatcatgtaatttattgaacacctgtatcaaaaaatgctgacaatgcagaacaccagagagaggccgttgtttgctcttgtgaccgtgcagctgcctgggcttgggctgactgatgcttcccagcatcagggaagaggaaagattaaaattccaagttcctcttgcattaaatgtttatgtccttttgattcactgtaaagtaaaatcaatcaatcagtcattagtcaaaccactacatgtgaaggaccatctgtattattgcccctattttaaagaagacattgaggcttcatgaggaaaaaaggacttaattacgatcgtatagaaagtaaaccagcttgccgcaactcaagctgtgcctctctggtccctaaaagggacttgagatcagggttgaggaagccatgtgagctttgctgttcttcaaaacttttagatgctactgataagacactgttctaatctcagcccacttccaagccagagccctttctcctaagaacttcaccactttctgcctttatctgcctgtttcctggacccaaagcagaacagggattctaagagtagagttgtctttagaactcgcttgagctctcctcttgggtactgcttctcccatgtacgaacactgtctcagataaccagggagctgcctctactgtgtctggaacgggacatcacttgacagtggtgggattacatcctgtgtgggtggtgagggggaggagtcagactgagtcatcattgttatttccattgcactctcatcaatctctcaaggctattgaaagagttagtaactaaaccatagtgtgactcctgttctgaaagtcaagagacagttgaaagcacaatgcaaagctagtgcaggaaacagagtaacaggagggtactgtctcttgactctcggattaggaaggaaggtctgggctgataggctcaggaaacacaggacctgtatttggagaaaggaggatagagtatgtacacgtggctggcactcactaaactaaatgggtgactcagatttttttgctgtgacaaaatacctgacataaagcattttaaaatagggaaggtttattgtgcttttagaagtttcagaccattgccaatggccccattgattctgggacctcggtgaggcagaatattatggtggtaaaggatattcacctcaggacaaacaagaaagggaccagggcaagacatagcccacaaaagacctgtttccagtgcactactttgtcctgttaagccctgtacctcaagttacttactgagccagctctcaagcctcctgcttggatttctaagtctagatttgccactagctgtttgacctttggacaggttccttaacccttttgttctccactttcctaacttatggtcttttaatgagtaagtgaaataatatatacagaatgctttcaagtgtttctggagtattcaaaggattcgatcaatgttagttattatgggcaacaaaaaagaatagcttccacagaaacgatggtgaggtcagatctggggaatgccaacttcagggcttttgtttgttttgttttgtttttgtggagcatgcaagtgaaaactgactgcatgggtttgagcttggaattcatttaggccagaaataggaactcgagagtgatcactttctttttaaagaattattttatttttacgtatatgagtacagtgtagctgccttcagacacaccagaagagggcatcagatcccattacagatggttgtgagccaccatgtggttgctgggatttgaactcaggacatccagaagagcagtcagtgctcttaaccactgagccatctcttcagccaagtgattactttctaaatggtcattgaaaccttggaagacgtttacaggaagaatctgttgggaaatagaagatggcttaggaacaatccctaagagccatcaacattttagggagggacagagacaaaggagcccactgaggtggctgggcagtatctagagatgggaaatattttggggagaagcaaaataactgcttagcaggcatgaggccctggcttgcatctctaacagtgggggaaaaaaatcagaaagcagcctcacagaagccaagacaagagaatgcatcggctgtgactgagtgtggtggggcttaggagaggccagtgtaagggaagagtagagaaacgacaatgagacttggacctttggtccagtggtttccatgaaggagtaaaaatggccaccaagaatgagagtgaaggaatggagagaactcatgtaaatggtccttcactgaagtttgtgaaagggaaatgagagaagataaataagagctgggctgggagaagaaggcaggctttattgtccacaaggaagaggcagagtagagggaaaggtgtgagatgccggagagacagcgggcagctgagacttgagattcctggagtggtaggaaatgagcacagatgtcaaggacagaccatgtgaagggctacgggaggacatcaagccaatgcagaggtaaattgctgtgtgaatgcgtccctttctttgtggaatttagagatggtgtgtgacaatgctataagcctgtgggtgtattgtagaaaaggacatagtggtcacagagtccccacagaaatggaagagagggcccaacggggcataacctagctgtctagccatatggaaaccctagtgcttttatgatggttctacccatgtggtcctgaatcagtagcagaacgtgtggactttttttttttttttggatttttttggaagtttgggtaatttgcaaaatggatgaaggatggtcagtgagaaggattttaacaacaaaatccaaaatgtccactctttctgctactaataatttctctctttcccactctattacgtcttagcttctatttgctaaaatcctttgtattccttcttttggactacacaggagaactgagatgggtatagcactggtcattattatggtgtttgacagctcaagacaccttgctgcctgctggacaaactatagggtctttttctgtcctgagtcagaggattatgtctggtccaaccagctgtacttggcatgagcattctttagaacgtgttctgggggagcagaatacttataatttgaatcctggatcagcaagatggctccaaggatatagaggtgtctgttgccaagcctgatgactgaagccaatggattgaccccatggtgggatccacgtggtggaaggacaaaactgacttctggaagttgtcctttgaccttcatttgtacactgcagtgttggcataaaggtgagtgtgtgcatgcacacacacactgaaatacatgcatgcatgcatacatacatacatacatgtaatgaaagataaattttgaaagaattttgtttttgagccagggctggcagtgcagacttataatcccagctcttagggaggctgacataggaataaaagttcaaaccatgcctgagttagagtgagttcaaggccattctaggcaatttagtgctattctgccaccaatgtattatttaagtaaaaggaggagctaggtgtggtcgtgcgcacctttaattctagcactcaggctatgagtccaagatgagcctgatctacatagtgagttccaagaaagcgagaactacacagtgaagccctgtctcaacaaaacaaaaccaaacaaaaagagaatgtggcctttcactcagtggtagagtgctagcttggcaggggcacgatccaacaccccctgtcccacacaccacacataagcacacacacagtgttctgcaatgagactacttgagtctgaatccaggttggctcctttagtgtatagctttgggaaatttactttccctcccccccgcccccccaagtttccttctttctaaaatggttcaataagagtacctgctttatcagctctttgtaagggtaaaataatacatgactgtgtccctgacacacaattctttctactgtaaacgttgctatttactgtcattgctagtgtgacactttccctaagaaggaagtataaaaggtctagccgactttcagacaaagtgtggaggtgggattcagactccatcacactgaaagaacagccttctctcatttttgtatgtcctctgccactttctggtctgctggtctttccccagggaatgctacccccaggctctaaaagcctgaagtctgccatggtcttgggccccagctgctgtgtctgcttgttgtcaactgggaagcaatcttggctgtctgacccttccagcccagtccttggtttctatgagtcacaggcctctatgcctagcaactccttttagaagaggagtcggatgggggtgggggaagaaaggaagaatgcagctgcagccttgcctctttctgagaatctcagcccaagttgtaggaatatttcctttgcacccatcatgagaggctttggggcctcactgagtgcagactgccgtgggaggagacatttcaactagtccacacagccccagatagctgatgtgggagcaatactttctcaggcaccctgacatccaggacatccatctcctatgtagctccagaaaaaaaatgtaaattgctgacacaggaaaatggtacatgggctggagactgcgtctctcaaagcatctccctctcccatgctcacagatcaggtcccagcttacttggcctgagttggtattttcccaagatgtatattttcaggattctttggttaagattgtggttggtgatacatgaagtgattttaggtggtatgtggctgaagatacacattttaaaattttaatatccatgagttgatattttttattttaagttcattagtgcttttcctgcatatatgtctgtgtgaaggtgtcagatcccccggaacaggacttacaggcagttatgagctgccatgtggttgctgggaactgaacccggatcctctggaacatcagccagtgcttttaaccgctgagccatcccttcaacatattttaatatgttgtagagtaaaactagctagcacattgaatctgccacctttaaggatgttatttgctcagaaatatatgggagtgttttttaaagcaattttaaaaaatattaaaaagcttattgagacaattgttaagcatgtgacaaaagtcatgatggtgactggaattttaaactcactagtcctaggtaagtggcatcttttcttgtgcttcttttgaccttaccccaaaacttagtctgtctccctctccctccctcttcttccttccctctccctccctctctgtccctttgcctctccccctccttttgcctctccctcctccctgcctccttcccttcccttcctttccaagctccacagttgcactggccaatcccccagtttctcttcttcccccactcctttagaatgtctcctgcaccatgtgtgaccgtctagctgtcatcgctcatctgagtcccatgacctcggtctgccattgcacctcgctacccaattaatcttcctccagtcaactttcagcactgttcctttctgaattggtgctccagtcagtagcactcaggggccagttcttagcaagttgtagccttaggatagacctccagcctatactatctgcccgtatcttccattttctgtctcagacccatcttagtcttgctgctcctcagacagacattctgtgcagacttccaggttctgctctccctatacaccttaagattctttcctcggcccttaacatgtgtttattatttttcatacattgctatttatgtcgattttgttgttgtcattctgagacagagtcttgtgtattagctcaggctggcctgggattctctacactgcattgactggccttgaacttatggcactcttactgcctcagcctctccaaaactggggttacaggtataagcctctatgtctggctagttgcttctttttgttatttttaaagggaaaccttttaagaaactgtctctcatatttatttcattaaccataactgtcatgtgctcagttttagatcaggtttagatcaatctgggtcttccctgtctgatatgaaggtatctttaggagccacctgaacaagctacatgtctgctatcaagcaagatggtgcagaaagtagctgttaggtaggtagctccagtatctaccctcgacccagcaaagactgcttcagataaccgtcagaccattctgatctagagtcaggttctgaaatttgccacagttaagaccaagaggtttccagaaaagaagttatctttttgtgccccacccatctgcacccaaatgtccctgactccatgttggaaggccaaggtgagttctcagttctgcctctccctctcctggttgagaagaagagcttgggcagatttgaatactgtcctgctagatgactgccaggtaagtgggcagcttcttcatgtggcccgacagcaggagggagcttctttgtgggagaaatcacccccatctttggctcttaggtttccatatatttctaaagtacttttgaaacagaatttgcccaaagcccattatatagtgttatttattatgacaacagatagtatcagaagagccaatagcagtgatctgactaagaagactctgtgttagtatgttcatttgtataatatagtcatcaaatgtgacaactatgcaaactactgatacgtgaaaatacatgcacagaagaatattgagtagaaaggtagatcaggagggtgggaacatactatgcaaaaggcacatagatgctttgacaaataccaagggacaatggccaagtttgagatcaacgccattatcaggctgagggtatggctctcgtttagctcagtggaagactgttttcagggcatccacaagggcctgggtcccaacctattactgcatggggaacgaaggcataggcgactgagtccggtggctgagattgaacagtaattccaaagcagctggaagtcactgatggggtgctcagttcacctgaagttagagagataggtctctagcgctgtcccatttcgtgacaaagacagagatgctcagctagagtgagttcttgtacttgggctcactttccagaagactgttctgaatgtggggagagatctaacctcaacgggcaccctcgccaagcctgccaactggtaagatccccctttcctcgctcacagatgatgaagcattttgatggcagtgtctactgtcactccagaagagtgcacattactgtgtggagacccagggtgagttccttcttgaggtttcttggtatgagctatgctccccccattccagatgtcatccaaggtttagactgtgaatttctggacaggacatgaagaaaagccagacctccgactctggctgcttgactggaagctttgccaagggtgtggtttgatacagaagatatctctttcctaagaggttactgaagaggattgtggttttgctggctcaggtcttccagctttattcgagagtctgaagacaggggggaaagcaggatgggtgtgtgtgaggagtggagtcttgttttgtacccagcaaggtctgttatttattgagtgaccatgtgttacccccacaagctccgacacaacttactcggggctgctgttcctcagggaacaaggaaggctgatgcactcaatgcagtttcttgagtcacttactctgtacagcctttttgatgggttctgggtatgccattgtggacaagaccaggctgctcccctcagcaatctgcagccctgggtggcattatagacaagcaagcaggcaataacagataggatgctgccttcccagaagaggaagaaagtgaggctgtgggagggagggaggaggggtgcccatcacataaagaacaggaagtggggtatcagcaagagatgtggtatctgggattggatctggaggaggaagaggggatgagtgaagggatgtagagataagagagccaggcagagagtagaccacttaccaagagccagcatgtaaagagaccacagaagtgggccatgctgacacgcatacctgtgatcccagctcttgggaggctaaggcaggagaatcagaaatttgaggctattttgacatacggagttcaaggccagccttgtgaggctgtgtgagggatagaaaggtgggaggaaggaggctgtgccttggaaaaccgcacagagccaagccattcagtaggtatggctatgctgtgaggcaagactgagaagtggacaagggctcctgggaagtgcctgtctgagtttaatttccagcgtgctgaagagccaggaagcagctctaagcaagagagtgataagacgtgctgggcagtctttttggcttagcctggcaatggcaaggagaccagtttgtaagggacccgcacaagtggccatcctggtcatgccagggatatcatagtggcttagttcagggtggtagaaccaaggaagtggcttatgttttgggagaagctaaagcacttcctgatggaattcaggtggggaaagaatggagggaggagctaaatcatgtccactggacctcagcttgctgttgaggacccaggggtttcagatctgagatctggggaagggatgtgcatgtactttgtcatgcacccagcaccactgaagtgctttgtgggtatgtcacactcattataactgcttctgttaatgcagtctttctgatgggaaaaaggaggcacaggaagattaaataactaccgggaccctggctttgtgctgtattccttcttaagctctgtcattgacagtcataacaaactttatgaggttgtgatgccattcacacaatgcctctttcctgtgagctctgtgagaatacgggacacagtctttgactttgcgtcgcagaaagcctggggtctgtgcttaagtgagtattttgatttttgttgttgttgttgttgttgttgttgtgctagggtttgaacccagggcttatgagtgctaagtaaggatgctaccaagagctacacttcctccagggccttgtgtgtggtactttaggatgctgtcactgagctacactccccctaacaccagtgcagtaaagactttttgcagtgacttgattgataaccctattgtttcaaggcaacatggcccagggcaaaactccaggacttggggcttttcactaccttcttggcttggacagcttcattttactgagactattttcctcaactataaaatgataataaaaagtcttttttttttcctagagggtgtgagcatgcaaaggaggcttaatgacctccaaagtggtttctaaattgttatgtgggatgtcacacttagcatactataaatccttttaaaagatttatttatttattgaatgtgtgtatgtttattagtgtgtctgcccttcagaggtcagaagtgggaaggaatggttccttagagttacacgtgcttgtgagttatgtgacatgagtgttgggaaccgaactcaactcctggtagagcagtaaagactcctaaccactgagctgtagggttggtggggtcccgcatctgtttgtcacagggctgggaccgtctgggtctcaggctctcggacacccaggcaccgctggaagctgcagaagagctgaggatggagtgggggctcacaggctagatctagcccggggccggggggtgtgacggggaaaagaggggagctccggatcgtccgttggggagagtccttggcttgatggctgcaggcttggcttgagcttgacttggtggtggctgtggctgggagcatagagaggccttctacgaaagattagacagtggctcttgaagcgaagaccttctccatgtctccccacagtgaatcctagtgaaaagagacaatccatggttttaaggcattattgtcatggcggaaagtggatgagtaaaactgaaccctatttctcagggcggtcctagggttaaatacctttacagggaggagtgtctgggaaggaaagcttattggctaagcctccaggcctttaggtacctcattaaaatggagatctgtcttgagcctacctgtggaggagcttgggacgttgaccttactgaaggactgaaggccacaaatctatagggagctgcggctagtgacaggggtctggtgcacctaccgtcgcttaagttcccagggtttctagccttagctcaaccaggaaccaggctgcctttcacggtcccacaccaagccacctctacaacccctaaggttttagtcatctggaactgtacttcctgaatgctaactgatgcccttcctttataaaccaaaaggagaaaaataatgatgtagtttttcataaagccaaatttctcctcctcttcctcctcctccttttttttccttctcctcttctacctcctcctcttcctcctcttttccccttctcttctttttccatctcctcttcttcctcttccccttcccttttttttttttgcaattctcacaatgtcattccaacttagaggtgctaaaacttttttttaattgatgacatcttggttttagtagatgatagttgcttgaaaataccactacttaatgctggcaccactatgccagagcccccaagtgacaaaactagtactagctgcccaggaaaaaaaaccctgaaatggatggcagagatgagggctttggagtgggctttctgaaggaccctgagaagagtccataaggttgagaagagacacagggtgagaaagacacaggctgagccaggctgggtctcggtgcccagatgctgtgggtgccacgcagcaagatggcacctctagactgccctcgccaaaggttgtagtactatggagtgttcaggtggaaaaaaagttgctgtaatccaaatacacagttaaagatgggaacctctagaccactgcatcagacagcaactgagcatctccactgacgcacagacatgacggctcctgcagtccaccctggtggctgtagccacactgcttctccagtccttctttttaaaataagatttattttattcattgattatgtgttgtgtgtgtgttctcatttgcatgtgtgccccagggggtcagaggtgtcacctctggaattcagaccactagaagagcattaagcactcttgaccactgaacaatctctcttagctatcctactgacctttgatttctagtctcatctcctttgctcaggtcagcttcagcaatgtaggaatcactcagttctatgagaatggcaggagctcacagctggaacacaagggctcaatcacgagctccacacaccctttcactcacctttcacaccccaaaaaaaaaaaaaaaaaaaaaaaaaaaaaaccagggagaagggggttggggcaaggctggcttctcgccctggaatgccacatggcttgcctggggattcgggtggggaggtgaagtacatacacaactccctgcctgctgtgtgacctctggcctacaggcaaccacaggaggccctgggcttctgcaagtgccaggactttccacaaggactcccagtgtcactacctgagcatgtgccttcacattccaagagcacgtctggattatccatttcttagatttctccagacctctgttctagccattagaatttttttctctacctggaatcctttggccagtggatgcagccacaagttagtccgctaaggacataggccaggtgtctgctggctgtgcatttggcccaggcaaaaggcaacgggtaacttctaggagaaagcccatggagctggagtggaagggaaggccaaggagccgtagtagctgtgtccatgcccagacccatgacccaagcctgaccaacaatacttggcaggcttcctggctccctgtttagggcaggtcgccatggtgctttgcctgctggcacatagaggctggaaacagagcagaggcatgagcccaggagtgggtgggggtgtggttactacaggggagagcaggacttcttgccctagttctaactggcttttgagtcctctgcagggctgtgtggctgctataaggagaagcccctatgatcttatggccccagggattcctgacactgcgagtgcatatgcctacaatcttcccacccaaggacttgttatctgtgccatggttctgcttcttccactgactggcagatctttcttatgcctactaagctcttcctgtatctgtggctgagcttggacagctgtttatcattcccaccctgaatcaaccagacagttctatgggtagatgttctctataccctctcaatatctgtcctggcttgatgtttagaagcagcctatagaggactggggagaggacttaatggtccttttgagggaagcattagagctaagtgtaaactcctggacttggcgttcaaagatactcactccaacaactaatctttataatactcagcgtttcagtgccacatagttcaagcatcaaggcacacacacacacacacacacacacacacacacacacactcattacttgcacatctggctgtgtgtaaaaatagggaaaatgtggatagaatgtttgaagttttcattttgtatttgatgtctcataaatgcaggtataaaattttacttgcaagttgacaatttccaactctgtgtctacatatgtttcagtagtcagtatttaatctagtggtcagtagaaaatggtatgttcatgtttgccttttactggtaggctgagaaaaccagtgtctgcggggccatgggtgttggggaaagagggaagagaacccgcgtcccaccagagttccggtgctatgggcaggccgacgcgggaggactgcgcactcttttcacatggcatcgggtgggtgtctggctgtgtgaagccactgacctcacttggcaggtggtggacaagggttagtccaggttcccagcctctggcatcccatacactgatggacaccccagaaaagctgagaacagaataggggccccggggcggcacttggccccggggatgaagggaggagtgggcagggggagagggggtgctagatggttcccacaccggcgagagtccttattcaggtccgtggctggagcacagggtggccttctggtgggaggttagccgtggcttgttagcgtggcttgttaggagaaaacccatcctatcgttcaagcacagcaggccttgatgagcagagatggtctatggttttagagctttactgtagaaaggcagggagaaaggagaggggaggggaggggcagggaggggaggggagaggggggagaggaggggagaggaggggagaggaggggagaggagagaggccatggccacgtggagagagatgggggaagggagagagagaaggaggactagagagtaagaaaggtgagagtttaagagagtgaggaggggccaagcggctcctcttatagtgggctgggctatcaggctgttgccaggtaactgtggggaggagcatacctggctatagtcaggtaactgtgggggtggagtctagccaggatgccagaagcttgggaaattgtctgtgactgatagtcacagaattatggacaggcacctgattctgggaacatggctcgcccttctgtcctttgtagatttctctattgggtcaccggagtgagccccattcaatcaaaataggctgcctatcacagtcccacactgaattcatatacaaagttaaaataaaggactcctcccacaggaatggtgactcatgttagtaatcccagccctcaagattctgagacaggaggactgccatgatgagttctaggccagtctaggcaaagagtgaggccccttcccagaaaatatgaaaacaacaacaaaaaacaaaaacaaacacacaagcaaacaaacaaaaaacaaaccacagactccaataccatccatccatctttcaatgcctaacacaaagaccatctcctcctggagatttccctgcctcttccggctgggcaccctttcccctcctagctgtaccatcagcttccttggctttcctccaatgtctccagcacattcgctctgaggttgtagttagcagtgcatttgtctctctcccctatggcctatgctcccagaaagtccgtatctgttctggttcctcctagacaccgtcagcttttgcaaccgagtctgcacttgcaaattcctgaagatgagtggcttgtctctatgttggagtttgcctgcactgagagaagctgatgaaatcttgcgtttctctttgaagagaactattagttccgtctcagtctagggcattgagtagaggtgcctctcgctttccctgttgcttctcatctcctttcccactagtaccagtgtgacatgttcctcctcacaactagtccttggggtcatcaacagggtgagagccttaggagacaggtcacacagcctttttctccatttgcctttaatgaggggcaggagaaagagggaggaggaagaaatcgagggagggaagggaatagagagaggggggagggaggaaaatacatgctaaaatctaaaatatacttaaaatctgggtctgggttaatggctcagtgagcaaaatgcctgctggacaagcatgaggacctgagttcaaatcctgcgcatacttataaaacctgataactacagcaccagacaagcagatctctggagttcactagccagtcagactagccaatccacgggctccagacttagggagagatcctgtctcagaaaaataatgtggaaaacaaacaaggaagacacttggcataaacctgtggcctccacaagtaagtatgtgcatactcgtgcacacatgtataaccagtcaaacatacacatcattacatacacataggtaataagaaaaagaaaaacattttagataaaacttacctgttttgccattttctgtgtatgggttcaatggcattaagtatatttatatactgtgtaactgtcaccaaaactttctgtctccccaaaggaaactgcccatttgttaatcactagctcctcattttatttttcctccaaacccttataaattgtaattttactttttggctcaatgaatctgactataagtacttcatatacatgaagccacaccatatcagtcttgtatgcctggctgttttcccccgggcttcatatcttcaaggcttatctgtattgtagcatgtgtcagaatttccttcctttcaatggctgaaggatgctcaatgaaaatactatagaatttgtccattcatctgttacttgcaattaaacagtatccatctttttgctattgtgaatagggttgttaggaacatgaatatctaagtcttggcttttgattgttttgggtatatatacagaagtggaattgttggatttcttttacatccatttactgtgcatatggggtcaggggtcagaagacaatttgcttctttcttttcaccatatgggttctgggaattgagctcatgtcattagccttatcagcagataactttacttgctaagccatctcaccagcctgtttttgtttctcaagctagggtcttataacccaggctagcttggaactgtctgtgcattccagatggctttgaattcactctctgcctcaacctcctgagtgctgggaatacagacatgtaccagtttacagaattctcctgtcccattactaaccttagtcttaatcttggtaagcttccaggatcacatgagatctggtacttttatggtggtatggctgcaattcttgtaattccgtatttaaatcaaggaaccaccgaactgttttctccagtgcctgactcatttcacaactcctccgcagatatataaaggttctggtttttctacatcttcaaaacatctcttcccagcgaggagtgtgaagtgctatgtccttgtgctttgggttggaatttgtcaagtgactattgatgttgagcagtacttctcctgcgtggggctgctaagtctttgacctgcctttgaggttatgtatttcgcactgttttctaggcgctcttgtaagtcagatgttcctgtaatttttcaggctataatgcaattgacttcaagaagttctttgttgtttggttaccagcctctagactcatcatagactaaagactgcaaacccacagatgtggtcctgtagagatgtggtcctgcagcgcgtgcaccagtgacatgctctactgatgagctatatatcaaacatttcttctgagaagcagtgttttgctgagtgcttttctgacttatccaggctggcttcgagcttgattcttctacctcagtagctgaggttacagacttccgctaccagatctggctctctctactcattctttctgagctgaacatgccaaagcccctgagattctttgatcctggtttcagtttgtttgactcatgtatcaccttactgtgatagctagcaagccatccggaaaagaacacagtcagggaatggagaagaaaggagagacaacaggtgacagatttctttcaattcatttttctggttaaaaacaagaagatacataaagctgcttttctttccaagcagaacaaattcatccatttccaccaaagagtcccacccctccttagaaacttagcagttctcagtcagtttaattcaaggtggagaagagaaacatacctggcacaaagtgtcaaatgcctgcctttgtgccatccatccaggaactgcttttgtttttagtctctgtgtataaaaagctcgcagctctgtcttggaggttgtggaacttttgaggcatggctcttacctggtagtagtagttaatagaactatacctgcttctaatcctagatttgttgtttcttcttcactaagatgtgaggagctctgccatatgatcccattaccacagagccacccatccacaccttccccactagaatgacttgaagtttctctggaactatgaaccagaataaagctttcttcccttaaattgcttctgtgacatatttcattgcagtgttgaaaaaagtgactgattcaatgggttgtcatctaatatttctctgggaggaacttccaggtcaaggtccagagcgatcatttttccaaatcatctttttgaaaaacctctagctcctatctgcaccccatctgagagatggctatggtaccgggtctatgagctcaggcccagaggccttgatctctgaagttagccccatgcactcctggtgaggtgtctatctcacgattatttttatggaactgtgttttatttttagaatttccttccatttagctcatgtggatttcttttgcatgagtgttctaagactgtattggttatttttctccttgttttactcaaatgactgacaagggaggaaggcttcattaaaggaggaaggctttatttttgctcagagtgtgagggcacagctcagcatagcagggaagacagggcagtaggagcacaagccagcaccttgcatccacagtcaggaagcaaaaacgatgaatgcagacactcatcttgctttcttccctttattcagtctgaggcccccaacccatggagtggttctgcccatgtttgggatgagtcttctcgcctcagttaatccagtctagaagccccctcacagatatgcccagaggtttgtctcctaggtgattcttgatcttgtcaagttgacgatattaaccatcacatatactttcctaaagagtgaaaacttgccaggtggttgtggggtaggcctttaatcagcacttgagaggcagagacaggcagagctctatgaatctcaagccagcctggtctgcagagtgagttccaggacaaccagggctatgtagaaagactcttgtctcaaaacaaaacaaacaagcaaacaaagagtgaaacccccaaaacctaaaagagagtgaaaaatcaaaagaaagtattgatttgaaaactctgtgtgtgtgtgtgtgtgtgtgtgtgtgtgtgtgtgtgagagagagagagagagagagatgtttaaaaaaatcaagaaggtgtccacaagggactagtaattggggtacattctaaactgttgagaggactgtgtgacaggaattgatagcattcagttccacagaccttctccccatttctgaatctttgatattttctgatgagagcaggggaagcctagaataatttctctctcctcttggaataattctatgatagctttctctggaagtttagagacagggtcattagctatgtattgcatcctgattaatttcctctaatgttattcttgccaaaatttaaggcacaattggtagaacctttaccagtctgttttctgtttctctaactgagtgtcttgaagtaggtgattataaaaaggaattttaacagctcatagtttcaggagccaggacatctaaaagcattgtacgagcatcaaggagtggcttcttgcttcatcataacataactactagcacgtatccctccttttcttataaaatcaccaattccattatggaagtcccatcctaatgacctctttgtgtaagttggaccaaatatccaacagacagcttaagggaggaaaagtttatcttggctcacagttataaagagatttcagtccattatggtgaaaatggcagatgacagctctacacatagggacagaccagaaagcaaaaatattggtcagaaccagaaatggatataaccttcagaggcccactctagtgacctacttttgtcaactaggccccatatagaaggttccacaaccttcaaaatagtaccacaagtcagacactaagcatttcaactagtattctgtgagagacattctagattcaaaccacagctttcactgattcccctccagagtacactcctcaaaatgccaccaatttatgaattcagggatttttgtttctgtattagtagctcttctaactgctgtacctaacagtagcaacttaaaggaagaagactttatttaagcctatggtttggagggggtagttcagcatggcaggtgagttgcttggtaactggttcttggctactttgtgggttcttacttccacccttctccatcccttttcttgcatgatttcaacccctaacactacataggagagaaaaatgatagaaggaaaagggggagacgttatcgttagactccttcttgctgattaagggcgttgagttccttggggcaagtttgctcttcactgtcaggatatctaatttcttcttgttgttgtttctttgcacatgactgcctaacaaaaagcaaccaactaacaaccaacaacctaccaccaacaatctctccaggccctagcatttctatatcctctgaagagtctccagaattccaaatatcacataattgcagaaactatctgccaccggcacaaggcaaattatagtcagctgctgtgggcaatctgaagcagccccatatcccacacctgggattaaaacaaaaacatattcacataacatttctgtgctttttaaaggaaccaaaattctcacgacaggttggtggcagcaggagcttgcttctcacatgttagagatgaggcaagaagtgaccatcccctgcaatcactctcaaagacctgccctcagggggccgactcttccatcagtgtctcctgttctaaagagtcaaaagccttccaaaacaatgtcaatggctgttaaccaagtattgaactatctaaaactgtaggggaattttacattcaaaccatagcagtcaagactttggtgggatggaaacattgaagctgtgacagtgctgaagaattacacttctttgggagaatctcttcagtgtaatagtgcactttcattttcagcctggtccctctagaaagagggtcaggccttctctttcgcctccacacttccctggcctacattctcccaaggccctgcttggaaagtgctcatagagtttctgtcttgtaggaatccacacaagactcagccttctgcttgtgaaagtgctccttgctcccctgtatttgggcattccctggtgggctattactattgactccctaccttgacccaagcactcactgtactgagctctttggctaacctagtagggatcatttgacatctgggaacactgaggcttttaggaaattgtcaggcaaggaaggggctgaagccaagaggacacgcctcacgagggtcttctgacatccacaaatgtgtattcttggagagctagtgacaatttcctctatacaggcttttgcctgtgacaacagtgaactaaaggggaaacagattgctttgagtccaatctgtcctagtgggaaccatgccagagcatctctggagagcctgggactgagcccgagttactgtcaggatgtggcctagagcctcattttccttcctgcccccctttatcttcctctcctcctcccctgccttctgctccatgaccccactgcccctttcgtgggagctgcagagcatgctgctcagaaggaagtggctattggtatttcacttgcagaagtatctcagcatgcctgctctgcaaatccactcatggctgcaaaggagagccagcgtcattctggtgtgttgttaggggcttaaattcaagcgaaaggggcaccttcctgtttctctacctgttctggaatcttatttttgtggtccaggctactttggaacttccgagctcaagcaatccccctgcctcagactgccaagtagctagcaccctattcttagaaaacatagtgaataatgagagtgcagatccttccagtttcatagttagtcctcatttctcgctagccatataaaacaggtcctgcccagcccctcctgttcttcccatacctgcttatttgtcaggttcatggggcaaacagagaaggtgaaactggagtcccaagttgtggaggctcacccacaaggctcatcctgtatcggcctcagttttcttctctctcaaatgtggctaatcatacagcctgttttccctatcaaatgtctgtgatggtaagagtgatctgaaaactattttgtaaaaggttcacagtatctgaaagccatttatttccttctttctcaccctgcttctccttcctttctctctccctcccatcccccttcttcatccttccaccttcccttacctctgtctttcctttctttttccttttttttttttttttggacacaggacatccatatatagtccaggctggtcttacacataaatcctcctgcctcagtttcccaagtgctgggattagaggcatgtgccatcatgcccacctcaagtgccatttcttttggtaaagaaacctgacccatcctttaaggctcagttcagcagcacctccttgatgacttggctgcactcctctctcagcacttggaagtcttcatggggcacatagcttggagcccagagggaaaagtgctatgcgtgcatctgcagctcttctagacaatgcactgatgtggaaggcagagaactggctcggctgtcttccctttttatggatcccaaccctacaagtggtcaattcccaacaacagtgtgtggagctggggaggcaaaaataaataaacaaacaaagaaaagccaattttgtggcttggaagctaatcttggcaacagttactcgtgtgtccctctggacgttgtgaggtgagggtaaatgacagactgtgctggtagaatagctggggagggaggtgatgggaatctttcacataaatgtaaattaatatgttttcttgactccatttatttttttctcatttgaattgggctttgccaggatctctaagaagacaggacagttagtcctgccccatctctgtcttgccccaagtaccacacagataagtcagacaacaggttacagagcaaggtgcttgcctccatgtgccccatacagccactgagcaacagaggagagtaccagcgtccgggtaccacctcctgtaacacctcataggagagctttcttaggagctggcgagatggctctgaggttaagagcatagactggggctggagagatgactcagcagttaagagcactgctcttccagaggtcctgcctgagttcaattcccagcaaccacgtggtggctcaggaccatctgtaatggggtctggtgtcctcttctggtgtgtctgaggataacgatgatatactcacatacatgaaataaataaaatctttttttaaaaaaaaagagcatagactgctcttcctgaggacctgagtttgattcccagaacctacatggtgatttaccaccaatgtactctaagtccaggcaatatgatcccctcttgtgacctttgcaggcaccagtcatgtatgtggtacacagacataagcaagcaaaatacccaaactcagaaaataaaataaaatcaaatctggaaataaaataagcaagctgcgtcaagagttggtaggggcatccatgaaacaaaggaggaaagggtgctgatcttgcacaacaaagtgtcttggaggtcatgaggttaggttctttctagggtcctcctctgatattctttttttttttttttttacattattgggataaagttggctctgctaaataacatgtttgaagtagacaggttgttgggttttatttcatgtatggacctaaggacctatgaggcaccactaacgtcatacataacaaccatttccatcacacccaaacctctgtgtcctggctcacttctacctttctctacagcctaagtgtagagaacggggctctattgttggtgcgtcagtctaagattagaacattctcaggagctgtggccttagattttgaggactggggccaacagagccccagttggaagtcagttcttcatgaaagcgtagtcccctgactttgtaatgtggatgacctgaggcggatgatcttctcttcaggcctgagtgtttctatcaatgaaatgagatgactgggcaagatgctaagctttcttgtcaacccggagcacatgccctttctgtgacaaaacttttctaaacagcacttttaaaaatgcataaaagaagtgtaatccggcttccttgtttcctcatacctggagttgctaagtaacagggtgaggatgctggccagctatgaccctaatgtagcattcctggctcagcccttctccctttattctcttttcaagattacagaagcgcctctctctagctagcttgtaccgaatagtggtgtcctcctggctctgtctggagaagcaaggttcacttcttcaggggagaataagggtgaaaagagatggtttcctttgtccacctgaaccaccaaaccatgccacagaatggggacactagcttttcttcaactggagttgggatttggtgactaaagtgcatgcaacctctctgtactgtgtgcggatagacatgtcagtgagcaatccaagaccagcaggagaagacagaaatatataggtgagaacagaatgctgactgacatactagttcttgggctttgagctgaggctggaggaagaactggggtgatcaatataggacttttagagagagtgtgggccttaagggattttctcactccacagaggaagagaggaatcagtcacacaccccctgtcacacacacacacacacacacacacacacacacacacacaaacacagacggttagtgtcccctgcctatttgctgtgccctgcgaaaaggtggtagctgggttgtgagcgggttccaggatttatttcctctgtgctcagcaagtgcccagtaggtgctcagtgaatgtctgttgacagatggagtatactctaatgccatgtcaggcactgagaggcacacagagagaaactggccctagtccctgactgtggtcaaaaaggaagggtaagacaagcgcataaataactttatacaggacagactgtggtaaatgccttgagagaaaaacagtgaagcgccagggaggcagggcactcacatctggcagaagaggcagcagggttccagaaaaaactgcctcctggtgctgccactgagcttgcagacctggaatagggatggggtttggagcatggctcaggaatgtgtgtgtggtgagggcgaggagtgagaacaggctgcattccagaccccaggggcagattggggacctgaaagttccttcagaatgtcctcagcaagcacagagagaataaatcactggccattcagagccttgttagaactggggcttttctgacttctcgttgtgcctcaaccccccaacttagagaatagacttagcaggggtccttgctggttcatgggttggtcagctcaaaccataagtgatagccagtcccagtggcctacgagtgatttcacaaaagccttccttccaagttcactgtgcttctaggaacaataaaactccttgaccccaggaaaaggccatgcaaggaccaatagttggttgctggctttctccatctatcagttatgtgactgagatgagccgttgctgggcagcagtgcgatcaagtggggacaggggccatattattttacatgagattgtttatctgcttattggctgccttaaaactacacagtggggagctgggtggtaacagtcctggttgtgctatacataggcaagagcctgggaatcaaatccatcccttcctctgctcttttcttcttcatttcctagtccgggtctaaaggaggtcagttactgatggatcaaatggtttcctttagcaagctattattccgttcatcagacattttcaaatgtatcgtgtcattgaatcttcaaaagcagtcttctaagcggggattatgaggaaataggctgagagacattaagggccttacccaaaacacacctagaagggcgagcctttagccctggcctcctaactgcaagtggccccagctgcagagagtttaaaatctgagagcatgaaattagttataaatcatcacaatccaggaaccaaacaaaggaaaagctgaagtgcaagagcccccagactagaatgtgctattatagagacaaagttgatcaaatgggaaaagaaatcttagcacatcaagtccaatatggaggcatccagaagtctccagcataatattggtaagagggtggagatgggacgcttcctcacctgggatctttcctgcccacgtgtgctacagtcccagctatagcccatcggggtacacaggggccagttctgctcacagcctcaaggctgatgtggccaagaggggccctaaccctgatcaaattgaatctacaaatatatgttatcagtacaaaagcaagagtcaaggtagatgtcactctgcttgggcacgtgtgcatgttcgtatgctggtgcatctacacatgtgtgcatgtagaggctagaggagaaccttgggtatcattcctcaggctccagccacctcgttttttgagatagcatctctcattggcctggagctcaccaaataggctagctaggctggatgttgagcaaaccccagacatcctcctgtctctctcgccccagcatacagtcactttcctatatactcaaaagttcacacatagtctccaagagaatataatggcattcctctctcccccctcactagggttacaagcccacaccatcaggttcttatgatttcatggtgttcatttatcaacacaacccattttagaacattttgtcatccccatacataaatattatacctgttattcttaacctccaatctttcagtatcctttactccccactccccagacatagacaatgactaatctactctctgtctccatgggtttgcctattgtggacatttcatataaatattctataagatgtcttcttttataaatggcttcactcagcataagctgttttgaaattcagccatattgtaagatgacacattcctttttttgtggaaagatattaaattgtgtgagtattccacattttgtttatccattcatcgattgacaaattttaaaggatttttttctaattttaaaaaaattctatttatgtatgtgcacacatgtgtgctatgtaccaccaccacaagagtgtggaggctatgatataacttgtagtctccctctaccatatgagtcccagggattgaaccctggttgtctgaattggcagtaagcaaggtttgtttgttttgtttttttttaaccaacttgttttttgtttttgtttttgtttttttgtgtttttgttttttggttttttgtttgtttggttttttttttttttttacccacagagtcatctcaccagcactgacaaatggtgagtgtgtgtgtgtgaggaatggagagaggaatgctattatattctcttggagactatgtgtgaacttttgagtatataggaaagtgactgtgtggtaattagtttttgtcaaagttgatgtaagctagagtcatataggaagagagaaccccagctgaaaaatccctccatgagattggcctgtaggcgaagtctgtatggcatcttcttgattagtggtttctgtgggatgatccagccagcccactgtggtcaggtggtcctggggtacataagaaattgagctgagggagccacagaaagcaaaccagtaagcagcactcctccatagtctctgctttagttactgcttccaggttcctgccctgacctctaggtgatgtctgtgatgtgggatgtgaaagtcaaataaacactttactatggtgtttatcagagcaatagaaactaaactaatacaggctgcatcatctctctttatcaacactagctatctaatatggcagttagcagaaccatcttagtatgaagtggtgtctcattgtacttttgagtcatatttccttaatggttcattatgctagatatctttttatgttactaggtcatctgtatatttctttggagaaatatctattcacattcttttccttcctagaatgggatggtatttttattgttgacttgtaaatgttctttatatattctgcatactagaatcagataaataaatgttttatcttattctgtacattgtattttgctgtctttgtagggtctattaatacatagaaggtgtaaatgttcatgaagttgaattcatttaattatttcttctgttataaagcttttactgtcatatctgagaaaccattgttacccaaagttgatgttctctctctcatcatcatcatcatagcttattgaagagactgttcttttcccattgaaggctgctatcattgttgccaaacatcaattgtccataaatgtattggtttatcttagaatgttttatttgattacatttatctatatattggtctttgtaccagtagagtgtgagcctggtcactgttgctttgcagtatggatgttggttggggttctgtgggcacctcccgaggagctcctgattcctgtgtcctagaacgtgaacttggaccagattacttttctagcttctgtgataacataccccacaaaagcagcttccggtaaacgtcatttattttggttcacagttccttatggtggggaggtcccagcatcaggagtgtgagacagctagtcacatcagagccacagtcaggaagcagggaatgatgcatgcttgtgctcagctccatttctcctttttgttaagtacaggaccaaagcccacagaatgatgtcatgcaccgtaggcaactcttcctgcctcagtcaacctagtcaagaaaagtccttcacagtctaacctaggtcatctttcataggtactccaggatgtttttcgcttagatgattttagatcatgtcaaattggaaatcagtattatcacacagacaaaagcctgtgcagggacagtttatcagaaaagagatgtaattccaagggaggaaggaagttggagcagaggaagacttcagaagctcaatggcagcataaaggatgtgggcttttgtgtcctatagcatgaggttagtaggtcatttgcataacaatgggctgtctttttcccccctttttaaatctctacttttacttttatttcatctgtaagtctgtgcactatgtatgcacagtgcctatggaagccaaaggagggtgctggatcttctgagactgtagttagagacaactgtgaattgtcatgtgagcaaacccagcttctctggaagggcaaacatggaaccatctctccagcgcacacgaggctttcttgagtatgctctgtcctgtgtaattgtacatacaccttcatatattgtatgcctcatttgcatctgaaatctccaccagtgcaggggtgtgtgttttagtactataaagaaccacaacttatctttagacaccccaaaatgtctgcacctgcccagatttatggattttgaaagacttaatgttgctgaaatgtcaatattatcaatacaaccccccccaaaaaaacctgcaaagagagatgtggtaaagcatacctgtaatttggaagttgaggtctgaggattgtcagttcaaggccagccggaactacaacaggaggcagacagtggaacgggaaatgaagaggaccttaagtggaggagtgggagtgtgtttgaaccttctattttgccaatcagtttattgcctaagctaatgttgcagtcattgagcaagatcttagggaccttactctctgtcttgttcccctgcctcaatatgaccaaaaatcagatgtatgtgttctccaactttgctgttcttttccaagcctaatttgacttagaaatcccaaagggtgccttagaaatccgtgtaattttaaaattagttcttacatttatgcaaaaaaggaccattgggatttgaattgaattctcattgtgtttgtaggtttgggggttatgtttatttggttggttgtaggcttatttctttatttagattgagtcttctgcagtgcaggctacccagaaacttcctaggtagccaaggatgacttgaacttctgatgtcctgcctcctgctcccctgtgctggcattgtaggcgtgcactctcatgcctggctctgagcggcttccctctagtatgtggtgtatcctttctcgttttttcataattcatgcttttttattgggaactggaaatgtgtagaaaacttgtgtgttccagtaactcttagtactggtctccacacttcatcccagtgtttcctcatgatacttcctcatttagttctgaccacataatttccataatggtcactccctcaaccaaagaccagcaggaggtgatcccaagggtgccctcacgtgccctggattctgactgagctcttacccatggcataaattgctccctaacctgtctaatcaaactgtgggctttgttttttgttgctgtcgttttgtgtttgttttgtttgctgcaccaattccctagataagcgtttgtggtttgttctgaccctgtctcctatttttgtccagaaaactaaatagttttgctccatctccaagacatccaccatccccctatccattgcctttcatctcacctcccctcgttaggcgccgattcctccatggtggtagaaatgaagtcaattctttttgtgagtcattcaagactctctgttctatagcctgttgctctccctgggcaaactctctgagacacggctttgttttaaggtcaaagcccctctttcctctcaatttagagctaagcactcacccaaaagggaacagcactgttttggatctccttggcttgcttttcctcatctagtacctgcgccccagagaccaagccagaggacttttgtacggtcagtggtgggtgctctatcccacgagagggagctgcatggcagaagggatccccgcctctttcaggctcctttacctggaactaagcctgagcaagaggtcactgagaatggggtgagaaatgctccttgctgactcctcctacgaagatagccctcccactgggagctgatggagaggattcctgtgttatcaggaacagtcggggatgggttttctgtcccttcgtgctgtgccgggaaggaggaggaagggagtaagcattctttgaactatcctaggctcaaggttccaatttagtggattctcttcaatgagtgtggttttcctccattctttgtacacttttaggaggatttctagggactcacagtgttataaatgacactactttagagggtggctttaaggttcccaatgcagataccccacatcacagaagaatgtttgtgatggctgatgagccctggttatcactgaagcggagagtttacattagggcccctcctggtgttaatgtgcagcagtctgtgtcgtctcttgtctcacacagaatgcctccactcccctaaacatcctctgtgtctcatccactcgtctttctctccccaataggaccagacaagccctggtatttctactgtctctatagtttttttctgtttctggattgtcttatcaaggcaggatagaaagccagggaaaattaaagagacatggaaaagaaatgaagagcatcaatgacttcaacacaagtggcaaaataaagattacctacagagacagaattctctatggcttacacaagagcactaaaactcaacaagtaagccatgcttgtttggggccaggacatgtgcatccttttaggtgagccaaggtagcactcctcctttgtccttaagcctgagcagtgtgcattgtaaagctgccttacaatttcacttacgaaaagcaaattctttaagaagacaggaaaccaactcatatagttttacttaatttttaaaactttccttaatttttgaacttggttggaaactacatcctctgattaatacaacttcagaagccataaaaacttatgtctgtaagtaacactgttagtcttttctgaggctggagcgacagctcagtgattaagagcactgttgcacttccagtagacctgggtttgactctcagcatccacatggtggatcacaatcatgtagaactgtagttctggtggatctgatgccctcctctggccttcaagggcaccaaacacacacatggtacacagacacatatcacacaaaacagccctacacaataaataaataaataaataaataaataaataaataaataaataaataaataaataaataaatagataaatagataaatagataaatagataaatatataaatagataaatagataaataaataaatattttaaaaaatattggtcttttttggtaaaacattgtaaaacttgcatttacaacattttcatctcttactttgttagacttttaggccagttttaaccaccaccaccaccacgcctgcccaaccttgtaaaatccttgttaacagaaagccaccaatgcatttcaacgtgtcctaaagcagtgaccctcagtttccttcattcatttcttttatactgattcttttaaaattagccaatcaagaaaagctgtgaggtcagagcccagccaaagggggaaagctatgttcaccacctgcgttacaataaaaagatcacttcttgtcttgatgcacttgctccttcaagtgcttccttttgatgaagagtaaggtttgcctcttgagacaattcagttggattggtagtatctttgtgagccccagtgtttttctaagatggctattgttgagacagtcaaggtacctcattctctctgtctctgtctctctcttcctcccctctctgaatgtctcaacttaaatataaagcatgcacaatttccgtttctacttaataaagtcactaaatttgctgtactctaactcatctcaagattcttttctgtgacatagtgaaggacaacactgctttacctgaatagaatctgctaaaagggacaactcctcgggctacggggctgtgttgttttctgcctctgatcatatatacattacatggtctggagccttctcagattagcttttttcacttagcaatttgtgcttatggttctttcatgtccttctgtagtttggtaagtcaattcctttttgtttgtttgtgtttgttttattgtttgagctcaagctggtgactcatctcttttagcactgaattatattccattatcaggtgctagcctagtttatccacttacctactaaagagcatcttggtagcttccaaattttgacagttatgaacaaagctactctaaacatacatatgaaggctgtatgtaaattcaagttttccttcatttgagcaaatatgaaagagtgtgccttccagatcatatggtaagagtatgtttatactgtccataccatgttgtattcctatgaggagagagtgagagtttctgttgctccatagtcttgcttgtgtcaagttctatattttgaccattgcaaagtagatattaatgtttcactattgttttaatttgtaagtctctaatgacataaggttgaattttttttgagacagagtctcatgtagtgcagtctggtctcaaactcactcgctacatggctgagaataacctagaactcctgattcttttgcacccccctccaaagtgatgggaatgaaaactgcctggcttgaagtttcttttttgcataattttatttgccatctgtacatcttctttgtgaagtgtttaggtctttcatcatcgtgatgatcaatatcattgtcatcacgtgtttgtgtgtatctgtgtgtgtgtgtgtgtgtttgtttgtgtgtttgtgtttgtgtgtgtgtgtcccactgtggaatttcaggattgcacccaagtggtgaggctcaagaagcgcttcgcctgctgaaccaacttggcagttgctgttcaggctatttacctatttttaagtcatgttcttcattttcttatagtccatttttgtgagtgtatatttgggattaattgcttttatcagccatgtcttttctaaacattattttccagtttgtggcttgtctttccatcctcttgattaataccctcagcagagcagaatgtttgccttttttccctttctgtggtactataaagttcaaacccagagcctcaagcatcctaggtaggcattctgccatggagctgtacccctagtttggaatatctactaccaatgcaactatcagatcaatgatttctttcattgtgcctttggtgttgtgtctaaaaagccattgcaatgtagattcattcattataacaaatgtacagctctggtgtgatgtgttgatagtggaagagatttagcacctgtgaagacagggcttatttggaattccacaattgctactcttttgttctggatccaaaaattctcagaaacctaaagtttgtatgtttgttttggctttttgtgacagggtctcactcggttgtacaggctggtctggaattcattctctttgtaaactcgatctggctcgagttatgggattacaggtatgagccaccatactacgctaaattctattcctttaagaaaaaattgtaatggtctagatgaagacgggtgtcagcattataaggaaactaacaatcaagggcaaaataatcatccaaaataatcatcgccgtatacaagccatgtatgtggttttacattttgcatttagatctgtgaacatttatgagttagtttttgtgtgcgatttattttcctccttccttcttttctccctccctccccttctttctctttccttctttctttggcacagcgatgaccacttgtttgagcactatttattgaaaagatttctttgctccagcatgttgctttgttgctttctcttagagcagtgacttattcatgtcagcctatttttgtcccactgatctgtttgttcttcacaaacaaccccgtcttgattgctgcagctttatatgtggttcttattggattgtgtcagtcctccagctttgtctctttccttcaatatggagttagttattctgggtcttttgtgtctctctatataaaaccttagaattagttttagtgatatccaggaaataactttgtgggatttcaattggaattgcatagacctgtagatcaacttaggaagaactggcatcttggaaatattgaattttcctgttgtgaacagaacatatctcctccatttattattgatttctatcattatggttttatagtttctccatacagatattgtatagctcatgtcaaaatttcacccaagtttttgatgctttgggaatgctaatgtatggtgatgtgtttttaaaacaatgaacaagttatgattaatatagaagaggttgtacattatatacatagtttaaggtaaagatatactaaaaatatgaaacatttcacaatgttgcctatcaccctggcataagtaccacactaatctactctgtattgtttcagctttgcacggtactgaagaaaacattgtaatgcgtctttagctccaaactccacttcttcattgtagttggcctttctttgtatgtcaaccttgtgtcctgcaaccttgcaataacaattagttgcaagagttctttggtttttctcagattgcctacctccatgatcatgtgatctgtgagcagagacgaagggagagtctctgctcttattgcgttatcttccctataaggagttggagatcagtgatgctagtggacctcctagccttttgattcctgatcttagtgggaaagccctgacagtctcaccacaggggggtctagcaatgaaacccagacttaccttgaactcaaaatcctctaacccatgtctggagtgttgagattacaaatgaacactactataggggttagtttacttctagctttctgaagttcttattgtgactagacattgataattttatcaaaacctttctctgcatctattaaaattattgtggggatttttgttaccttattaagtaattgattatgttaattaattgacttttttattttatttatttatttatttatttatttatttatttattatttttttttttgttgagacagggtcgcatcacatagctctgctgacctggaacttactttgtaagccaaacgtgcctgaaattcctgggtctgcctctcaagtgcattgattgattttttgatgctgaaccagcccttcataccaagcataaatctcactttattgtgaagcataattctttttgtacattgttggacttgactttgtctttgtttgattttagtattaggataatgctagcctcatagaatgcattaagaagcattcccccggcttcaagaaaactggtactttttttccccacaaatatttggtagaatttaccactgaagtgatctgagcttgctgttttctgtttgggaaaggtattaattagtaacacagctcctttaataaatataggtctattcatatcccctagtgctctttgtgtgggttttgtcaggctgtctctaaagggattgactggatttgtctagggtgttgaatgtgagggcatagcgttggtcactgaatccctttattattcttttggtgcatgtgcgatcaggaatgatgccctctcatttgtgacattgataatccatgccttttttctctgcctggcattaaagcttattggatttttatttgtctgttttgtttttgttttctttaaaatatttttcctcattaatccatttatttattcactttacagcctgatcaaagtcccctccttcctttcctcccagtccccctcccactccttccctcattcccccatccccttttctctaaatactgaagattcgataaaacagctttttgttatccgcttctgctgtggtctgagagtagatagcatgtgatttccatttccattaaagtggttaatgtgtgctttatggcccataaaaagttactattagccaacctttgtcaacttgtcctcattgaactttaaataatcagtcaattacaattcatattttcacactctagtactgttttctgcttatgaaacttccatgcctcctttcacacacattttcttttgagtcatggtcttgccacaatgtcctggctggtctggctggtctcagaactccccagatcaagtgatcctcttgtttcagcagcccaagtacttggagctaccgatgtgtgctactgcagcgcatctggaagcttctgctaccataagttgtcattctctatatctaaagtcagtcttcagtttttaaggacagcagtttgcctttggacttctctgttggacatttaaaaaatgggggctggagagatggcttagtggttaagaacattatgtgctttttcagaggtcctgagttcaattcccaacacccacatggtggttcataaccatctataaagggatctgatgccctctgctggcatgcaggtgtacatttcaagcagaacactcatgcataaaataaaataaaataaaatcctaaaaatgtggttttttttttaaatgttattgatgtagtcagcttttcacttggtgctttgaggtttttagtttgttgatttaggttttgggtctcgagttttatgtaggaattttgatggtgggtgtttgtttccttttggttttgagcccaggtctctctaagcagcccaagctgtcctagaattctatatagctcaggctagccttgaactcactatccacctgcctgggcctttctagtactgggattgaaggcatgccaccataccaggcttcatttttctttaaatattttataaaatttatcagtaaggccacctgagcaggactttgccatgtggaagttttaaatttgttcattcaatctttttgtttgttttaatgcattcatattttccttcttgagcccattttagaaattgttctttctaggattttctatttccttttccatatcttctttgtttcagtatagttatgtatattatattagcttccttttattttcataatgtcaattaagtgttgagtcttctctgtttttctactatactcaaagatttgtcctcactcccaaagtaactaatttctgattttgttgttattttgttttattttctctattatttttctatgtgcttatttatttcctcttttatttatttgttttgcttgctttggatttagcttattctttagtttcttgagcatttttggcttgtatttccatatgtcacagctagttttttccctctgctcttttactctcttctttggtgttaattaaatgtcttctagttcaggcataaatccctttagtgatttttcaactacagtatttttatctcacttttgttttgacattttagacttatcatttttgtttgcttgttctgatattaatattttggagtgggtatttttctcaattctctcaataagtcagtttcttaattgacttgagggttataatatacattttagcatgtgtattggttgctctttttgttgccataataaaataccatggcaacaaataaattataaaggaaagggtttattctggttgagaaaaattgagaaaaatacccgccccaaaatattaatatcagaacaagcaaacaaaaatgattatgactacgaaggaggaatctacaatgatggaggagacacggcagcagacagccagagcaggaagctgagaggtcacttctcaacctccaatatggagcagaaagtgcaaacaagaagtgtggctagcctatgaactctcaatctcacctccaattggcatgcttccttcagcactgctatacctcccaaaggtcccataccatccccaaacagtaccaccagctgagggccaagtgttctaatatgtgaacttgtaggagacatttctcactcaaaccaccacattccatccctggtccccataggctcacaaccatctcaggatgcaaagtgcaattacgtccaatttcaaaagtccccacactctctcacagtttcaataatgtttaaaaacataaaatccaaactcacttcttagactcaagacactttcttaactgcgatcccctgaaaaacaagaagcaaagtacatacttccagcatacaatgcacattaccattaaaaattgcggtgggggggggggaggtgaagacatgatgaaaaaatacggggctaaagcaatactgaaacccagcacggaaaaaccaaattccatagctctgtgtccactgcttggatggctctgctcctccaactctgctgcctgccactcccctctctcttgctcttgctttctcgttctcgctctcttgcactctctccccttctgtttctttctctctgtgtctctatttgtctctctcctttctgtgtgtgtctctcattctgtccctgtctctcttctctctctctccctctctctctctctctctctctctctctctctctctctctctctctctcccctctctcctctctctgtctctgtctctctctctcagactggttccaacctctgtatgcagctttcctttgcagatgtctcacatttctgacatccccaacatcttggggtctgcactgcaactcaggcttcactatcatagctgcaacacaatggtttcttgtgctcttctgctctcttggggccatctcacagtaactccaacactgccacacagtgcctggcttcaggggctctctgaaactgtggagggacgtggacacttcccttatacttgtaccctttatgcctccaaagggaatactgctaaattcagctgctagcctgggatggaacctcaccactttgaatcacattagtagcagttttctcatggtgaagcagttagttactagaaacagaaaacctcctaggttttctctttacatgagttggaagcttaattggatgggatattgccctgggagcacccattccattgttctaatgcaaacaggactctccgtaacaattacagcctctcttctagcacatgccctggctgtaacattaagcttcccagtcattcttcttgacaagctgtacattctatatttctttctgccttgcttgttcttttccattgaagatctccacaagcattaccagtaataaccatgctgtgtatttgaccttatgctgtttgaaatttcctcagccaaagaagttagtctattacttttcatgtagcctccagcaagttcttatgacacaggcaaaaggcaacctgattctttgcccagatatcacaggagtagcctgtagtccagttgctaatattatctgaaacctcatgagccccacctctattgtctacatttctctcaataatactgtcttccaggcgtctaccagaatattacattaaactctgcttacagcattcaactgcttttctagtcttaagtgctgaaatcatccacacatctcccaactaacttctctgtgttcatgacttttctgttgatgtaataaaaatactgtgagcgaggcagcttacaggaggaagaaggttggtttactttgacttccagttctagaaggaaaggccttactaacaggggagctatggaagcaggtgagcagagcaggaagctaagagaccacatcttcaaccacaaacataaataaaagagcacagtcagagccaggggaggctaagaactctcaaaggatgccccaatgatacactctctccagcaagactgcacttccaaaaggtcccagaacgtctcaaaacagcaccatcaactgagcaagtgttcaaatatgtgagtctctgggggacatttctttttcaaaccactatgggctgacagaatctactacagttatacactaaagaaaaaacagtaaaggccaggaaccgcatcctgtgtagctgcctttctttctccattcttgggctattattatctgcccatgtacattccaaatctaacaacacctgcttatgattactgttgtacaatacctatttgtgattactgttttatatagtcttacatttttagagaaaatacaagaagaaaagaagagtagaatagatttgtaaagttcctgaaataccattgctggttcctccatttctctctgctcatttgacttaacatcttcagtcatatccacacaccagcacatgcacttttattacaagcagtaatgtttttatcctaactacttcctttatgctgagtcaaaaaatgttttatttatttatttatgatacagggataaaatacagttttatagatgttactcatgaaattactttttaaatcagctaaatgaagaaaataagtgtattattataatccccccacatacactttctccaagaaatgctaaggaggacagtgcctgcatctcccagactgataaccccttgtcctgtgactgggcaccaaaaggacaatggtagtaccagtccttctctcattgtctctctgaatatggactctccatcttaagagcaagctggggtagagtgatgaggtcagtgttcttggcccacagagcctaggacagaacgactgccatgtaagttggatctgaataggggaaaggctgtttctacccaaaaaaaaccagagtatctgttacactgacatggggagatgacgctcctggggtggagttgtcacaattagactgaggtgaggaagagagagctgtgcttttgtggcctcgctcatccagaacggtcacacagaacgtggttgtgggggtggggccatggattggggattgctgtggactatggtgcagatcctacagattcgggatccttgctgacatttagtagagttccttggataaatacttctccattagtgtgaacacttcccagagactttaaataggtgcttttcaatttttcaccagcgaaatgcctgttacactggagggaaacaacaagcttcccacaccatcctggaagtcccaacccttacatttttttttctcccgggggaaaaatatttcttttgttggagactttgccacatattatctctcctagaattcaatcaagtcgagatccgagatttcatgcaggcgcaaatgaaagcacacaaaatgacaagataggtttccaatataaggctcatttcaaaaaaccaagtgaagaaatcatttgaggtgctttgcagagtagctgctctccagaaatcgggcagtaatcagaggggaaacagtagtaattatgtgtaaatcactctaaacccgggaacggcagaaatcatctcatccctgggaagtgcttgagggttatgttgagactgctctgccgttaatgcaaccatagcgttgaaatttcaattgaagttttatgaaggtgggtgggaaaattgtctttaataaatattggcaagaacacaaaatagccctcatctggtttctcaaaacacataggacaggctgccatgtacagcagattttatggcagatggactgagtgagacattgttgtgcctctgaactctgtgaccattgggaagtttgtgtcccttctccctgcctcgctttctccgtctgcagctcctgcctcactggagcatgcagaaacgtggtgcccctggaacaggtgccttctgacctttgtccctttggacttcttctcagccccacaatttgttcaagagaatggccagttatgacaaagggcggtattgccaaagagaagatagccctagcagcctttgcttctgttcctagttattcatcctgtatgtcccagttctgaacagtcagcatcctttgtgcccccaaaaggacaaccattttccctggctttggggctgaaggggtaaatactgactcatctgttccctgggacactcctttcttgccttttcaaaggaagttcaggattgatggccaggggcacactggagactggctacttgcagtctgtgaccactgcaggggtgacctgatctctccctgcctcatcgcaaccttcacgcatgtactctcccttttgtatcaaactatcccactcttcatctctctattctaaacacagcctctcctcccacggcttcccagcacatctgcagtggggcctctcagctttttgtaaaataccatgaatttagatactgcctccttacttccctgcatgctatctgtccctccctttccatctctgtctctctccaagtccctcttcccctccttccactctccctccatcagtaaatcttccttctctaaacagcctggtcaccatgatgacctcacctccttgacctttggccttccttatcataccatttgtctcaaggcttactctgggcctctttccataacagcctactctgttctctcttctcctggccccaagtgctctttatagagacaacaggattccttccatacccatccccccagaatccaggcttgaagcccgataaaaggtagggctcttctctagtcaactgaaatgacagagaagtaggcatagtcagtcctgtggaatgtcccagagtccaaggaaaaacctgctgctggacccacccactgtgttgtcctgttgaaatgctcatttgatgctgctcaaacctctggttgaagagaggaaagaaactcagttattaatgtaaactgtcttactttaaaaaaaaagatttatttacttattatatgtaagtacactgtagctgttttcagacacccccagaagagggcatcagatctcattgtggatggttgtgagccaccatgtggttgctgggacttgaactcaggaccttcagaagaacagtcggcactcttaactgctgagccatctctccagcccctgtcttacttttaaatgttgccaattattctctctctctctctctctctctctctctctctctctctctctctctctctctggtttttttgtttgtttgttttgagacagggtttctctgtatcgccctggctgtcctggaacttactctatagaccaggctggcctcgaactcagaaatctgcctgcctctgcctcccaagtgctgagattaaaggcatgtgccaccatgctcagctttttctttttctcttcgagaacctgggagcagggctggatggaaggctcagcagttaaaagcacttctgctcttacagaggctctaagttcagttcccagcactcacatagtagctcacaactgccagcaactcctgttctgggagatccaatactgtcttctgatttctgtgagcatgctatgctcaaatacagacacaccagaaaaggatcacacatacacatacaattaaactaataaaaatatctgaaagtagtagaaagaacacctcccacagttactcagttcccatttctggaaggttactggttcagggtgacccatttcagtaccccactaaaggtagctcagcatggtggctcacatctgcattcctagcacttggggacccaagtcaggaagattgctgagaattcaagggtagcctgggcgttccagaacaacctgggatatattgagaacttatctcagagagagagagagagagagagagagagagagagagagagagagagatctgtatcatagacaagtttacgtctcactttgaaggtttactgtgtttcttttctattgctgttacaaaacaccatgaccaaggcaaatacagaaggaagggattatttgggcttgtgattccagagggttaggtgtccacaatgattgaaacagcatggcatcgtggaccgacaatggtgattgaagctggaagctaagaactgagaactcacatctccaactataagcaagaaacagagaatgtgaactgggaatatggagacatttgaaaccacacagcacacctttagtgatgtaattcctccaacaagatcacacctcaccatacagtgccaccaactcgggggcgggggggtcaaatatctagatgccagagcctatgggaaacatcgttattcaaaccaccacagtaggtaggtaccaacagagtcctaatcaatgacatttcctggttttatgaatcatgatttcatctaatcccagtacccaaataatgctgtctaatgatgctggagcaagttcattttctctgctgattaactcattaaagggcaataaagaagtgttactggaaatgttgggaagtcttggtgggactaacatatgattccagggaagtcagagtctccttttgaaattgtgttaataaaaaaatttgaaaatgaattcaaatggaagctcaagaacagtttatcagagttttaaaagaaaagccccaggtcagagaaactgtaaatcttgcatttgcctggaggaggagaatggaaaagaaaagggggaaaagtcatggcctttgagataagctgacatagaggtcagccatgtgacagggagagaagagtaaagaagctcaaagcgttagggagcttaaaaggaaaatcccagtgtaggcaagcttcaaatctcacaactgcccttggggggagtgtggagaagtgaattggggggggggagcagtcatttgagaatgcactggcatggggatcaacctgtgacaatgggcagccacatgttagggagaggagctttaaagaaagagtaaggaagcccaaagtaccagggagtttaaagacatacttggtctctggccaacgtccaaaagaaaagacagtagagaaaaaaaatagttacaccttcctgaggcagggtgagaatcctagaaaggaaaggtacaccaccttatggtgaaccaacccatcattctaaaagtggtgccttaggtgtgttcttgacctgactgactgaattagctcttaagggaggaatcaagaacacatctccacctagaggtagattccattcttcactgtaaccagggtgtggatcccagaagtaaaaagaagaagaatgtgaaggggaggggcagagtaaaaggtacaaaagttaactcagaatggcttgatcaaagatgcacatgtaagaactagagcttttaaagttttagaaggtagcctaaatcttcataaccttgagttggcatagacttcttagatatgacaccaaaggcgcaagtgacaaagaaaaaattagatacattgaactttgtcaaaaggaaaaaaaatgtgcttcaaaggccacaatgagaaaagtgagatgctctcctaacaaagaaaagcccacggccggatggcttctttcacttctgaattcttccagacttttaaaagaattaacaccaagtttacttaaatgactcaaaaaaaaatgaaggggaagaaagaatccttccagactcattcattattctgaataaaaacaaagcatcttaagacacatcgaaaacaaaactacagaccactgtcccaatgaacaaagtggaaagcttcttcccaaaatgctaactcaccccagaagagaaacagttaaggggtaagaaaaacgcctctagatggcacaggatcaaaacctagctgagctgtagagtgagttgaaggcaagtctgatccactcaatgaggtcctgtgactaaaataaaaataaaattggtgtatatacacagtggaatattatccagccgtgaaaaagaaagtcatttatttgcaggacaaaggctgaaacgcccgatcttcactttagtgaaataaggcaaacccagaaagatgagagtgacatatttttctctcatatatggaatctagataaagacaaaatgaaaatagagtacgactattaagatataatctagggagtggagaaaagagataaaataggatactgaggggcaaatgtgattaacagtctatgggtatgcagaaatgtcatgatcaaaaccatcttttgcaattagtttactttaatttttaaatcttgcttttaaaattaggtataagccaagagcagtagtgcatatttacttatttatttatttatttatttataatcctagcacttagcaagaaaagggaggcagagtttggggccacactggagtacagagcaaataccacaccagcctggcacttactcatcaacatgatgagatcttgtttcagaagaatgtatatgtttagtttaagtgttggtggcccgtgcccatcatcccagcagttgacaggctacagcagaagaatcataaatggaaggttaacctgagctacaatcttctgtaactccagttccagggtctctgatgccctcttctggcccccacaggtaccaggcacacacagggtacacagacatatatatatgcgagcaaaacacctataaaagaaatgaccagcttaaaatagaaaaattccaaatagtctgtactcaaagtagatccacaaatgagcaacaaacacgaaaaaacccaaaacattcaacatcattttccttgagagaaacttgagtctttttgtttgtttgtttgtctgtttgtttttgtttttcgagacagggtttctctgtgtagccctggctgtcctggctggcctcgaactcagaaatccacctgcctctgcctcccaagtgctgggattaaaggcgtgcgccaccaccgcccgctgagaaacttgagtcttaaccacatgaggtaccacctcacacctaataagatgactatggtctctctctctctctctctctctctctctctctctctctctcacacacacacacacacacacacacacacacacacacacactttcacacacacaagattatattacaggcaggtttattaagaagctgctctttggtaggtgacttcactggccccaaggaccaaggctagggaagtcactatgggaaaagagggggtaggggagggagagagaaggagagaaagggcacaggtgaagagagaagaggagaaaaagacaactgtgattttttgtgtgttgtttttggttttgtggtactggggtttaaacctggggccgtgtgcacattaagcaggagctctatggttgaaccacatccccagcccagcccagcccagcccagcccaggatggaggtaatctagtagatagataataaaaagtgttgatagagatatggagcaattagcactctcagacattgttgacaggaatgtgaaataatgcagtctctgtaagaaacagcccagttttttccccgaaaaaaaattaatcatatgacccaggttaccatataatctagatactctccatgtagatataccagagaaataaatgtatgtgttcacataagaacttttacataaatattcatagtgctcatgcataacagctagaaagtgaaaatcgcacaaatttcctttggtatgtgagtggagaagcaaatccacatgatggaactcagttataaggaatgaagtaagtcagacatggtgacacatagctaaatctcagcacaaaggaggctgaagagagcaatgaatttgagaccagcctgggctatatagtgagctcaaggtcagcctcaaaaccagaatgagaccttgtcttaaactcaacaaagagccccctccccaatgaattaaagatatgtgctgtaacatgaacgaactttagaaacattgtgctaagtggaagaagccagagggagagcctccaggtttgagggagagcctccaggtttttagtgattccatttatgagacgtgctcaggtgaggcaaatccatagagacagaatagactagtggtttctagtgactaaaggagaaaggaaatagagcactaacaaataaatttggggtttccttgcatattaaagttaaattgtgagaggaccacacagttctgaacatactgaagtccactgaattatatactttaattggttgactagatggtatgtgttttcaatcgctacaacacatatatgtgataatcaacttacaaagcaaaaaagatttatttatttatttatttatttatttattcattcattcattcaatcattcatttatttatttccctgcatggttttggtgttgtgtctttgatcaattggcctcactattgagggcctgtggcagtcaaacatggcaggggtgcagggcaaagccaaggagctcatgaatggtcagaagtcaaggaaacaaaggaagagaaaagggtctcacaactccttcaagaacacttcctgcatggccttaagacctccccactatgcctcactcttagcgtttagaccattttctcaatggcaagaagctggtaccaaacctttttcttccgcctttttcaagccaagtttcttcaaggctatacattttagttcttcatttttctagataaacctcttcaactgttgttctttcctttaccatttggagcaatctgttgacttctgcccagctggctgaggaggtaatgccattgcatcatttgtcatcattcttcatccctagtagtgtttgtagtatcctaacacctttatgtccctgtcattggttatcaattgcctttcaacccctgcttgatgagataagatgctggtccccttctctgtacctttctctctccatccaactctcactagggagcatttagtaacacatttggttcttattttattttattctagtgtttacgagataaagtttccagtagtccaggttggcctcaaacctactatatagccaaggatgtccttgaactcctgattctcctgcttccacctcctgagtgccaggatttcaggggtgagctacccctcctgcctagttctaattttcaaaagcacttggtcttaaaagtagacatgaaggatggagctagtttttcctgagcatccactagtgtcaggagctgtgcatacatcttatttaatccttgtggcaatcctgaaaagggaatcacatcattgtgatctgagacgtgagaaaactgtgagcaaaccacaaatctggtagggacccaagctggatttgaaccaaagttgaactacaaagtcccaatccttttcccagaggcccatgattcctccagcttcgctttcatttacaacattttgagttccttttctatgaccaaagtttggactgaaagtcattatctttttttttttttttttgaaccccataacgattttggctcgttcaccagagggcacaggaaagggcaacttaagaggaaactgaaggcaattgcactggcatgggatggaaggagtgggccatttgctgagatggatagtttagctgcatgccttggcaggcctccctctctacctgtggcctagggcttggcctttggaggctagcacagaaatctcaggtggtgtctgaggtgacactgggggccatgtgatagcatcactatgtctctcccagtcatactgcctggatgtgaagcaagttttgaattttgaaggttatatagctgactcagaccattgctcgggcattgcggtcatagacacatgtgggaaattcccaaactaactttcccacagagctgttttggagtgggggacagaaagaggccaggggtggagaatgtattttagttatttatttgattagtatctgttaaattggcagaccacttcaaccagaggctcggagtgggattcccccaggggtcacttccgggcatataagagtctagaggttagaaggcctgggctcagttttccatacggagtggaaaaggccatgatagaataaaactatctagcttctttttattcatcttcatgctactgtcatagaaaagcatgtggatatccacacccatctgcttccctcaaccctggacaaccagggttcttcctctgttgagactctaggcatcccccctgccacccaccttacctgcatcccagtctttccacgtccttgcttcagcccttcttcttggtccctggcttaccacctgcaccgtacctccaaagtcctcccaccctgctgcctgaccccagttcatctcgttaccactgcgagatggatctgcatacagaacagctgtctgaggactttcccaaggttactctgcatcttacatcataaaatccaaatgcctccgttcaaagaactcagccagtcctggcccagttgttggcatcctctggtggatagagagctccctgaagacagacgagctatgtcggtacaggttaggactagggctgcagagatttcttaggacgtaacagggtcaggacttgttagcacgaaagggtgagtgtgacaaggacatcgtggactagattatgcctcagtggtagagtgctttatctaccacacggaaggccatgggttccatcccagtgttacgaataagatcataaaaaataccttgcatggctttgtgtgtaaaagagctgtcatttgacttattttgataaatagctatgcaggggactctttcactggctgaatgagtagccttggataaatcttctgattttctgagcttctaatcttccacaagagtctcaaatttacactcaggacagagtggcccacagaggtgtttgttgatgaacacacgaaatccatttgaaatgcctgtgtccagcacatgcatgctctagttgtgtagtgtgccagcctgtttcccccctcccctgacgcaccccatcattttcatttgctgttcagtgcctgaaagcatttacatttgtgctgctgggattagactgtgtttactcccccttttaactctggcacgctggaattttgtttaacctgctttgaaaggaaacgtgctagtgctttgcttaagcggtttgcaatgccatctagtagccagcagccaggcacgactgaccgtgcttcctgaaacagcccaggaaagaacagtagtatttctgacttgtgtggtcagctgcacagggagatgatattccattgaaagtgattgtttttagatacccaagcacaagtggtgcccgtctacagtgcagaaaggaccaagcacagtgtgccattggcagccagctgggcatacagagggcattggttggaagcacaaagtatggatttagcccaagttgcctggcagggtactctctaggacagggtattgaatgggagtgtgtgctggatatggcccaatctatggagggactccacagagccacacacagagggcacagggagatgagggaagcatttcccccactggttccttggcattaaccagtcccaagggctgcatgagctgcaaatcagcctggccataggccagcagggcacagctcccttagagatgttagacagacacagcagcaactggaaggcagcagctcggctccagcagcaacggagcccaactcttttggggcagcatctgggtaagaagggctgagaactgagtagatgctggtgagtgtgtgggcccgtcaggagccatagtcaggcactgggtggaaagcagaactgctgatagctacagccgcagtgcacacactgtgttagagctgccctaaacttggcatgaatgctggagaaggactgtccttttggggaatcacagtggccagtaccctgcatgtgggtagtcatgggcttcaaaatggtggctaggaaagggatgggagagaggggtggcaaaagggaaaggcccacatgtctgactaagctgtctcatgggtctgaagcaactccagggtgcttcccagggaaggagactgatgcttggcctccctaacccggttctttcctactctgcttgcttatgaattcaaggagacaagtttcccatagtcctctttggcaacattaactagaatggaaaaggtaaactttgcaaagcaacttcacggcacacattgcgaagtcccggggaaatgttttgacatgcttctcgggcacggtttcttttgtgtgactacagcccactcatgtcaaccaggcactgagtgatacacttgggattgaggcccacaaaaaggaatgggcactcagatggtgggggctgtcaggcttcacaggtgctaaaggatgataggtgctggctgggcgaggctcagtcgtggccaagaccaaagattgggaagatgaaggagggtggatatgtggagatggaacacgactggaggatgactggggttgtgcgatgtgtatatgtgtgtatgtttgagacatgtttggggaacctctctgtagctgtggcatgtggatttcttctgaacagcttgaaaccagaacgctctggcactgacggcatggctagggacaaggccagagagcccagtgtcagataggtaggagcagcaggaactggcaaccagacctgtgtctggcagtggcagaccccctgaggtttccttgcctcctccagctaacttgcagtttgctcaacggaagccacagaaacccacacaccaaactgtgccattcttggtgcattcagggcctcctggggctctgagtgcggacagttcatgaagctagatcttagttgcagacatacatatacctggtcctctgtagctaagcctatattatcactgcctggccaggtggcttgctgggatgtagttgcttgctgagataggagctatgtgagggattctgggatctctactgtttcttttcagtactaagagttcagagcacactaagggttcagagaaatcccgggctctgcagtctgcccatctttcccatcacttcctactagggatacctgagaaggtttgatacagaagctagccagcacttggcccttcatccttttggctgctaggcaactggccagacctccatggtgaaggtatccattctatgagggtcctatgtgagtgatttaaggacaagcatcctttaagcagcaagcctttggtccagcaagtgggccctggcctggggatgctaccagatgcatacaggaccacactctccagcccagccctggcaagtagcatttgaataggagccggccaagtctgagacagcttgtggtatgagcagccacaacaccagtctcctcacattacttttgaaaacactgtgcaggggaaagaaggccaaacccgaagcatctgtgagccatattcaacctccgtgctgccagttggtgactgatgggaaaagcagcactcggtcgcacatccctgagaattctttttgcttagtgaactgttttcttctttaaacattttttatttatgtgaatgtaggggagagtatgccctgtgtgtatgggtgcccaaagaggcccaaaaagggcatcagatcctctggagctggagttacaggacattatgagtcatccctcaccccagtgtggacttaggtcctctggaagtcagcaaggactcgtaagcactaagctatcactcctgtccccagttgttttcttggtcttctaaaccctgctccttgagacaaatcagcactttaaaaaaaaaacctttttaaaaaaatattttatttatttattattataagtaagtacactgtagctgtcttcagatgcagcaaaatagggtatcagatctcactacaggtggttgtaagccaccatgtggttgctggaatttgaactcaggacctttggaagagcagtcagtgctcttacccactgaaccatctcaccagccccaaataagcactttttaattcaatccttagtgttgctactgaaatgcagttgaatatttattcattgatttattcattcattcaattaactttataaagagaccatgtctcacatatacctgtagtcctagcactggggaggctgaggcaagagggttgcaagtttgaagccagcctgggttatgtagtgagattgttttgaaagcaaaggaaagcaaaggaaagggtgaataaaagcagtgtgttgtataagttggtcttgaacttctggacccaacgatcatcccacttcggcctcatgtgtggatgggattactgccacacaccatcaggcctggctttcaacaaaccttcattaacttcattggcaagggcagtgctgggttgcatagatgaagaaataaaaaaacaatacttgcctttaagaaatagctagtctattggggagagaagcagagaagagctccctgagaggggcagccctgaggctggaaatagaggaaggagacatcgccaggaccaacaggatgaaagtgaagagaacccagctgaggaacacacagggctttcctggcctgagaaaccttgggcagatgccgagcattctggaaggcaatggcatgctcaggcgttggcgggcagccctgtgatgggtgtgtaaaggaatggagagctgggagcggcaggaagtgaggcgaatcttttggggcctggtgggccatgatgtgcatcctggccattttccctctgaaggcagcagggagccagctgaaaggctacagggcaggcagggacgggtctgtctgaccttggctttggatggtccacactaggggcctgaatgtgtcaggtggatagaagggacagtggaaaggtgctcaccggggaaccagatcctcagtgcttagacttgctcaatctagacctgtagactggggatgggggtagggggtgctgaggtgtgaagatatgctggtgagccttctgtcttttttgtgacaaatgcttgtaataaacaacttataagaaggaaagggttatttgggcagatgatgtaagaggtttcagcccatagttggctggttcccttgctttgaatctgtggaagtagaacatacagatgagggggagaagctacttaccttaaagcagtcaagaagctaagggccccacctactaaaacacatcagtgctatcacctaagagggatgtgggaagctgctactacagccacctgaactcagctcaccatctcatgggggctggctcctgtgagcatctaactaccttcagtccccattgggcatcacaaaggtgacacattttagaagcaaacctggccttgtctcccaccgttgctccaattctccctatcatggttaatgttaaacggagctttccgactcctcaaaaccaaatggcctcaattcttttcccccatcctccacgtttaagtcacgttgtttccaccttcaaaatagatctggaaccaaatgacatgccaccacttctgtggcctgtggcctgtggcctgtgtgtcacctctcaccttgcagcctgtgggatctacaagcatcctgtggaatcttctggtagattcctccctggcgcctctctactcgtctcaacagcacagctagtgtgatcctgacatgggcccttgccttggcacaaatcctctctgataactctctctttcaggttactgtcacccctgcgtgtgtgaccatatgctgacattctgctcctggttagtcattgctccagccacagtggcctccagggcctttgcatgtgctcttccctttacctggcctttcctccggattctggcgcagccccctccctccctccattgagaacttggcatactgcttcctaactaagcttctttggtcctcctgttaagagagcagtgtcccagtcctcccggctccggagctcatcttttgtttcatgtttctccaaacgtcttgcttcttgcatgttcgaatcatttgttttatgtgttgcctctctcgcccctccagaatgcaagccccaagcagcgggtgcttttccctctgctgcctctccctatggtttggattgtgccaggcacatagagactactcagcaaggatctactgaatagaggcgcagaggcttagtatgggtccctgagttgctctgagccacctctagaccacatgatacagaattctcaagagtagattgtttaagagcagcagagattcaagtggattataggagttagcaggcctagccagaggaaccttggaccagccccttcccctctctgatcttcagtgtgctcatttataaaatgattacaaacactgggatggaagatggtgagatggttcacaagggaaaggcagttcccaaaagttgtcttccaagattttcatgagcatcaagacatatgtgtgtgcactcaaacccaaatccaatatggttgccaactaactagcttgctctgtggaccctgtctctgccttctgagctagaattatagatgtatatatgtacacacacacacacacacacacacacacacacacacatacacacacacccctaattgggctatggcatggctcagtggcagggtacctgcaatagcatgcatggagccatgagtttcatgcctggaactacaaacacattaagtaaataatatttaacagattaatactttatattgtgatgcaatctggagtcaggcctggtggcatgggcctgttatcctgcctgtttaggggactgcggtgggagcatggaaggcctgcctagagtaggattcagagtgagttcaagggcagcttgggcaacttagaaagcccctttctcaaaataaaaactaaagaaaaagactaaaattgtagttcagttataaagcagttgcctagcacacagccctacattcaatttccaataccgcataaacaaacaaacaaacaaacaatcacacagtgttttgagttgctcagaggtgaaataagcaactgatccactgcccttgccactcaggtcccaagacagaaggcagagatttctaggcctgtgactccccatttctttcttaaactcttctgaaacgcagtcttatcttcaacctacatctataaataatactccattacagctgttcaaataataatggggaagggggctgccaggctgctgcattcagttgagcctacagtggtccatgaagtgggcttggttctggccatatgggtcaggacagggcagtggtctgagagacaccagtggtgagatgacagtccagcccacttctcaaagccaacatgcctaccatggctagactcatgagggcccacttccactcctaggctcagctttcttatctaatctagccagagcttccagtttaccaagtacctgtcacttaagatgtaatcctcactgtaactgcagatcagtatccttgggacaggcacaggggtggtccccacacaacctcttccttcttctatagaaattaccagatacttgctcacaaatgtctaggctggagctaggagagagagagagagagagagagagagagagagagagagaatgcttcattctttctttggctctgtgtaggctgcaggtggagcctagggaagggaaagcaggccaggccagatggaaaccatcactatcccaccggctgagcagaagggaggtgccttccctgcctagctccaccaggaatgctgaggttcctaaggccaattgcggggaggggacaggttactgtaggtgatgaactattttcctttctcactctgagagcacttggtgagttgctctttgttacagtagaaacagaaaaccagaaaagcccagcaggggttggccaaacttttcctttgttctgctgaataggatgactagccaaggggctgggtggggccagcacagggcaacaagtctgaaggtaaaagactaggatagaattctagcagaaacaacgacaataactaaacacaaaaaagcactgaatgcacccagtgaggaagacgcctatccccttacaggtctaaatctgcagccgtgaaaactttatttttagcatccatccatccatccatccatccatccatccatccatttatagcctatggctatatcacaaacagcccacaggccaagtcctgagcttctgggaactgggtgggggggagaacaaaacaggcaaggcttctccttttttcttttttttagaaccaagtctcctatagtccaggctagccttaaatgtactgtgtagtgtaggcagtaaatgttataaagaaaagaaagcagtgtagtgtggaaggctagggcatgtcagcagtctgtcgacagggatctaggtgtgaaggttgagaaagggggctggtgagcatgcggtatgtatacagaaaggtgatggggttaagcaatggttagctggttttcagcttccctggaggttgtcgagtcctgtcagggagatgtctggtgataggttctctgcacagcacgctatcctcagtgttcatgagccctgctccttcacatggcgagactccatctcatctctcatggcaacacaggcaccatcacaacccgggttgaacacctttgttcactgcatgtttgggcctctggtgctcagtatagactcggcacttagggaatgcttactgaaggaaggaataaatgagtggctgttgtttcctctgctttctccactgactgggtcatccccagccctggacagatgctcagcttatctttcattccatgggaaaagcctccctcagcctcctcgaacctacctgtaaactcttgactatctctgtgaagccttcttgacttccccaggcagggttgttccctccatcctccgaacattctagcacactctatctcccctcctgttactagccctgatcactctatggtgtttgttttgctgtcacctctcctaacctgtgatttgtcttagtggcaaggaggactgttttcatcacctgtgtatctctagcactaacccttagatggtgcccaataaaaatgtattgaaataaggctgggaatatagctcaatagagaccgtacctaatatgtacagagccctcaattcaatccccagcaccaaaaagtggaatcgatgtgggaaaaaaataacgatgaagttttttgtcagcctttgtgtgtgtgtgtgtgtgagtagtttgctggaactggcttgtagtggttagtgacagccaattgttaaatatttaggaatgtgtgagccaaatagtaaacattccatctttaaaactgcaattacaccagaaaacagacgacaaactgaaactgaggggcagtcaacaaaataactgaccaaaaatattcaaggagggatcctggagtgtatcctagaagagaaaaaagactgtatagggaaacctggtcaaatcccagttatttcgtatggtgctgcaccaaggttaattcaccagttttgacaaatgcttgataattatttgagatgccagctgaagggggagcttggtgaagggtgcacagggtggaaaccatacagcaaagagactcgtaagtctaaaattattctgaaattttaaaataaactgttaaacaaagatagtaaattttataaatctgtgattaggtaaatcatgtcgaaagcaaaggtgatcaatacagcttctcacttcctaattctcttgaagctttccaccgagtctatgcccttgcacttcttgctctcccctgtgtatgcatggcacactgcaccatagctcctcccactttgtgccacatttatgtcactttggaagctcgaaatgggcccaaatgtatctacatcatggaaatctgaaagtgccacaaatcagggctggggttcttgttctggacaattatactgtagacttaagaaagtgatgggagcttagcatacatgaggtcctgagttccatacccaaagggatcaggaaaggaagaggaaggaagaaggaaggaagaggagaagaaagaagaggagaaaggaagggaggaggaagagaagaaggaagaaaggaaggagaaaatgttaataacatacatgaaccttgaatctgtggtatgtctattgctggtaacttcatgtgtggtacacaaataactgaggaatgatgctctcagtatgcatgatgatttaacaaaaaagttcacccaatgacaaatccatgagggtttactgcttctttagtggctcactttctttttacttatgaatataaatgaactgtctacctaggaagtgcactggcctttctaccacagccagagtctggctttgaatagaaggcataagcaagatcaatgaaagcactatgtgagatttaatcagccgtgtgaaatttgcaacaaagaatacctgtcttatcactgtttataaactgtgtgttctgttgtcttagataagtagatgtacagtgctcacttacctgcatgcacacgtttttgagagaccattgatgaacatcttttagagcatcactgatcccagtgactcactttgttcttaattgcattaaagagaagaatatctgcacctcctctgggccacgccacaccaaccctttaatatggagaccttgacgttgctctttgcctcaactgtgtgaaagcattgtggtctctattttactaatggggctattgagacccaaagaggttaagtgaggaggccagaaataaaacactgcttatgcctacatccaaagctacttattagttcttgttgctgctgtaacaaagtaccataaatgtagcagtttaaggcaatacaaatgtattatcttagccctgcatgcctttaatcccagcacttgggaggcagaggcaggcagatttctgagttcgaggtcagcctggtctacagagtgagttccaggacagccagggctacacagaaaaaccctgtcttggaaaaagaaagaaagaaagaaagaaagaaagaaagaaagaaagaaagaaagaaagaaagaaagaaagaaagaaagaaagaaagaaagaggaaaaacagatgtcttatcttatggatctggatggaggttgaaagtccaaagagatctgaactcatacttgtgtaatgagtggtttactcactgaaacatctccccagacctatttcatctttttgattagcatatgtttattatacatgatagctttattattgcattttcatatatacacacatataaagttctttttatcatagtcatgccccgctattatctcctgttctccttccattcttgcttatcctattcctcctccctgacccagtccctcttctgtgttcaggtttgtatttgcttggttttgatgacccaatgagtttcgttaggattgtccacaagtttacaggtaccagtggcaactgctgtaagctcaagggccagacagctgttccatgttctatgacagatttcccagcactcccgctgacccccccatccttcagctcttatattctttctgcactctcttccaagatgttccctgagccttggaggaggggttacaaatgacctatttatggctaagccatcacttatcctcatcaccctgaccaggccttgtgcatcttcttcctaggttttcatatcatcctattcttgaaagtgtcctttcccactcttgccaatggcacagtcagtttatctgtgcttagtattcctctgcatgctctttcaggctcaagctgtctaagcaacagttgcctacctttctcactctctacacagggagcttcctgcttccggccatgagaaatctcgcctcctgagactgtgatcagaagtctctcatgccccagaacatgacaaacagatacatctcatcacagcttggttttgccattggtcttgccaaaaagctgttcccttctctatgccaactccatacccagcctttgaggtgccatctgaattgttctttggtatgggcgcattgaaattttttaaaatttactttttttcacagttctttgtatatgtgcaagtgtgcacatacacgcacgtgctacagggcacatgtggaagtcagagagggtgtgggggttggctttctccttttccatcagtagcacttatttttgacaaacatcatttatcattatggagaagctacagactggtgaccactgggctaatagccacaaattgtgtcccagaacagttaggaatctttccatgtggtctggatttctggctcctttggaaaaacagaaaaatctggtattactagatgtgcatttccacaggacagtaggtaactagattgggatggtggcttcccctctaactagaacaatgtcctgtccagcccttcacagtccccactagtccttattagattcccccaccttttttcactattctgtcgggttggctcataaaggcatttgaattaccttatctgaactatttcattcatgcccaagttcctacatataccacgacctcttatgtacatgtgaaactctgtgaatttcttctgtttctctcatgctggtactgacaaagtgttccatcaatactgagatggaacaatttgccttgaggtgatccttttttcattttatgtgtatggatgtcttgccagcatgtatgtctgtgtagcatgtatgtgtgtgcctcgaggtaagtttagaatgtatgtgaatttactttcgtagcacgggaaggcagtataaaagtagcatttgttgacagacgctcatatccctgactcagaggaacactgtgtggatggcaacactgctcccatgtcacagaggaaaactgaagctcagagagccacacggtaggatgagccttagtttcggtagtcagtttctgtaatcagggccaaagactttgtcgtataaagcagcttctggagacggagaggagctgccccagactctcttagaaagagagcacagactctgagaggtttttctgcttagacagagatcaggcatgtgtcatgcacctactctgtgccccgtgccctctcgggaaccccaagcctcctggtaggtagcccactgaaaaggtgaaacagatgaggccggattgctgttgggatttggggcccatttgatgagtcgcatttgattctgtcacaattgacagaagcaccttgcctgtgtgtgctcagagcttgctactcccatgtgccgtcactggcgtgcggtgtggggtgggaaaacacagagaaattatgcgtgcctaattgtgcagcagcaagcaggaaggaatgtgcgcacgccaggggctcccactggggcagcagtctgctgtcatgtgtttctgaacagttgcaggaaaacttgtctggacccttggatgcagaggggtgggtctggcagacgtgggttgtaactttggtggcagaaaggatttataggaagcagatatttagagtctagaaacttttctctggaacctttgtctgcttcccccccccccacacacacaccctctagtcacctccagttcttagccctggctaagaaaggagctatgtaggaagacctcaggcatggggccaaagtgttcttcaacacctgacatgtccacagacccattttagggtcaccaaaatgtgcctgctcatgttggtgcatgtactaaacctctggaccacaagctccaggccagccatgaaacagggaagataggtcagaatggggtgaggatgctagtgtatcaggtaagagattgtcttttacactctatgggatgcccagactccatggtccaagcacttcctctggtcctagaagcacaccctcagtagtccactcaatctctttgaagtcacatggcttacctctttctgtgtgagaaggcagaaggaaatgtttgcctatgtatcaagagatgaacgtttaagctccatagtgatgcatctaaataaaaaaaaaactattgtgctcagtgtgtatgcgtgtgtgtgtgtgtgtgtgtgtgtgtgtgtgtgttactacagatgaaagctagacttcacacaccttaaacaaatgctgtatctgaggtatatcctgtccctgttcattactgagggtgctattgagggtgctagtctaagatatttaaattcactatttcattcttaaaagaaaaagatcaagaacttgagttaagagaggaagactaagtcatcaaaagtcacccagggaaccagtgatggggccctcttgagctccatgcagagccagcataccacctgctagttccacttgatacacaggaggaaaatggaatttaggaggttcctagcatcagaggaagggctggattgtcctattctgtctctgctatctagcttgctgtgtgactttaggcacattactcagcctctctcagctgtctcctgtttgcaaaaagaggtagagttggaaatgtcagcgttccaaacctctgaaagcctataccgtgaaaagcagtattagtaggcagtagagaggagggaacttcgaatgcccagatgcaaaggatgggaagttgacctgggtgtgccttggctttacgagatggaagcaggcctgggaagacttgtcaaagtggatacagctcacaccaccccctcagcagccattctgcaagtagccacttgaaccaggtgatcactgatgaccaggttcagcaggcacacctacacagtgggctgctgctgccacctaggggacagtggtgacccggagcttggactgtacagagctgtgattcagtcacttgctgcacattccctgtctcctgctggtttccggagtggagagagacagcctggccctgttcagtggtggggaggggaatgaggcagagcgtcaagtgccgcctctgtttggggagttataaataaatccatctggaagtgtttggggctgtgagagctgagggctggccctgcagttcagaccatgtggtgcatatttccatccacaccagctcccccacccccagtccccagagactgtctgagccgggcaggaacgtctcaggccccacctcaactaccagcccccacccaggactcctctattctggtgcaatccacaagatcatggctgagcactactttgaatttagttcagtgggcccttgatgcctgacgaatgaatgatttttgtagctcagcattaggcaggacctgtgttggaagtgaagcatgctaggtttttaggatgacctcagcaggcagctaaagctggcctgggtgtaaaggcgctgcccgagtgtgcttgtccccttgtctcgagcacccagcagcatgctgctcagtcacaatgaagccatggaatgatttattaatgtctcaagcacctagtgcgcacccttctctgctggacaaggaaggtagaaaatgacagcctcggagaacttgaactcagagttcgagttgccccttatctatggagtgccagctccaagacacccactgagtgtattgttcttcctttcagaaagccctatgacaaggcccaattgataaactagtcacaggaggagattaacaacaactaataagcagactcatagccacaaacgtctagaaaagttattttttaaaaattcacaattgtttatttctcgaagttttccattgatatttttaaaactacaatgtccagtgagtagaagaaacttcagacagcaagaccatgtgtgcagtgtgcagcatgcagtgtgcagggggtgggcagcatgggggcagctgcacactgttagcagttgaggctacacagttctttgcagtgcgaggctctcctttgcagtgtggactttcctgacccaaagtggcagttgtactctggagcggctgggacaaccagacatacctctacacatttccaggtatttccaggggacagaagggacaggccctggctgcaggacatttggaaggaacttgacagtagggagctgaaaggaagctgctccaatgtgaaatgctaagccagccctctgcactgacaagcacagaactgggaaacgctgggttcaccccaacggtatgaaatgatccttaattgctggatcagatcccagaagcccacaagaccacagtcctaccaaactggattggagccaagaagcaagccacaagcatagcagttagggatctgctggtggcatgattgggaatgtccacaggctactgcaatccagccccagggacagagggtgggtaggtattgggtaggtgttgttggatgagaatacactatggtagaagttgcactggaggcctgagctcccattaaaatggctacaggttaaggtattggtgttaccgggaaccccccacaagcacccagatgaccactcagatacagttcatagacaactgaaagtctttattccagccaactggaactacactcaggtgttcgggacccaagcgtagcctcgagtgtttagggtaagggtgtaaagacaaaagccacatcataatacctcaacagctgcaggggaaggtctgcaggcaggcagtttaactgaggctaagttgttagctgggcatctggaccttggatacctggaatagagttagataatttccgcaggactctccatcaaggacatcagattctagttaaaactaaaatggcctcagcaaaatacaagatggaggaatctctgcatcatcttgccctgtcgcattgagaagggtgaagagtgacagcaggatataggcccatcatatagcacacaagagctgtgctgcctcttctctgcctcatgctcccattcttggtgcgagtatccccatccagggcttcatcttgtattgggaccatattagcagtgtcccaattattctatttctgtttctctgtcctttgaaatcatcagtttagttgtacaggggctagaacccaagactctccatagttggccacgtcatgcactcagctaaaagtatcttctggctttcaccccatcctaccatttgccagtgccacctataccctgcaccagtgccacttagcaatctgacctccatgacctctatcccttgtcattctggtcacttggttccagttaactttttccaggctccctgctttccttgatcccagaccttgctgtgtagccaatgccaagtgagcgtacactgccctttgctcctcatggccttacaattattcaatgccctttgaacttttctcaccgcagtgtgaattcttgggattcaaggcttggctgaaatgtttttgtctttaggaaagccttccccagtccctgagacaaacagtcaccctccccactctgtggtcagtccctgcactggttggtaagttgcctaagggcatcagccaggcaccattcagttttgccctcttcctcaacccccagtggggacaaagagtgacccagagataagattctccccaattgggccattctttatagctgtttccctgtggctactatatttggatgagggtttttgaaagagccaataaaggaatggctgagatgcagggccaaagccagggacagggaagtaagggtagaaaaaggaagggtagaaaggatagaagaagaaaggggatggcagaggccctttagcaggctcccaaagggcactctggtagcagagtggggtaaggaaggcagttcctgtggtgggtcagccaagtatacagttattaatgagcattagtgcccttcagtggcaagcatttcatgaaaggatgccttgctgggaccaaatgacagtcaaccgtgacactcttagtaaagagcagacgaagcatcgaggtaagagctgccaaactccttagagagatctcaagggcttcaaaggccactggaaccccagaacttcttttccggaagcctccctcttgcctaggaaaggtagacacaggaagagaagagacaaatgttgagcagcctctgccagacacatgtgacatacagagctcaatgacccttactatggctctgtgaggtacagaatgactccatttttgagattggaaaactgaggtcccggctgggttcagaatattgcccaaggacacccacttgagagagttggactcaggattctagtgtaggttacccttcccctgatgagtgggccaagatccagaggctggcagcaatttgatctccgtcttttctgactttggctatggggctcatttctttggattgatttatagaagtgtaaacaaaacaccggcactttttcctagctttggaatgggtccttggagtcatgcgctgtcctccactttctagctgggcacctttgctgaggggttcctgaaattgaagcagagattttaacctgagaatctgcagtgtgcgcagaaacactcagggtgctctttgtcatgatatacatccaaatgtgggcgccggcagcctggcccaggctttccggccatgccctctcagcaacctcaccagtatatgatatggctgatgcttgcctggcctcccagccccccctctccctgctttttaatttctttcagatgtctcctccacactgtccccactgtggtcctttgctttcacttagtgggtgatggatgccttctgtctgttgacagctgtgaatgacaggaagttggacagggcaaattgggacagcttttcttggaattctcacattgatgtacttaggctagctcttgtaggtagagcggctggtgccaggggcccagtgaagggagcaaaatagcacaaagccctagtagaggcttggctctgaggtgggacaggttagctaggaagcccaggatggctgttttctggacttgctctagagtcaggaatagagtagaaccttctgtgtttcccagagttgtgtgtcctgcttgagggacagtatgttaggaggtccctgctatgcagaggccttctgaaatcttgctgaaaacagaactcacattggtatgcacaaagacacgtagaggaacaagacactcatcctgcattggggcttgtgctctggccatcttattagagcaggacgcctcagaaaaaccttcagaacctattcagacgaggggtaagagaagatgggtggaactgggcacagcatgtgatacacacgtgggaaaacgctgtaatggaatctaccattctggacagtgagttgtacaaataaaaataaataaaatatatgcagattctgagctgcttgtgcttactcaggcctgcaaaaccagcagttagcagaacccaagcagaaagtttgtgagtttgaggccagcctgggctacatagaaagattctgactcagcatgaatgggtctgacttagatcccctgcatacatgttatcgttgtatagcttggtcttcatgtatgacttctaacagcaggaagaggggctgtctcagactctgttgcttttcatactacttgccccccactgggctgccgcatttagccttaataggagaagatgcacctaatcttattgcaacttgatatgccaaggctggttgacatccatgagaggcctcccctttcctgaagagaagtggaagagaaactgcagttggtatgtaaaattagttaattaattaattaattaattaattaattttttaaaaatcctggctcaaaagtaaacaaacaaacaaacaaaacccaagtctaaacaacaaagagtacagccacttcttttcacactctgtggtcctctgcatataggttgtggttgtgtgcctgcaaaagtggggtgcagccagcatagaaaccctgcatagaaagagcccagaaaaacaataccctcagctcactttctctttcttcccttgtccatacaggtgcctgccactgggtgaacgggactcgcatcctgagggcaagggagcttgctgatgtagccagcacaggtcagctaccagggccaaactgtcgggggtagggggagacgatgtgcaatgtgcagaggggcaagtagacaatggccaggcaagctgcccgtcttggtggctggcttctccacttacaacctccaccatttctggacatatttctcaattgcatttctcattccctgtcaccgttgccccttttctatgccgctattaataacggcacttaaccccatccatttacattcctcatttagcccatttccctactctcgcagtagagtgggagctccagcagggcaaagactttgttttgaacactgctattgttgccatctggtacatagtaggtgctcaacaaacagtgaataaatgattgaagggatgcactggcttgggctacccaaggtgagtctgttcttaacttttttgtggtagactgtagacatccaacttttactcatgcctactggtattgatttcttccaaaaaggaagaatggctgtcatgtcttcagatcttcaggtggggaagcctttgtcgctcccgggattgtggttacatgacgctttgtcaaccttagcctgctgtgtgttatctaagtgttagcaactgtggggcactggcccttcctcaaaaaacaccctctgcactagtgtacctgctttgaaatgaggaggattggagccacttccttcaggctcaagggcagggtgtctgggagccatgtcccctgccatcatgctgatgaagcctgtcaaattcagatgagaaatgcagatgtcaattcctagaacactgcagttgtgtcaaggatgttttaatgacacaaatactacaactatattcttagcaatgttggtgctgttgcagcgctggatggaacccagtaccttgtgtgtggtaggcaatcactctgccaccgagccgcatccctagcccatgaatacactgttattgtgaacaaaatcagtttggctgctgtaaaaatcctctccgtgtcaaccgtgctccccagaagtagccactgttctccacatggagtgctccccttcttagggatcttcatctccgtacatagcttggttttacatggaaacttaaaaccatttagtgcaccgaacacagtagttgtctgcagcttgcttttctcacttaataatgtcttggaaacctctgtgtgaggggcgtctacctcaccgttctcttgattaaacttcatattttcatcattgcagaatgacttgccatttcaaaaagaatacaggtgctctgcccccagcttttctctatgctcagaaatccagaacagcacacaagcaggatgctgacactggcccaagaacaagcatttccccctgccaagccatgcttacccaatgcctacttaacccttagcaatcatgctttaaaaagatttacacttgtgtgtctgtgcacgctaagtgcctgaaaagccgtggtgtggaagtcagaggacaacttgctaattctcttctttccacgatgaggggctgaggacggagctcagattatcagacttagtggcaagcactgagccatttcacagccccaccatttctttgtcttatttcattgaccagacttattgtacactatattatagtatgtaaggatattttcatgcaaatatatgctgtacgttgaacacattgtcccataccccttcccctgcctgtctgcaccaccttcatattagtactctttgtgacagtttcgcttctacttccatgtcctatacatgattttatgtatcgatataaaatctaggaatcacaagtgagagcaaagatatggcatttgtcggtccaagactgacttaatttgcttaacatgggcatctccccttgcatttattttcctgcatatagtttaacaactttgttccatttcttgaattaggtcatttcaacaaaattaaataaaaactacaatcaatcatcatgtcacctttagggatttcttttcatcaccccattatctagggcagtgattctcagcctatgggttacgacccctctggggtatatcctgcgtatcaactatttacattatgattcataagagtaacaaaatcacagttataaagtagcaacaaaaataattttatgagcctggcagtggtggtgcacgcctttaatcccagtacttgggaggcagaggcaggcggatttctgagttcgaggccagcctggtctacagagtgagttccaggacagccaggactgcacagagaaaccctgtcttgaaaaaaataaataattttatagttgggggctgtcaccacaacatgaggaactaactgtattacagggtcccagcagtaggaagattgagaagtactgctctagagtcattgtcacgtgtgatgaccctgtttgtttatttgtttgttcaacagtcctcctttgttttgccaagtgcttttccgtggtcttgatgcatcaaagaatgtttatccattccggcattggagggtatctgtagtgtttcctaggtttggcttttatgaataacactgctatgggcatttacctagcagctttttagtggacgtaaactttaatttctctgggacacatgcctaagagtgcagttcctagatcatatggtacttgaatttagtttttaaagaatctgccaaactgctttctggagcattctaccattttacattcccaccagcaacgtaggagggatccaatttctagacactctcatcagcgttgggtgttctcatggtttagtaaaatgttagacatccagataggtgtgctcgtgtctccctgtggctttaatttgcatttccctgtggttactgatattgaacatcttcccatgggctgaagtgacaactatgtctcctcttcggtaaatgtctatttatgtctttagctcattttctgcttgggttgtttgcatttttaactgctaagttttcagaatttttaatacattccagattcaagtgctttgttagacaatatgttttgcagatatttctcctagcatttaactttttaaaaattcctctaaatggggtcttccacagggtgaaagtgttaaccctgataaagaacaattattcatcttttttgtgaattcttttgagccacagtctcagaatgtaacccatgcaggccctgaattcaacgttccttctatctcagcctcttgttggcaagaatgacaggcctgggccccaatttcctgatatgaacaagttttgatgatcagatacgtggtctgggttatatgcccagctgtagatttgagtttgaatttctcttcttttcctaattttcagatttttaaaaaagtttattatagccgggtgtggtggcacatgcctttaatcccagcacttgggagacagaggcaggcagatttctgatttcgaggccagcctggtctacagagtgagttccaggacagccagggctacacagggaaaccctgtctcgaaaaaccaaaaaaaaaaaatttattatgggtgttagacatgatcatatgactctttcttctttaatatgctaacaatgaactaaatcttttgtgtagaattactgtaaaattctctgcacagttgggggaatttatcaatacaaccactgaacctggatatttctgttttgagttttaaactttaaatttgcttctctcattttttatttttatttttttaaagctcagatacaattttattatagcttaaaatgaaaacccaaagtcaggcaagtggcagacctcagaagcttcccagaagagaatgaaggggagaaaggggtgcaacttcagttaaatgcacacggagattaccttatgatagcagacagctacatggtgggacaggggctctatagaaagagaaaagaagcccattgtgttaggaaaagcatagatagaacagaagtaaaaagaagcaaagtcatactttcctgagcaattcagaaaagcagactagcttaggaagtagtgtggctatgctctataagagactgcagtagggaaatctgggaaggaaaaataccatattgcattaaagggataattattcctcctgtttctttagcatagtataaggtcatcctgccttctggggagtggtcttgccttcctgagggatggtcgcttggccaggtgattgacccagccaactggaatgtgaggtccccattcaggctaaagatctattctcttgatcagaaggagtttcctttaatgaggtctttctcgctactctaatgatacccctgcccccatgaagaaagaggcaatcctaaaatcattaggaggtaggcagaaaatagtgcacagaacccatttacaccatgaaaacttagttcttgttccaaaactgtccaccagaaggggccgatgacactggaagaactcagtgcagagattttcaagtctattcgtctatccctaatacagtagagttggaagtctatactctttttttaaagcctcgttcactttatcccagttatcagtgtgcagttcccactgcactctaaatgcctactgctatgtccataccacaatccattaagtactctggatttaatactttgtatagggaattgtctttcactttattttctctaaagtgttttttttagcattctctttgcatgcttcctggctttagaatgagtttgttgaatccaatgaataatttctgtggcaatttagctggaatagtagtgagcttatagactgctttaaggagaccagacattttttttcctccttcgtgcaatgtttttctcctttacaaagaccaccaaagcctgcaagaaagggagccagggctaaagaacacatagaactcacctccctgacttacgccctccccttatttgtgtctgtttgtgaaggcctgaacttcagactcctgaagttaaatatttattttaaatctttaacaggccgtgaacgcttagtctgtttttcagtagtacccacgaatagagacaataccttcttttcctgatcacaaagaaaaagaagatgtagtcacgtgcatacctagttaaacactgtcaggaaatggtggggtggtgcctttctaggtagagctcaggctgacagaaagtcatggtgggtggggtgggtgggaataccagtggatgcagaagcatgaaaggttactcatgtctaactttttttctgtggctctagagcaccatgtccgttcggtggtgctactagccacaggtacccacatggaaaccaaatggacctcgatgcttggctcaggctggagctgtctgaatgattcatcaggctctctcagggtcaaaccttaggtctacaaagaccttcagcatcacggggaagcagtcgttagctacagctttccacactttcctcaaagggaacagtaggacctggattagggtttctttggcttccacaaatgctgtctgggcaagcagtgctgtgcctacctatgttccattcagcccagaggataggccgtgccctcacaaatctggattctcttctgcatgtttattgtctccaaagcagaggtgggaccttagctgcaggctgtgatctgtgtttcttacagtctaaggaaacaagcaatatattactaataaagaaaataaaacaggcagtggcaaacaccagaggcgggtgcaaaggcgatgtggactttaactgcataactttttgatctactagtaaatccttcttaaccccagagccatgtccatgtcatgcacttgattcaactgcacatcctgccaaggttccagggtcatcttagttgcctctctctctcccatctgttccaatttctggtgcacattcctaactcacagctcctgctcctattcccatgcttaggtcttgttttgctttgctttagaaacagtctcactattattcttaactatgttgctctggctgtcctataactcactttgtagaccaggttggtctcaaactcaaggagatctgcctgcctctgcctcccaagtgcatgtgtcactatgcccagctctgtgtcccgctccttaactcaaagcatttcacacactcaagccccacacctgtctgcctttctcattaggagctattttacagcttttaattttgaaatggtaaatgtttgctataatgcttgaatttcaaagtcctttatgacatcatcgtttaactgacccttcctgagtgtgtctggtgtgtgtgagtggaggaggggtgcaatttgatgctgtggaaagcccatctcacctgaactttggagtcacacataactgagtcatatagcccctcccctattctttagcggtttgttccctgccttcgcccccatcttcccctggtcctcagtctctatccccatcagaagttgtaatgaatcgacgcgaggttctggtgtgtgtgtgggggggggggtgaataatgctggggttcatacaggactggggcccaggagggcagagcaggccaagtgtgccccggctggtttgcgtgagcagagcagctctgtgcagctccgcgcgtcaccaggcgcgtgcggaggcggcaagagcggcgggcggtgagtcatggtccccgcgcacctccggaactggaggctgcttggcgcagcacagcccccgcctagctccctgctcctccccgctcctggggcggacgggcggcatgaaagcctgatgccgggcggcagagggcgctgctgtgcagctgctggcaagccaaacaaaaaaggctggagctgcctctggctgggagggatgaacagcagcccagaggcggggcgaatgggggaatgaatgccagggcagccttgctgtttttaagagaaaggaagtgtacttcagaatgattcatccctgcacagagtgatggggcagtggatccccctacccaccgaaggagaatgcctttcttgcttagcctaagctgtctaaagttagcagcattatccattccttagagagggtccctgatagagcgggttacctcttttcaaaatggatctgcccaagggacttagcctgcaaccttctttcctctgatgattgccacttgaggaaagtggcctaagatttgagctgacagtaatgcagggcaagagaacgtgctctacttatcggtgaccaacgtcccactgtcgtcgtgtttttttttgtcttgaaattgctctgtgtgtgtgtccttgagcttttgctcagggtagaacccagagccttgtgcataatagataagtgctattcaactgagcaacatccccaaacccaaacttaagcaccatcattcattcattcattcactgtgaacatcttcacaatgtttgaaagccagtcacagtgcagagaaggaagagaaccaaatgttaaaacaatgatccttagcagaaaacagcttatgcttgacccgggacacctaagtaaatacatgcaagagcttcatgctgcaccttggaactgagttgttttggtcgctgatgcattctgggagcacacaacagttactgacacacaatagacactcatttgtccagggaatgctagagacgttcaggagagtacatgggacccagaagagtccaggatgaagatgttagccagatggagattaagacagagagaaaagagccttggcaaaatagaggtctccatcctcacctccctgtgcctcccttccctcattcaaggagaaaagcagagacctggctctgaatctaaatgtgcttccagaaatgagcccaagtgtataggttagggcctggccagagcttctgacctctgacttagctcggcttcagattacaaacttgcctattttccgtgctcctctccccccccaccccctcactctgtcttccctcaaactcccctagaataaattatctatgacatgaaagtctgtacttgtgttttgtcatgaggtttattttttgtattaattgtatttcaaaataaaggctttgttgtttacagatctttatactagcacaattttgctgtaggaaaacaagtcaacacttttgtactaagaataaaataaaaatccagccatagtttcaccgtccaaagtagtgcttggcgtttggaatgcttccattacaattcacacacactggcactcatccagttagaactggtacagactgaatcttatgttcctaagaaaaacatgagcttggacagtggtctcttgccctctatcaataactctgatggcaagacgttttggctgagaatcccaaacttgattctttaagcagctgaggctcctcagtgtaagtccttgggaaagttcagagagctttctctgagccagtgctgtttccacaccatggtatggatgcctccctaagtctatttcagagggccacaggaaagaagtgctgaactccttgctgggagggaaaggtggagaagggacctattgccccacttgtccaagggagaatccctaaagcaagtccataaccctgggtaactttttgggaagctgattttctcagcttctttaacgcttcaatataagtatgggaactcttttctgtctttagtccttgcctttcaaagacacacacacacacacacacacacagtccctgctttcagtgtaacacgtcttcatatcgaaggagcttaggtgaatagtctagagtcagacaaggggtcagagatagatttgagactggaacatcctttcagacagttaagctaaagtgctcttaggtgattcctctattcagaagcttttgagacaccctcctccctgtagactggaatggatgatgctgagtctgacaatcaaggtcctccatggcctcttgattcagctcagctcttcttcccagactgacttttcgcttcccaggatcctcttcttcactctctttcaccatgctttagagttcgcttgtcagggtgcccgagctctctgagtttctgggagatagggtgagaaaggactcactccatttctcaggctggccttgaacttaagatgtctattatggctaacattgattttgaagttgacaagatctggaatcagacattccttccgtcacatttagcatcctcagtttctagaaacattgagtcaaatgaatcccccacttcttttgattatgggacactgggtcctcaatgctgcctcagatcaccccaactcaatggtctgtggcagctcacacacaactgctttttgcaccaacaaagtccaacctggctcactgctcactccatgacctcctttcagattgtgtctttataagcaagatctaggctcctgggaggggacaggacttagtcttagtcccctctttatccttcacaactcaaacatctcactttgtccttcctccaccctctcatggcttttctttcttttttcttttctatttttaaagggttatttagttaattagcttttctttaggcaggtctcattgtagccaggtaactatgctgccaaggatgaccttgaactccgagtctcctgcttccacctcccaagctcaggattacaggtgtgcaccaccactcccagccttcatttctttttggaaatccaaatgtcctctccctgccaggcatgggatggcgggaaggccaagagctctagatggttctgatcgacagggcacttcaagaatgtgagaccagaaaattgattttgggccccggccagtaaaaatatttgtaaaaatggttggcaattaggtggggcccacccattcctagagcagataaggaggaggtgtgtggtgctgaggctgacttgaagagtcctggggaccagtgagaaagcgaaggagcattgttcgcattttccaaatgagcacatagaaagggaagtcgtgattatgtagctgttgaaaacagcatttccactcgttacctgaaacaataggcgctgggagtgtagctctgagaggcggtgatgtcatgggaatagcatgaaacaagctgcttgcagaccatgactctttgacctggggtttggtcccagctctacctctgttcttgctcactgttaaacctcgctgggctatttccttggcttagacttggtttcttcctctctgatatggcaaggtaggcagaagggtggtatgtgagcagcttgaactgtctgcttcttctaacgccctgggcatttgaggtatgtgacagagaaaagcccagatcagggaagtactcttggaaggcaagacacagacaaggtggctagagaggtgacaaagcctggtggctagagaggtgacagggcctgatccagggtagggccggtggtttgatgactgtgaagctgacatgttctgacaggaactgactgaaaaggttctaataggaactggcaggagaaggggagggggtgacaagaaggatggagatttcatttgcctctggagcccaagtgaaagtaatctcgagtcccaggtttagctctgcctgcacattaagaggtttcaagcatgtcctcgcctcccttgggatctcagtggccacatgtgtccagtgacaccacccaagtcatagaccaccacaacaagttgcaagggcttcaggttccaaattacctactagtttgcaggaaatgtctgaactctgtttgtttgtcctggcttttgattgtttgtttcattttgtttttgagttaggattctctatggtgccaaggtcctcaaagttctaaagcttacatgggaagcctagggccacggtagacgttgtactgagagccactggggaagaatagtgaggggaagccacaagtgatgctagcagaagcagacttggggacattcagaggttacacctaagggtgggcagtccctgaaaaagagcttgcttccagacccgtcaaaacttggcctatgcagtattgaaaaagcaacctttaaagatcccaggtccccaaacaatacagattggagagcagtgtgcctgcaaacccaaggcctcgtgcatgccaggcaagcgctgatgggcccacagcttgaaccctatattgaaaaagttcttcttgcacacaagaactcagctggaggtggggctttgggtttggataaatgaactctatgccctgtatccatccaagccattttttcaggtaacagtagtaagagctgacacctgataaaggtctccagcgacataattagggaacgaaacacatcatctgtattcatcaactcatttcactcttacagcaatgcacactttacagatgagatggacacagaggggccgaggacggtgtccagatcacacagctgacgagtacgaggacaggcaaagctatctccggaacagtaaagtgtgtcgctattcgcagcacctgtaactgtcaccagtagaattacagctattttcagatcacattatggctgttgcaggtatctcaaaaatcgtttgtactcatcactgtgcactttgaaattatggcagtcattagagcctttgctgaatcgtgatatattgaatatattaatcaagcagcacgcatgactacattgtaaatcgtgcttcaggagctggccatcagtttcctttctgatcctaggtcatttgcttactgcactgaaaagcatttttcctcagaaagggtcgataagcagtgccagattgccaaggctgtgtatggcatgactgggcagactctgctgctagataactgggtgctggaggctcagaggtaccacactgagcactcctccaggtccctctcctacacgaccacttttcccaaaccagtaatgacaaccactagggcacctgggctggctggagtcatgagcaaccagtggccatgctgggatggagacctaggtctgtctaagttcagtctctgcccaccgtggcttggccttctctggaaatgtagtgtccgccctccagtacagttcccgcaaccacaaatgacctacttcagaaaggagatacctgatgtgtcagtagatcacaccacctttgtagctctccagtgcatctccatagctggcatttagagcaaggtcctttcctggtaggaggggagccttaaaagcgggccagcaggggtgtgtagcccaatggctgccagcctgccgcacacttgagtccacatcccaacattgcctgtgtacacttaggcccatgttagagattcgggcttccatttccttagctattcagtgaggacaagaatgatctctcctggccgggcgtggtggcgcacacctttaatcccagcacttgggaggcagaggcaggcagatttctgagttcgaggccagcctggtctacagagtgagttccaggacagccagggctacacagaaaaaccctgtctcaggaaaaaaaaatctctccttgtgtggctctgaagaacctgagagacaatcgcagacctcccgctggacctgctccagactatagtgtatacagagccactgtctatgtcctcacagagactgatgcacggagggagcctgaggcatctggaagacctttgggagatactggcccttcctcatagctgttaacaggactcccctgctctggtttccctgatgtgttcaacagcagacacccttagcctcctgctttacacctctgcctgcaagtcagaatcagctaaggagctattttgtttcttttgtctctactgtcttcctttgagacactatcttagcacaggctggccttgaactctggatcctccttcctcagcctcctatagtgctgggactacagacataagccactacacctgtttgccgaagaagctttctttgaaaatggcctggacctcgcctccaaatcatggaattagacttggggtagggagtaagaagaaattgtttctaaaacttcttagaggaatcttaagtggagatatgtgagagtcatggactcgaaaggaaccaggcgggatgttgctttaggggacaaggaatggagtggggaatttggagcccatgccctggtactgcagacaagatgagaaggaacagaagtgtgggtgtgaagggaagctgtgtgtatgctttagggaggaggagggggacctggagcccacaatcagaaagagctggaccccaagccaggccagaccagggatctcactcactaattttctgtcagaagaaaatgggacattttaagtcaagagacagacgacactgtgtttgtagcctcctccaggtggcagatatgaggaatgttaacacatagtgaggagcattcagccctgtacccccaagtccacccacctgctccctcatacactcacatcagacaccacctttagcccaactaagcagaaagccccctgtgcatcagtgaacataagatgaccaaagcagggccgcacatggaggcaaatgccaggctgctaagggaatgtttgctaccctttgctctggcagaagattgcattaacctggaaactggacagggtgggctgatggttagctttcagtataatcagaaaggaaagtggtcaagaggagagaggcatgcatgcagtgacatggggacaaatgatagagccagaccttctggcccagtgatctttgctccaccccctttcctggtccccaactttcagctttggtccctaatctgcctgtgctgggaaaagtgaacagattcctgctacagccccgtggctctaactggccctgcaagggaggtttgagtcagcctccagctcagagcatggatcaaaagccaaggcacagagcattttaggtttcagacctgtgtgccctccactactgtttgctttagagcatcttttgccaggtgagagttgtctggctccccacccctacagggagactatgactttaagagaggagtcagaaccatggggatcggtttcaagcagccctcaaaaggcaaatctggattgagtttaggaagaaaaaagaaggggttagctttggtcctgcctcctttcccttctcgaaagcttgcccctcctccagcctacgcctggaaattcacttcttttggcctggaggttaggagcctaccagcaaccttgtcctctcacctggtccctcccctagttccagagcacaccatctggaggactgccgagctagtggctgcaatgagtaggtatgtgtctgaaatttcaactttcactttgtcaaagctgtctggggagaggtgggaagggttccagggcctccgagacccttggctataggtgggaagaagatgagtggactttgctgactccaccagcatctgtgtgttcaggcatccgtaggccgataggaaagcttcatcctgcagcctggcccatttccaccttaagttacttaccaaacccataatacgtgggagcttggcagtgtagagagctttgagctctgtgcagcaagaacactcagaaggtagatttggcttttgttattattgcatacaaggactcactatacagtccaggctagtctgtaactcaccatccatcctcctgccttctgagtgctcagattgcagacctagactaccatgccctgcagagggatttgtttttatgtaagatgttgaagtccctggaagatcagcttagctctctaggttgaagtcatgaagctcggcatctttcccctaccccagtgcagccttgagcacagtgggagcaaggtgggcaggtcctgcctttggtcttaatgcctatttcctggtcactggtcctggagcaagcttctggctctaagagttcagccttgtatgtcaaaccttagagatctgccatccttttgccaggccttttcatgtgtgtgtgtgggggggtcctagcacacactctctctctctctttctctctctccctctctctctctctctctctctctcacacacacacacacacacacacacacacacacacaccactaccactaccacccctctatgacacaacaaagttctctacaaccaaatgaccacttaagaatcagcattctcagctgcaccactctctgggcactcttgggcagccatgctcccagctagcatgccttctgtccaagtggtaccaactcaattcagtcgcaggaaccaagttctcagatgctcctggcagctatatatcctgacaatacttggcccatatagaattctgatgggctgtccaggggtcttgctttacccctagtgaccagagacactggattggtaccttctatatggccggactctggaggaacctgttgttcccagcagaggactttgggagtcctccttagttgctgagatacttactgttcaagagccaggctccagtctctttcaggagagactgctgtcagatgagatgtacctgctttggtgccaacagcaacagcatctattatgtccttatcaggtcatcttgggacactggaggctaccaattctttttttattctgaagcaggctgggtgtacagggaaaggcagagtagggatgtggagaaacagccctcgtagaagaattggctgccatattggggagtcagtgtacgcccagacacatgagcaatgggcaccaacagggatctcaatgtcacttggctacaaggttatttctgagcctggaaaagagtggggaattgtatgttgcttgccaaggctagggggttgctgtgtttgattatccttgcatgccttccatctcactgtggctgttcatgagctctggggatgggatgtcactaagatgagccctctacttccttcagggaagcctatgatgcccacttcatggtggccttgggacttatcaatccttttcagaataaaacagcatcccaagcaaagggctcagctgcacagcaagaagatgggggcagggaaagtaagacttcacatcaggaaggttggatgtctgcctgtgtcctagagatcattagagaagctgagtgttttcatagttcagtcaaaatcgtgtgtgtgtgtgcgtctgtgtgtgtgtgctgtactcattttgttgcctttttgtacccaactttgtttgtttgaggaaagctaaaggtttcatagactgttgttttttcaatgtggaaaaaggcaccccttcgatgtaaagctgagtaattccagtaaaaggatccaagtgaatgaggcttctgcccaagtatgggaaaatatccatccatctctccccttaattagaaaaatggccttccaagtagtgagtcatgctgcccgctagcaaattgctccatccctagccagtgtcccagggacaacagaggtgagagatggcagtggctatgacacagaaaagacatgagaagggacttgcatccctgatgccagcagctctgtggcctagtgttgtctgctcctctgccaaaaataattcatttgcctagctgcagcatccggaatgttgatcctgtctgagttcacccgtgcattctgctaagtgtggtgttgcaaggggcacgtggaatcagccacagctctttgcataatctgggctttttttttttttttttgaggaaagtatagacatcgaaaagtgtaaagcacactggatggtaaaggtacagccagtgagcttccccatatgtgggcatatgtgtgtaactaccacccagtgcaagatacagggagggtttgtacaatcagaaggctcccttttgccccttccatccaggatctctctctttacatgtattgaaattcagtattggtaattggtgttgtgctgggaaatataagaagccgttctggggtgtgtgtgtgtgtgtgtgtgttgggcggggggtgccctgcctgtggtgtttcccaactctttatggtgtaaacattcccaccacagctggtttcaagctaccaacagcttgacaactggctcaaaaaatcctggaaaatgggagcagatgcagagatccgccagctaaagaccaagcgaagccaagagaacctcacaaaagagggagaggaaggattctagtaaccagagaggacaccattagaacacaacccacagaatcaactaagcaggcctcataggggctcacagaggctgaagagacagtcacggagcctgtatgggtctgacctaggtcctttgtatgtactttatggttgtttacctcatgggcttttgtgggactcctaacaatgggaatggagagtatttctgatttttttgcctccacttaggactcttttcctcctactggactgccttgtccagacttgaatgagagttgtgcctagtcttattgtaatttgttatgccaagttgggttaatattgctcattttaaaaaaggaaaacagagaaggagtgattttggaggaaagatagattgattgatagatagattaattgttttttttaatctgaaaaattaagttaagttctgatgagtccgagcaagctgactgtttgcaaagagggatcaaagaggttaagtccaattatgtacccagtacagcctagttggctacagtaagggggctccccatactctcagcctctttattaggtaaacaattgtccacaggatttagaattattaccaaattcattaatctacacaaatgactctagagtcacaaacatgaccaaattgttgtggcttcgttactcaagatgctatacgcttagaagattgccgtcttagttactttctctgcagctgtgacaaaatatcttgacaatagcaactttaaaaggaagggtttatttgagctcacagtttaagggtataatccttcatggtggggaagtcaagatagtattcaaaccaaggtagaattcaaaacatctgaatgttgaggcttaggaataaaagaacaatgaatgctaattctcagcccaccttctacttttttaaatacagtacaggatctcagcccagggaataatgctgcccacagtgggcaggtcttcccagctcattttatctaatcaaaataaaccctcacagacataccaatatattcatctttcaggtgtttctaaatgtcattaagttgacaactaagattaaccttcacaaaggagcggccaggaaatcacatagcagtccattcttattggggaatgtattccacaactccctgtgggtgactgaaatttcggatggtagtgaatctcggagaaaccactttcttgagttttcactagtcctacatgcattctgaacatgaagatacatttgattccaaacattttcatcacatttatccatttctacaggcatcaccatggttgagatgctgagctgtccattaccactaagaacttccccactaccaataaaatctctcccatactatctcttggtatttgcacctatttaatttgtttgggctcatggcttaaagggatatagtccgccatgctgagaaggctttatgagaggagtttgctcaattcagggtgggtagggaagcagagacaaggcatgaagcagaaccaagctataaatttcaagactcaccctccagtgacccacttcttccagagagaccctacctcctaaagcttaacttacaaaacagtgccaccagctagggatcaagtagcgttcaaatatgcagtactatagggatatctcacactgagatcatagtagtctaccctttagctttagaggcttgtggtcaactcaaaatgcaagatatattcaacccaactttaaaaatctccatagttttacacttcatacactgttcaaaagtccatacatagcttcttctgagactcgaagtagttttttaactgtaagatactataaaatcaaaaaccaagtatcaaacttgcaacatataatggcacagggtaagtaagcaccttcattccaaaagggaggaacagttgttgcatctagcagtcatttgatcctttcatgactgagcctgtgaccggaatgtatgtattcattttagcaacgcacctgtggaaggacagctgggttgatttcaatgtagggacaatatgagataaagctactctgagcactcataaaatgggtttgtgtacgaatatgtattcattcttctggacaagtgcccaagagttcatttgctgaattgtatgacaattacattcttagtattttaatagccacactctattccagcatgttccctctcacgttctccacaacaatggatggctgatttggtttcttgacatcctcgtcaacactttgtgtgatcactggccattctgatagatatgtagtgatacacatgatggccttcacttacatttccttggtcgctgatgactttgtaaacattttcatcttttgtgtacatttgtcatctatacaccttcttcaatggaatgcctgttatgatttttgtccattttctaactgaatggtttgtttgtatttgtttagttttagagacaaagtctcactatatactcttgctgccctggaactctctctttctctctctctgaagatcaggatgagcttaaactcacagagatccacctgcctcggcctccccagggctaaaatttgtttggcttttgcaataatgagctttgagaggtagttactattgctttgttggattgcagtttgctttctcctactctgtttttgtttttattgtatttattttatttcacatgtacggatgttttgctagcatgtatgtctgtacaccacatgtatgtcttgtgctcgtgggaaccagaagagtgtcagatcccctggagctacagatggcagagagttgccacttgggtgctaggaattgaatctgggtctctgcaaaagcagtcagtgctcttgagtgctcagcccttgaatacatggtgcggtggcccccaaccacaaaactattttcatcggtgcttcataactgaaattttgctactactatgaatcataatgtaaatatttttggagacagatgtttgtcaaaagggttacaactcaaaagttggtatcacttctctagccccttccagtataaactcatcttttcattctctttatatatgcaaaagaattaattttgaggttcagttaatcagttttttctcttatgggtcatctttcccttgcaagtcaaaaaaatcttggcttaactctacattccaaagatttgtcttatgtttacatttggcttatatttttcagttgatttttttctttccctttctttttcttttttctagttccaggagttaaaacccacgcatggccttgactatgccagatatgctttatcacagggctgtatctctgatgctttttatttttattttgtcttacaaagtttccgaggttggactcaaagttgtgatcctcctgcctcagcttcctgatagctaccatgcctagtggagttccttttttctctgaggcatgaagtaagtttaggtcaagcctctccttttgcccatgcatacagattgaatttggcacagtctgttaaatagatggttatccttctgtactggctagttttgtgtcaacttgacacagctggagttatcacagagaaaggaccttcagttgaggaaatgcctccatgagatccaactgtaaggcattttctcaattagtgatcaagggagaaaggccccttgtgggtgggaccatctctgggctggtagtcttgggttctataagagagcaggctgagcaagccaggggaggcaagccagtaaagaacatccctctatggcctctgcatcagctcctgttccctgtcctgcttgagttccagtcctgacttcctttggtgatgaacagcagtatggaagtgtaagccaaataaaccctttcctccccaacttgcttcttggtcatgatgtttgtgcaggaatagaaaccctgactaagacaaattggtaccagcagagtggggtattcctgtgacaacctgaccatgttttggggaggactgtggaaggactttgaaactttgggcttgaagatccatctgttgttaagagctctgtcagatgttgtgtaggagcttggaagataatgttgagaatactgcagaagatggaggtctggtttgtgaaatttcagagggaaaattaaagactcttttcagggccattgctgttttaattgtgaagattctgtagttctggttagctggggctgaagaatcagctgtgattaacaagataccagaactaccaaagcaaaaactttgcattactgggactattgatgctggttagctggagctaagaaattagcggtgattaagaagagaccagcatcattgaggtgacatcttctgggaagtgttttctgaaagcacaaagaggctgtgttccagagatagccaaggttgtactcctgctgcagcgggacttggtaatatgtaagggtcacccaggtggtactggttttgaaggcatgaaggggtcacgcaaagcagctgaggctcagcactgtgagaggccatggaaggccattggtgaaggtgcagcctcagttgcaattgaaggcccaggactgaaggggtcatgcagtgttttggagatgccagtaccatgagatgaccaccaagagcagcagcagcagtagagtacaggcatctggagcctagaggatgacgtgtgtgctacaaagggcatggctggagaagtgacccaagcccttggaggagcccagaagatcgtgagttggatcccagacattggacggttggagattgatttttgcttttgattgtgactgtgccctgatattttccctcttgaaggaagaaactgttttagtggagcccacagttaagagacttttaattgtaaaaagactttggattttaaaagagatggatattttaaagagattgaaattttaagaatatgtaaagactgtgggacttttaaagttatttagatcttggggatgaataagattgtaagggttgaggcttactagtgatgtttgtgtgtgtcaagttgacaaggggtcaagtgtactggctagttttgtgtcaacttgacacagctggagttatcacagagaaaggaccttcagttgaggaaatgcctccatgagatccaactgtaaggcattttctcaattagtgatcaagggggaaaggccccttgtgggtgggaccatctctgggctggtagtcttgggttctataagagagcaggctgagcaagccaggggaagcaagccagtaaagaacatacctccatggcctctgcatcagctcctgctttctgacctgcttgagttccagtcctgacttccttggtgataaacagcaatgtggaagagtaagctgaataaaccctttcctccccaacttgcttcttggtcatgatgtttgtgcaggaatagaaaccctgactaagacaccttccatcaaatcatttttgcaacttagtcaaaaataagtcaggaatagtttgtggctacattccttgataggaattgcattaaacctataaacataatttgtagcaattcatgtctttgtgtgttgagtccatgaacttaatgtgtctttttgtttatttatgccttctttgctttctttcctaagcatcaaatgtcgtttagcaaacgaacattctctgaaatagcaaaatgaacattctctgaaggaattttttgagacagagtctcatgcatccaggctggcctggatagatgagaatgaccttgaccttgacctctgacctgcctcaacctcccaagtgctggaatgacaggtgcacaaccatccctgagtcatgcagtgctagggactgtaagtcatcgttataagcacgatcttttctttggagtagttgtaaatggtactaggtgtttttaagttagcccccacatggttaatacaggtgtagaaacgcagttgtctttctgtgttagctgataaaaatccaactttactgaactcatttttttttgtagttctaagggtttttgtatgaattacttggaattttctatgtcaataattatactaactcaaaatagggatcctgtttttcattttcaacatatattccctttattcttcgtaattgcatagcaaggctttctaatattgtgtcagtgtggtgagagtcaggccagggatgtagctcgaaggtggagcattcagttactaatcatgaagccctggaattggtccatggcactgaaaacctgaaatgtaagcaaaggcattcttgccttgtttctgttctcctggaacagactagaggcagtgagggaatgaagaaaagacagatgcacagacacatggacagggaaggtggcatcagatgggggtctactactgccacgaccccaaaactgcctgcttactatgcttagcaccaggtgaagggtggaagtgtgaagtatgggaaggattggctcttctcagtaggaggtctctgtaggtgagcagtgtccagctgtaaacatctgggagaggaaagctgtagttgctagtgcttgtacacactgatcaacagtgcagaaacattcatgcttggattccagaggaaagctctgctttccttctgagcttctgagtaaggcttctccactttcatgaggccttagagcccttctcatgactgtgcccatgttaacaacacatattcactcaggacttactctgcttcccacagtttctgatctccattaacaccattaaattcatgttaactgtaggtgtgagtgtgagtgagtgtgtttgcaagtgagtgtgtgtgcgtatgtggacaagcacacaagtgtgtccatgtatggtgggttgttttttttttaagatttattttatgtatatgagtatcttcagatacaccagaagcaggcatcagatcccattacagatggttgtgagccaccatgtggttgctgggaattgaactcaggacctctggaagaacagtcggtgctcttaacttctgagccatctctccagccccctatggtggtttttaattcaaccatcaaacatactgtagaaaatgcaggtagagagacaacgttgtatttatttgcccagttttttgcttatcatacccttcttccttcccagttttcctttttgtttagagaactttatctagctattatttcagactaagttttttttatatagattttttaaaatatacatttcaaatgctatcccgaaagttccctataccctccccctgccctgctcccctacccacccacttctgcttcttggccctggcattcccctgtactggggcatataatctttgtaagaccaatgggcctctctttgcagtgatggccgactaggccatcttctgctacatatgcagctagagacatgagctccgggggtactggttagttcgtattgttgttccacttatagggttgcagaccccttcagcttcttgggtgctttctctagcttctccagactaggtttttttattgaccaattttctgaaggatattctcactcggtataaaactgaattgggtgtggtggctctgctgatagaaaccccaaatcttttgttagttttgtgccagttggtaatgttctgcgtatgtttcgagctcttccctctgtgcttcacattctatcatttctatggctctatcttgaagttcattttctctgtcgtacgatactctttctattgagcctatccattgcatttttaatttttgccattaaagttttcagttctatcattcccattgtgtcctcccctccctcctactttccctcctctctcataccttctctctttgcttctggatgctggggatagaacccagggattgacacatggctagacaagtgctccttctgctgagccaccctaacctctcattagtgttttggggatttttttaaatcttccattactttgataggcttttccacttttttttcaagaagtattaactaaagcattttgtgatgactgtattaaaattgttgcctgataattcatacatttcaagtttcagtgttggctcaagtagtggccccagtggtggcagcacatgcccactccctctttggtctcactctgactttccttaggtaaggaatgagaggtaccaggctgtagaacattcagagagccactcacagccagcgttttgtccagctttgtgccagcagggctccccgttcaatcacagctagtgccaccgggaaagaaagggccaacttattactggatagaaggctgcacaatgctgaccaaccctttaacacagaatccaaatccaaagctcaaagatgaccattagggttcggcatactggtgactgtccacaatcccagcactgtgtaggcaaagggctgccatgagtttgaagtcagcttggactacatagtgagttctaggctagcctgagttatagagtaagacctctcaaaaaccaaaccccaattcccattctatttgtcagcagagaacttgtatttccaaatgcaaggcacaggaacttgggatctaaatacactgcttgtccttgaacaagtcattcggcttatctacaccctaagtgcttccttacagagtggcatgagagtggcagctcctttccagagctggcagaagcttgtgtggccatgctctgcaatagcctctgcccgtgcctgctgcagcaggccctgagtgatgggcaagaggctaaaatactcaggggcagccataaatggcttcctgccaagcttcaaaattataaatgctttcaaatggatagcaaagtagggagaaaaatgtcatagcgaaacattttgccacatttgctaaagatcttttctaagaaacagcttattacagatccagctgtgagccccaccccatctcagaagtaatcagtagcccaaattagttgtttctaacctcaatgtctatgtttctcatttctcccccctctctctcccctaatgtagaatatcatcttgtatgtcttgtaactttatataaatggcattacattgtgtttgtatattcttctgtaactttatgtttatgctttgtcgatttatccatgcagacacatattataaaatgaatattctattaaaatgcttctgaatgctgttctgtagcacagtgtgtgcactctcaggtcagggtgtggctggttggtacaacccttgcctagtgcacagtccccagccctgataaaagacaacaatcaataataacacattgtctagttcttagacatttaggtttcctctcattcttccaccacgtacctgcaatggtaatatgaactgccctttgtacaggtctacaacttcaagttcagtcaagtttagtagcaggttcacttccaaccaacaatccctacttggtgcctgtgaaacatttcagaaagacctgcttgtggtctggcctcttttggctgggtgggggctagttacatcaggccagctgggaccagtatgaagctagcatgggtactcagggctcctccagaaaggccacacacagttaggactcacatctgcatcttctttgcccagtctcaaccttggtctcatctcactgtggttttattgaaattcctcttgttcctgtcactttcacatccaccctcggcaatatatcagaccccctcagagtcctgtcagtctccatgaggaagcctgcagccctgggcactatgaatgaagagtggctggctgcagctgagctcagctgacccacagatggccttcagtagaggactggagagttgcttttcctttcaggggaatgtatcctaatctttccttgcgggggtagccgaagaaatggaagccgagtgggaacgtacatcctctgctctggtttctgtttgggattcttgttgctgtttttgttttgtgctagagatgtgttcggtcattgagtgccacccccagccctatattgacagattttacttgccatccactgccccatgcatgatctcttagacttacaaagtaccagaaaggacactagttaattgtccacagtaagtcacttagcctacaggtacccaccttctttagtccccattcacactcagcaaagaggtatttttaggtttgtatgatgacgcccagagaaggtcacttgcccttaatcctagacctaggaagtactggaggcagttttgcatcccagagttacattcatgggatggcccttggagcactcctatcccaaagtaaaattcaagtgtcactctgcaaggtcgaacatgcttcattcttcactttcctgaacatcccataaatctttttttaaaaagataatacccatgattttgctcttaagatgggccttagtcattcctggatctttatctcttagctcaggtcctctgtgacccataaaggggttgcttggatgcttgttgactaaaggatgaaatgactgtgagtacaccgttgctatcctcagatacaccagaagagggcactggatcccattacagatggttgtgaatcaccatgtggttactgggaatttaactgagaacctctggaagagcagtcagtgctctcaaatctctctaaccccatggatactatctaagttgctgatctactgctatgaagagacaccatgaccatagcaactctcctaaaaaaggggggggggtatttaatttgggccttgcttacagattcacaggattaatcaaaccactacacatataaatatgccattgtaacatagtaggtaagagacagacagtgatggactattattgaacaggtgatctgtgacacagaaacatcttaaagggaaggatttctttgggcccacagttgaggttttggtgcatcacaagtacagagtcctgagcaaagaatgcaggagagaaggcccgagagagggaatgtgactcagtccagtggccactgttgacatggaaagatagatcttgtgatgtttaatcttcattgtaaacctaactagatttagaatcacctaggcgacacgcctctaaatgtatctgtggaggcattttccagagaggtttaactgagtagggaacatctacccttaaagttggtggtgccatcctatgggcctagacttcataacaagaggaaaaagcaaaaacctgacacatgccctgccattcaagtctctctgctctctgttctatccagatgtgatcaaagtccctctgccacatctgtgagctgttcttgctatactatgccttccctgccatgatggactgtaacccgtccaatcattagccaaagtaaatcttccttcctttaagttatttttaatcagatatttggtcacagcaataagaagtgtaactaatacaggccagactgcatactgtttctttactttgagtctccccccgccccccccccccccgccagatggatttttctgtatagccctggctgtcctggaactcactctgtagaccaggctgtccctgaactcatcgattcacctgcctctgccttctgagtgctaggattaaaggtgtgtgccgccactccctaccctacttcattttttaacctggttacactttaaacccctttatataaccaatttattagcacctaccatcctaaatcaaaattcttaggtaaataaaccaccccatacatgcatgcgacttcaccctgaagacaatgggatctttgcaaactcacctaggtaaatcttcaaaaatttttcagtaggtcctttttagaaggattgggcagctgtttatttttttttcctttggaatttatttttaaactccatattttattcccctcatccatcctccaactgttccacatcccatacctcctccccacccttgtctccaggaggatgtccccagaagattgaagtcacacagtaagcaatagagctgagattctaaccctccagcctcactttcattacacagtgcttcctcagaaacaactagggttcaaacccaggggtttgccatgccagagcaatcctgtcaggctgagctaaattcccagaccctttttatttgttcattctagttttgttactgttgatgatggcagtggtatttgagacagagtctcagtatgtagcccaggctggccttgggctaccacagcctcctgagcactggggttgtatttgaatgccatcaccaccagctcagaaacattttttctaatgtatccattttctcagaggctcctatgcctcagtacttccatgaccttctcttggctattgtggtccctggcccttttaggccacacatagttggttattttggcaaatatttactctccattccacctagggtctacattcttaagccctgctgctcttccaggcaaatggaaattcaattagtttctttcttagtaaaagctctacaagtacaataaactgagaaagctgtgcagaaatcaacttggacctctccttgcaccccactgttctatttgttctgcccacacttagctggccttcctttgtgtcacacactcaccatgtggcgtggggttgacagagatgaatggcccccaacctctgcccttaaggagctaccaagttaattaggcagctggtaggagcgagctgataatgtggtgagtgctgggattggggagcacagccagtggagagaaaacagaacagtcctaagcccagtggactgagacttatggcgagactgcttcatgatgggggaagtgacttaaaattcacacctttaatcccagcactcaggaggtacaggcaggcagatctctgtgagtttgaggccagcctgctctacatacggagttccaggacagacagagatacataatgagatcctgtatcaacaccccccccaaaaaaaagaaagatatgggactatgtgttttagaacatgttaacaggagaggtcatcttgcctttttggattttcacatgcttagggctctctcaaaacaagaaaccaggatgtgggtgagctcagtgaacccagtttccatgtatttctgtatttccagcctagttggtgatggggagagttctattctctaaataagagccgtgggctccctcagcatgagcatccactggtgtacctgctagattgccagattggacctcatatggttgggtccccagaaaacaccagattgcataagaaaagtgagccaaagaaatgtcctaactgatgtggccctggtggcacagtgtgctggaaactcctatatgcagataggaagtgttaatggtctatggtgcacttagggggtttgttgggtagggatcagtaggatctagtaaattccccaccttccagcataaaataggtgctgaaattaaattatagtcattccatggcatgagagtccatctgtataaaatatcaagagccagatatgtaggaagaaaactcaagtgtaatttgatacagatggcattatctggagagcacggcataatctttgcaataggtaaacaggtcatcgtctatatacaggacacatctagcctgtgggaataaggggagtccccaaactgaaaggtgggctttcaggagccccagatgtcacctaaggctcaagactggatgtacatcctttgtagagtggggatggtcaaggaacaaaggaccttgacccacgtgctggtcaggatggctgaatctttgtgcaagagtaaagaaggcactgtgggatctacgggcctcaactggctttttgtctctacatatagcactcaaggcggctggttatattcactacttgtctcattgatgcagctggatactgggcaagaagcaacttaagagagacggggcttcttttggctcatggttcgagagtgtatcgtggagggaaaggcctgatagtgagagcacgaggaagctgctcatatcagttcagcagtcacaagtaaagaggagggggggaagagaagaaaagcatctgcgcacaacatccccctcctctttacttgtgaccttggatgagtcatgtaacctgtctgcctcttggctttcccatctgcacgcccttgatgatagcgagaacattaccaaattggtaatgatgtttgggctgaaacggaaaaagacatatgctagtgagtagccggtgcctggtgcaggcttgcctgtttatttgctacgtctcaatcctcctctgagccagcaacaggggcttggtctgtatcacagacaccaaggagcaggaacaccatgccaaggtgatccccgcacctttgctctgcatgctctctccttgaaatgcccctggagcataatttttagctcaggatttgggagcagaatccagatggctctgccagtttattagcaccagcaggctctcaagtttaataagctttctgcatttgctagcactggaaaaagatggcctggaccagattccttcgtgataagaaacactgccagcttgcatccacactggccaagtgctgtgggatgcctctcacagcagccctcaggaggcacagccagtcctttgctctctgctttgaacactgaagatttacaaagtgtaaactttctgccactttccagtatttggccgggtccattcttcttctatgtatgtagaattaccttccagctgttcacaatttcaagatggatttgtccagtccagagccattcaatactcgtggaggaggacaggctgccagccgttgtcgaagagactgtctttttacctatcagataaggttgagggcaggaccagcagcaaagacagtccgatcaccttaaaaggttaggaatgcaggacccagggagtttcaagaattgaccaatgaaagtgcttagcaacatcccatgaccaatagtgggtgagcccctctgttgccatgaagcatccttgattctcattggtcatgaacagagacttcttcctgaaagtggtagggtgggggagggaaggagggggggcagtgcttactgctctgtctaggtggtttttacctgtcattgaaggggcttatcctgtgtccctggaacttgccaattctccgtgacatcagaaaactaaagcagttgaacagacttttgtaaacgcaaattgtgtggcctgcagacctgtggtcagagcattgtgcaaaaagacatgtatggccattttaaatccctagagaagaaaaagttcgttttagatggtagcctttgtttgatctgggcctgttgcagtccagacggtacaagcccttcttcccgcttaactaggcccaactcttggaaaatgtgaaccaaccctgataggtcatagttccctaatgcccgcggtccaaggagcactgcaaacagtgtccactgctgtgagggttgatttccatgttcatctcgactggatttaaaaacatctcagacattaataaggagacacgtgtgcttctgagggcatttctagaaaagtttaattgaaaaaggaagctccatcctggtcacacatgtattaatggcagagttgagattaaaagccctagggaagctgggggcagaattcagccatacaacatttccccagtgcactcattcacacacatgcacacacacacacacacatacacacacacacacacacacacacagagagagagagagagagagagagagagagagattatttcaccaaaattgaaatgtaatgcatgtgcacgaggttgtaaagttgaaatgtgatcttggttttggttaccccagccccccatctcacttctgtgtcctctttgctcaccatcctgagaccatgccaggaactctcacatttcctccaagggtctgtccctctcctctgttaggctttctttctcagtggtttttggcaaggagaagggagctggtgtttatcagttatacataggctgtccataaatggtccctgtgaggccaccaaaactagggagagaattgctctgcccgatttccaggacctgtacgctctcaggaagcaatgactatggtcacagcatgaaatgttttaagaatgggacatttgccagcagctcttggatgacataggagtcaatcactccggggcctttcttaaggtctatatcctagtcaccagtaccaagaccagtgccatggaagattgtttagctcaatatttgtccctgaagactgggttcagggagtccaggaggccatcccagatttctcacagctgtcatgagactcagcatgcggggcagggaatggaaaaatgtgttcttcacactatggtgcaaggtggtggtgccagggccaactcctagtgccagcagcccttgggacagcttggttcatttacatcagtacaagagcaaataggcttaagggaaataagggggaagccaagtgtgtcaggaatcaaggccaccaactgcctaacaaaggactctgctccgggggcttcaaaagtcaatttttggagggtccccattgtgggacaaatcctgttgtcacagatattcaaattggctgtccatactgattcgttgtctttgtacctcatattcatgatgacaggtgacatttattgagcatctgctgtatgacaggtaccaagctaaacacatatttgattaactcagtcctcatgacaaccctattagagagatataattttctcttcatgatacagatgcaaaagcagatgctcagattaagtgagtttgaggccagcctggtctacatagtgagtttcaggacagtcagggcaccatgttgaaaccctatctcaaaaaaggagggcagctgccatctcaagtaaaagagggtcaggaagggtaggctaagtaactttgttgggattgtgcacagtgacagagctcctgtccataggccactaatattcttgaagtctccaaactttgctgcttgaaaaaggttgataaagataccagcaagaatcctgtggaggtacagttgttgcatccccacaatttaccatacatggacatgcccaggagctctgctataggaagagggggttttctccatagtaccacagaaatgtcatgagcatttcctttaggtaacaccaggaggcgcagcagcctgtttctggcctgtggcttcttgtcttttccccttgacttgcttgggaagggtacgaaagcttgagcattcctaactgaggtgtagaatacacagtctttgtacatagggtaatagaatacactggagaactaatggctctctgttggctctgtagatcttcctgccagagaaagtcctgctgtggtcagggcaaggtggacttgcaggagttgggaaccagagacagcaaccaagacaatagcagtgtccccaataggtggttgtcagctgctaaatgatgggagactagaaagaacctaactgttcagaatgctagtcttggtgtcagagctgctgtgtagggttgtgcaagctaccccctgcaagggcacctgagtcaatgggagctgagatgaagcccagggtccagtagtcctatgtcctgaggatgctttgttctaattctctcaaaagcatctatcgcatgtctctaggatatgcagtggaggccagatcccatcccttccttattaactctgatgtccattttgcttacctaaaccccattctcaacacctctttgtctctgtacagactttgtgttgcttgagccttcaggctcattgaagctcacttctctactgtcccatatccctttctcctgccaatctttctatcctagaccccagaccccagaccccagaccccagttcccagcccctacctcaggtagaggtaggaattctctagaaacatgaatacctgctttggcacatctgaaatttttactccatgaacaaccaagatatagacatggagctgggacactcaggtgtcctcccttcccctcaggccattcactgtcctctttcagtcactgggcttgtgtgtactaagcacctgcatggttctcttctgggcacaaggccattaacaaaaccagaacaactaaatcttcccggagcttcaggtatagttctagcaataccccctccccttgattccaccatccttctttcttgctcaagtaccatggaagcccccctcttcctccctttcagaagcatcccccccccaaaaaaaagctggaccttgctgctttggcctcggtgccaggacccctggtattccatgtggggaatacatgtgtaaattttgcttttgtatcctggcctggcaagagccatagggcactgtgctcttcctggggtagctttcatgcacttgttttctcaattgagtcggcaaaggcaggtcagtggaactgtggctgagagctcaacctctgagatacggcattcattaagacctgtgtagtcagtcattttttcctattattcttcctacttccttacttccgtaaaagacatggacttggggctcgagagaagcttcagtggccaagagcgcctgttgcttttgcagaggacctgggttcagttcctagccctcacatgatagctcacaaccatcagtaactccagttttaggggagcccacaccggtcttatgatctccttgggcaccagggaaacgctcatacacatacaataaaataaataaatcttttaaaaaatgttttttaagagctatggttttgggctggagagatggatcagcagttaagaggtcctgagttcaattcccagcacatggtggctcaggcatccaatgccctcttctggtgtgtctgaagagagcgacattgtactcacatacataaaataaatctttttttaaagtgaaaataaaagaggcatggtcatatttgttacatgggataatggccagttctctgtctttcatctttcctttttcttttctttgtttttccttagaatatgccaagagaaaagtgaaaagatgaccacacccaacatgaacaagtattaacatgtgttgtttgcctgtgatgttgcagtgctgtgcatttaaaccggggaccttgtgcatgccctgaaagctccaccaaccaagctcctccctcagcctgcccatgatattttctagcaaaacaaaacattctgggtactgacatcctgcactctcctcccatcggtggaatgtcctagatactgccaggccctgtgatccacctcctagccagttctctcctgtctggctttcccccacaccaccaggtcactgttgtttcagatttcccccagcacagcacgtccagatctagttccccagctggtgttaagacctctgcaggattggtccaggcaaactgccagtatcacctcccctgccccaggacacagtcaggaagtcccagctctttccagtgggcctctgactatggtcgcctcccgttatcacctttgtgcgtctttggtcacacctagtcacgttctttccctcccacccaagaagaccactggatttccaagccttgcctcaatgatactttatcttgacaccatccagacaagctcattctatgctctcttcctttcttactggtcctcaggcttctacaaaccagatgcaaagcctcttgactcaaatttgaaaagcagctttagccaacatgggtctcattttctcttgtgaatgaccatgcctccaacaaaggaaacaatgtctgctccatgcctgcttggttagatgttgagcagctgctcagccaggtgagggtgctgcagtgtgacacttcagatgggaagggaggagagaatgtgtgcttggctagcagcctctgaggaggctggcccctaaaagcctctgaggtacatagaactggagcggctagatagtccctcacagtttctgtctcctgcacccagcaccaagtagaggtgagaatgagcttgctgtatggcaggcaaagcactggaagactggaaactgaggaaagaaagccatgtcttagctagagcacaaagatgctgggagtagcctgtgatctctaggcttcagagtagcctgggaggtcccaggatttttggaaaaggggagggtcttggctgctagagatagtctgtggaggggagggaggaaaggggaatgtgcacagggtcttagctgcatggcagccctctgactcttttcctttcgggccactagacccctgtccctcagccattccttgggaatataggatgccctgacctaacctaaccagctggggctcctgcccagaggctttcaggcctgttgtttcctgtctgtgcagaagggaggcccccctccaggttgcaaatggaaaaggcaggcagggcttcttccaagctatcattctgtctggttctggcattgagctggcctaacaaggatggaacccccccatggcctctccctagacatttcctaacaggcagcagctctgagagagaagcatttctctcttattagcacctgttgaaggggcctgcctctcaagaggaggcttgatttttatgtacaaagtcccaagctacagagatgtgatgagatcctgtttctgactgtttcctgcctggtgggggaagggaagggaagggagagtatccctccactttaggattggaggggagccattgtctagaccatataaagtctatgattttacagtggtattgctgagggcagtggcaacattcagagtcacaaccaaacctgagggggtggtggctacttttttctatctgacacttaagagtcagaagcaggctgggcggtggtggcacacgcttttaatcccaacacttgggggggcaggtggatttctgagttcaaggccagcctggtctacagagtgagttccaggacagccagggctacacagagaaaccagagaaaccgtgtctcgggagaaaaaaaacaaaacagaacaaaacaaaaaaagagtcagaagcaagaggatctctgtaagtttgaggccagtttagtctacctatccggttccagcaggccagggcttacatagtgatatcctgtctcaaaaccaaccaaccaaatcagaatcatagccaagtggagctgaaacagtgcttgcgagatcctccccactcccctttaccttccttcacttccggttcctatgctcatcccaattcatatactcctatagaaccttcaaagcccattcctaagctgtttcttttataacatgcagagcacgcaaactccaacagggcctggagaccctttgtagtaagtgcctctgcttatttgaggggactcttctctatcgtcaactcactgagagtcaagaaattaatagtccttcctagtaactgcagccatacagacaaggtctgtctctccttgtcagaataagagcttgagacagacaactatctacaaggtgcttctcctgagcctttgagagggtgcaccatggagaattcgtgtgagcaaaaacagcagtaaaggacttcttggcgtggcctcattgagcctctgcttaccttagttcagactatgcagtaagtatcaggggttggggaatctggtgattctgcagtcctcttcccaaggacatgctgggatgaagtcaaatatttctctatgcactgtgtgttaccagagttccctacctgcccatgtcaatggcggcttctggtgccattttatagtctattctatagcgattgtttttacatcagtagaataagattcctaagcccctccccaccccaccccacccccagattgcaacttcccaatagaacaacaagaacatttgcacactctttctctccagggcttcttttcttggtggggagaactgggtatggatgtaaagccctcctgcaatgctaggcaagtgctctaccactgagctgtagccctagcctccagtaactttagcaggagcctgagctgatccgcctgcagttcctaacagcttccctttcaaaggacaaagggactcttctgatctctcggcgctatttttatttttttgtactttgaaaaataaaatgtatttttttccttttttgtcatagagatcattgcttaaagctctttgtgtagtaaaggtagtaatcctttctgtcctcggctgcagacattctctcctagcttgctactgtgatttctagggtattgtatgttgggggtgtgttaacttttttaaaagatgatatcgcatatggtaacattttcctttgtgattcttatgctgagaagtctaagccttctcccagattggagaagtactcctgtgtaatctcctagagtgtggaaggtgatgtcacatgtgtcgtagagtgtttcttttctaacttccaggcatccctccccacccctcgcttaccacaacctttctttggaggcacaaatcaatcaattggattggagtctcaaatatgctaatgaggtcaacccctttcccccccccccagctctttcagcccctttgaaaagggaaagcttgagggaggtacttctcccagtgggctgtctcattagcaggagcaaagaaggaacaaagtgcaaaggaacttccaccccatctcccctccttttatctctcttaggcaagtttagtgagatccaaacccagagctcccagttaatggaaggtcctgggactctaaccgatcagactccagcaaagtcacgaggccagtagccagagttcccccagcaaccgccaggccaggccactgcatcttctccatccagccagcacggttaccatgggaacatgagtgctaaattgcttttcgagtatagaagctgaagacctcagctttgacgcacatagcccaaaaattgattgacctccaattaggtttttgttgttttcttaaggcatctttctgttttcgtcttgcccatacgcctcctgaggtctgcatcagagactcaaatatttggctccgtttgctaaaaaagaaaaaatatatatataccttgacttatttaaaaaaaggatttaatgtggcttatgaagatgcacccaatacttggacccaaaatttgatgcaagaggaggatggagcaaagagtaaacaaggatgagttgaaaagaagtagtaagagactggatgtcaggaagtccctgcgtgataaatgagagtcccaaaggtagctcttaggctttcatgggagataacgaaaatgggcagcagaatcgttacaagattcacagataaaaacaaatcaactgattaatagaagctcaagtgctcctaaccttgaaacaaaaagtttgctttcctcctgtagactctaaaaagtgatgtcatgtttctccccctgtacccagcagattacttaaaccaattccaagtgtagactaacttctgtagatggtttggtttccaaacttcttcacttttattattgttgttgataaataataaacgcacatttctggtaatgtcaaaagggaagaatacaatgcagcctttacaatgagttgagcaaagctgtggagatatctcagtcgctaaagtgcttgccatgcaactgtgaggacctaagttggatactcagcacctgcttagacctgtatgtagtgatgtagcttgtaatcttagtgctagggaggcgagacctgaccatccctaaggctcactggccagccaacttagcttaaacagtgagatctccaggtcctagtaagagagcttgtctcaagaagagcacaataaggctgggaagatgtctcaacagtttagagcactggctgctcttccagacagtccatatttattttccagtgctcatatactagctcacaactggctgtaactctagtcccagggggcccaatgccttcttctggcctccaagggcaccaggcacaagtggtgcaaagacatatgagaaaacaaaacactcatgaattaaacaagcagacaattgaagaacacttgaggttgacctctcctccatatacgtgtagacatacatatgcacgtgtacccttgcacatgtgagtatgcatacacactgacacacacacaaagtgactgtgttaaaacaaatgtggggtggagaaaatgtgtatagtatgctgtcgccattgcatcgcttgcacagaacattaattgaaaaagaaaaaaacattgtagcactcagggtatctcccttgccaaataaaggctcttcaaaaatattttttaaacgaataacaatatacatcagcgtgttaaaatagaaagattagaaaaatacagaaaaaaatctctttctcttctttagacaagaccttgttattctataactctagctgtcctggaacttgctgtgcagaccaggctagcctcaagctcacagagatcctcttgcctctgcctcacaaatgagggggattatagacgtacactaccatgtccagctgttttagcgaaggctttgtacatccagggtactcaacctagaacctcttacatactaagcaagtgctctcccactgagctctccctccagcctacaggcctatttttcatgtaaatcagtgcagcctttctgcaggacaatattgtaggtcatttcaaaagactttaaaacgtgcataccctttgatctggcaattcagcttttacaagtgcatactaaggaaataaccagaatggaatgaatgcccaaagattcatgtacaaagtagcacatcaaaacattggttataggggctagagagtcagcccagtaagtaagtgcagtggctactcttccagaggaccctgcactacacccacataatggctcacaaccatctgtaccaccaattctagggagatccagcgcccctctggcctttaaatactaggtatgcaaatggttcacagatatacacctaaaattattcctttaatttaaaaataatattatcgggagctagagagatggtccagcagttaaggtaatgaaatgcactggtcctgcctaaggcctgagttcggtttccagcatccacactgggtggctcacaactgcctgcagctcccgcttattgggataatcctgcatctctagcaggcagctgtgagccacccagtgtggatgctggaaaccgaactcaggtcttctgcaagaccagtgcatcctccagatagaaggaactgtgtggctcttgcaaaggtatgaaggctgtggtgtctctgggtggtagagcgtttgcctaatttgtgcaaggccctgggtttgattcccagctccagaaaaaagaaaatatgctaacagcttaaaacatgaatgagaagttctatttaccatcaaacttcccagactacaccataatctctgtcatatagcctctctgtgccctggatccttccctccctcactgcagttctgagttagataatatgtattgtgtgcttatctagtccacatgtgcaagtcgggaaggaccataaggatgggtgctaacgcctgtccttgcactcactaccattgtacactattcaagaaagaaaattaagaaagctcccagtctaattgaaaaatagctttgacaaagcaatggaaaaggctcattttattaaaccgtcacccctgtgcacaggtcattttaatatcctgtgtgaagaaacagagagcatagcaagtgctgccactgagctggtcgctcctcagcaagctccggggttgaggggcggggggagaggcaagagctcaacaggcctttttttttctgtggaacatcaatttcagttgaaagaactacagtagtcagactcagtatttgacagacattcttcttctccaagatgaacgaagtgagcctggagcttcaaagaaacagctgaggggatttgttaccaaagataaggtgtaaactttcaactgaagattctgaatttttgaaaacctgtctctgccactggggccgtggctgtgtctcaggatttaaggaagctcttcctgcctcttaattctttatgacctgttgggattcccaagcttcatcctagatgccagggtcacttcttctattggcttgctggggtcccatgcatgcacctatgcacatggtctttgccctcagtatatcatgtacgctttggacatgaagtggagcactgcctaggatgtatcaggaaggctaccagtgcagcgcagtgcaggtgttgcaagacatgatgacacaaacctccaatgtccatgcttccctttgtccccagcaccagccctctatccacctttaggctttagtctcccaggagctagtgatggctctctgcctccagctttgacctcttctgagcttccagttgcacgtcttccctgcctctcagctatatgtacagcagccaaacctatgtttctttccatttctcgcactgcctctcttctaaggctccctaagtcagagacatcatcaatactagccctgcctcaccagtgaggtctgctctccctccttcctcttagtctctgcaccaagcaggccaccttgcttatcaccccaccgctcccacagccccttgactgctcgccatccctctcccatcagtctccatacaaagccactactggcatttgcagaccactccctaacctagaagtttccagttctcttccccatgagatccacacctcttctcctgccctctacaggcatggctggggtctccttccacctgcctcatcatccacctgactggctctcttcctctgcttcataccagggaccttcattctattttagactattgcctactagttcccttgccaacttccattttattggcaattttttttcattcttcatttttttaaagatgtatttatttcatgtatatgagtacactgtagctgtcttcagatacaacggaagagggcatcagatcctggcccgctctggctctgctcactccagcctattcatacacacacacacacacacacacacacacacacatattcatacatatacactgtagctgtcttcagacattccagaagagggcatcagatcccattacagatggttgtgagccaccatgtggttgctgggatttgaacccatgacctctggaagagcattcagtgctcttaaccactgagccatctctccagcccccattcttcatttttaagggttcactgtccttaggcaccactcgcatgctaggcaagcactacattaaatgacatattcagccccaagaagcaattctgggtcaccttgtcttctttctgttccttccttccattctctttgcttctcctcccctccctttcctttctcttttctcttctcttatttgaagtcagggatgcactgtgtagaccaggctggccctgaccaaaattttggctcagccttgaaagatttgggattaaaggcatggtcactaaatttggttctatggtatctctttatttttcttaaggatttactgaggtgtgtgtgtgtgtgtgtgtgtgtgtgtgtgtgtgtgtgtgtgtgtttgtgtgtgttcatgagtgtattcgtgcatgcacagaagccagaacagagggtactgaatctctcagagctggagctacaggcctttgtagggtgtactggtactgagatctgaactctagtctttataattgtatagcaaacactcttaaaccagtgagccatcttattgggggagggaggagcttgctcttcttgatgcttttcacttctgaatgaacgaaacaactctgggagctggcaagtgacaatgaatgcatatggcaaggaagtgaatgtaaaattttatcgagtgagggtagggggccctgtagctgaaaaaatgaagttcaatgggaataatctggaaagaaagtaccacttgctgagccttaatttgtccaatctgcagtatgggttttgtgtgcattctccctccattgttctagcaactgtaaaccagcactatattccatatggggatctgaggcccagccaccccagtgcttcctagtccttgctgactgtggcagcctggcagtcggctgcagaacactttctagacatgaaaaagagtagagacagcacctagtatccctgtgattgtatctaatcttcacacagagggaaagagctacgtttcctcttataagatgggcccatgtcgtgaggcatggaagcagtctgtaaagtcaaaactcagtggaaaaacaaccccccacccagtaagaaaaacaacgaaccaccatctcatgtaatcttgagccagtttcttaacctctctgagatatgagctaggaatagtcccctgacagatttgcggtgcaggggagctaccgggaatatgaaagggtcccatatggctcagccacagactgaccctaccagggattcgatctcttccctcctcagcacccacaggaagaagtatggttagcaaaactcacactatgttacaagtctaggaactgtgctctgtccccggcaccgccaaggctgtgtgacctttgtcaagtcattttccctttctgggctttggttgtttcttcttcttctttctcctcctcctcctcctcctcctcctcctagccctggctatcctggaactcactttgtaaaccaagctggcctcgaactcagaaatctgcctgcctctgcctcccaggtgctgggattaaaggcatgcgccaccatgcccagcttggtttcttcttacatttgtatcatatgggagttttatttcatagcagttggatgtttctttttctttctttctttctttttttctcattacccagtcactcaaaaagcaaaggggagtagctcagttggtagcatgtttgccttgcttgtaccaaaccccgagtgtgatccctagtaccacatggtgtgtactgtgaacccagcactgaggaggtggaagtcagaggagcaaaagttcagactcaatgcatagtgagctcaaggcatgctttgctacatgagaccctgcttcgaaaaaagaaaaagaaaaagaaagaaagagagagagaaagtcaaggtcattgtcttcagctacataaacagttggagtccagcctgctctatacatgaccttgtccctcccaaaaaatgaaatgatatgtagcctacttgtagagcacttgcctggcattatgcaaaactggaaggaaggaaggaaggaaggaaggaaggaaggaaggaaggaaggaaggaaggaaggaaggaaggaaggaacctagccaccagatcagatgattttaacctgaaggactgtgtttatggaagttggatatctcaagaaatatttcccaaagggacaagtcaccaaagcctagtgacctgaaagaaaagtcagggttcctcatcaacagatacaacccaggtccctccctcctggcctccagagagatgccccccgcaggcttgggccttactgccaaagcaggcctggagctgattcaggggcccagctgcctgttgccatggcaacattccagcacactttgcatagtgacggggatgctaggttttgctaacaaagtgctctgtagctctgtaaaggacttcatgtctttggcagggacaatcccgccttctttttctcgcaaataactgtgggggctgtgaagagggagttggcaagtcacttcctctgtcttggcctgcgcccctgggctttccttgaaggcacaagttggcagctttttctttctctagttccaaatataccatcaccaccctcctcctgtccactcccccgtccagaagaaagaatggtttttcccttagttagagcccaacatgtttatgaaaacaggaggaatgcgctgttctaatcgcctgtatccccttggctgattgctgggtcaaacagtcctcaatcccctttcctttgttcagaatacccagggattttcaggattgaagcaggaagaccacgtcgtatcctggggaatgaatccctcaggcaggaaatggtctctcagttctgagtggacttggaagaaagccaggcagctgagcaaatcctgattttattttgtccaagggatacactctcgaatacacattactgaacctctctgggcctcgatttcctcatacatgcaatgggcatgattattgagtctttagatgggctttatggaagtgtaacctttatggcaatgtaacctatcttatgcttctgtttccaacaggaggctggtgagttagcctcctgacctcctcatttctaccgcagtctcccctagatcaggtagacttactgatcatgccaacatttaaataacatcctggggctgagaatgtgactcagtgataaagggcttgcctagcatgtgtgagattctggccatccctacctagcacatgggaggtggtgggtgtgctgtatatatcaagctgatcctggtagcacagggctgtcattctagctactcaggatgttatggtaaaaggattgctagttcaagaccttgctgggctattggataaattccaggccaacctgagcaatttagtaaaaccttgtctcaaaataaaaagaggtctggctgggcgtggtggcacatgcctttaatcccagtactcgggaggcagaggcaggcagatttctgagttcgatgccagcctggtctacaaagtgagttccaggacagccagggctatgcagagaaaccctgtctcgaaaaaacaataaataaataaaaataaataaataaataaataaataaataaaggtctgggaatatagtctagtagaagagtgcttttgtgcagatccaggagcctggatccaatcttcagtgctacagaaaagagagatgtcaagttcaaggacagcctaggctagagagcaatactgagtctcagttctccaccaccctgtgtcacttcatggctttcaaactctagtggcttctccctgcacctcagatgaaacccagccttctcccctcatctcttccactttgacatactaaccttctttccatttctcaaagacattgaggctctcacctcagggacttggcactttccattcactttgctggttccttcctgtgctcagttcttagcgtgagaagcctccctctccccctccacacatccatactggttcctacaatcattcggtgtcccatccccttgctagtgttcttcctaacgatactcacaaggtaatcttactttgctgcttggcacatttggtacatttacctcctatatctctctatccccaatgcccacaaagcagccatgtgatggactccacgtagtttattaaatgaatgaacaaatgaatgaatgaggcagtcagagcactggaagcaaagcctgaaatgcaatagagaacaaaggatgtccgtccatctttcttttttcctctttctatttttcttcattttaagtttatttgacactaggtctcactgggtatccctggcttgtctggaactcagaaattcacctacctttgcctcctgagtactgagattaaagatgtacaccaccatagtgggcatgtttacccttctttttgccaccttcatcatctggctatatgacagagggctctttggctagacctgtggccttcaaagctgagagagtacattcatctattcgagtttggggagaaagtattagaatttctatgaacactaattttagcacattttaatttccatatttttctgttttatcatttcaaaaaccaattagcacaatattacatgtatatagtttatatataaatatacatatcttggagcgcaggcttaaaaatacttggagaccatggctggtaggaaataaataaacaggttgttggcagcatgctacagatacactgggttgggccagcacagatttctaaagcagaatattagaggttgaatgccttgggattagggtggggataggggcagcagtgggtttagacccccacaattcctagcacatctgttggccttctttacaaatgaccctacctgtcctatccttcagagacctgtgagtttcctttttaagaaagttccttttgcaaggctctggggaaactttgactctagagcctgatgttgtatcatccccagagacaagtaaggtaggagaaagtctgaggtcctggggctcccttgaagaaacacaggctggtgtttcttccatttgtgtgttctctgtaagcaaaatggtgccttgagaagagtaggtgctgtacttgttgatcaccaccagtacccaggacacctcctccaaatgtttgagctgagagaacactctgggagcaagaaagcccatggtttcactgccaagacagaaattaaatgaggctaggagaggccaaggctggcccaaagtcatggggtatccagcgacctctctgttttgtgctcttctctgcttagtcactgggatgagtgccctgggccttccttgtctcctcctccttggcccgctacttacagcaccagttctccagaactctctggctttcttactggggcaggagccaaactcaaaatattccaaaccacaattccacaacctccttccttcaccaaagccacattctatatttcttcccactctttctatggatgttaataatgtctctgcccttcttgttgttttggcctcagttgcaaagtattcaaagtctactgagtaaatgctactagaagccaggcactttaaaaaaaagtgtgcttcaatttcttaagagagagtgaggggtgggaggagagatgcagaaggcatgcatgccatggcatgcatgtggaggttagaggaaccttttgtggcgttagcacagtccttctaccatagaagtgggctttgaggttataaagccacacagcatttttagtttgtcctttccactctgtgattggggttcaagatgtgaactcccagcttctgctccagttgtcatctatggctgctgcctttccgtcatgatagtgatgtttttgtttggtttttgttgttgttgttgttgttgttgtattttgggggttttttttcttatatttttggttgtgagcctagcctttaacagctgagccatctttccagcccaagaagagaggtttccctgaccggaaatcaaaccctaagccatggtggtgagagtgccgaatcctaaccactagactactagggagcatcttggtttgtcttgagacagagtctcactaggtagctctggctgggctggtattcactatatagatcaagctagccttggattcacagagatcggcctgcttctggctcccaagtgctgggatcaaaggcatgtgccaccatatttgacttagtgataacctcctatgtctttggtactaaaagccctaataaacccttccttttataagatgccttagtcatggtgttttatcgtatcaatagaaaggtgattaatataccaagctcgactagcaagcagcttgacttgctgatccatttcactaactctagacgtttttatgtacaatgaatatatacaccaacgagtgcacacattgactagtgatcacaaagtatacatcctatactcactctcgtttccctcgcttgagaagctgaacagaagcaggaccagcactgcagagccctcctacctttaggcatattgcagatcatccttccaatacctttgtgagtagtttaacccaatttacagatacacattattttttccttgaaccagctaatttaattttgcctcagatatccaacaaattagactttttgacacactcaatttttcttcttgttatgagatcctattatatatactagcatacgagtataactacgaaatttacaaagatcatgcatgtacttctaaaatccccctctgtactattagctcatatgcacttgcaaagtgcgtgtcagattttgtgggacattctattgggggaattagtgtgaatggaagtctgtttctagtagaaaagatttttttaaaaagtctttgaatctgatgcagcagcatctatactggaaccaaaccctgtggagcagatatggctataaaggggtaccttcagttctggtgacaagtctctaagaagacaccctcaaagtgtttgggttgagacttgagaaacaagactgacttttcctgagtgtagttgaaaatggaaggaaaagcactcctctggaaggaatagaaacagagaaaccttcattgaggctgaaagcaacccccctgcttcagggttgagaagtatgactgtagctcactgggacagaatctctcagaaaagggctgagtaagcttgcacatgagcccaaggataggctactggtagactgctggaggacacagtcgaactgcgccttggaattcagggtttccaataaaacttcgatctgaaagacccaataccaaactgaagtatgtgcaggtggggccagctgtgtgacaaaaacaaaaacaaaaacaaaaactaggcttagagttagctaacttgggtccatgacacaaccatgcaattttttagttcagtctctttaccctggtttatttctccatcttcctcttgggcccaataaaccagggcattacagaaatgagaacataccaaaagtgacatgctggctcttgtcctagctctggggttccaggtgtgagtctggaggtggcactgactcctgcccatttctctaccaggtccttttttttttttaccatccttgctgctgatggggttgcagacgaccttaatcactttcactttagaaaagtagcccccagcattgctttcaagccccagatttctctgtctctcctctgcaggtttatctgaggcttctttaaaaaaaattttttttatttatatgagtacactgcagctgtcttcagacacaccagaagagggcatcagatcccattacagatggttgtgagccaccatgtggttgctggtatttgaactcagggcctctggaagagcagtcagtgctcttacaggtttatctgaatatcaagcatggtggggctggagacaggaggtactagccaaagagcggggcctgcctttacctccgacccctcctctccagacttggctgctcctggtttgactcattctgagcttatgccagaaactccctcctagaactcctttccacttgtctgtctgtctgtctgcctgcctgcctatgtacctcagcaccttagcacattgcacagtgatcacaggagtggaccttcctagcccctctcctcagactaggggaccagtcagaagagtcaccagcactctatgcagcccagatgtcctttctgataagaaagaaggggtgagaagatttgaacatgtggggcaggagaatcagtgcgtgaagctttcagaggaccgatccgaagggaagatcaggggaggtctgcagggcagggaggctggctccatggttctgctaatacttaactagctactggcagggtggtctcttcccactggcagaagatcactgatgaatactctatgccaggcactccaaggcacagcctcaagtccatctacttccacacagccctccaggaaacctagagactaccacaagggaagacctcgtgaacttgtggagaagttctaacacagctagtgctaaaagtactcagatgaggattgtgggtaaggaacagggctttggaagcatggtggcattatagttaaagtttgaggaactgcctatagggcttgggaatcggtgttacaggggaagcaataagaagcagatggggagcacgttttagcaagcactcatgcctgatgtcacgtcggagaagtcttacaatacaatggttccctcttatgcatcaagaatgcattccaagatcttgaaactgctgataggactggcccatgaagagactctgctttttttcccccataaatacctacatgcctacagtacagtttaatttataaattaggcacagtatgagactaataactataaacattagcaaaacagaacagtaatatactataataaagttctgggactgaaggttctctgccgctcaacatatccggttgtaccatggttacctttgtagtgatgatgtgagataacactaagctcatgtgtgtgatatacatagatgtagatgacagcatcaaactatttatgacttgaaaatttgtcaagagggctgagacaggaggacagctgtgaatagtgaccccttcacacacacacaattattaagagaataaaactatggcaatgacattggttgtgtgttgggaaatgatggagatggctgggatatttcataggtgaaggtttttaaccaaagcatttgggaagagtttgtggctagaagttcttctcttcatctttcattgccccagtgattctgtttaccttcttaccaaaggcaggttctactggttttgttgttccagagtccactgaaggcttgctctgaggctgagggtgtagcacaatgcttgagaacttgcataatattcacaaggtcctaggctggctccctaacacctcaaaaatacctgctttggttggaatcctgtctcttgaactcagcttgaaatgtgacagcagtttcttcattggcagacaaatggtcctgattttttcatagttttcagcccaaacctattcttcaatctgtggaaccagcccttccttggaaaatgtggcttggtctcactctctttcctagatccctagctggggttttcttataggctccgtggttctgatggcacgtactgccagcaacagttggaacacgttttctgctcatgtcttccacccacaaatttcattcctttttcgtgcacttcttctttcttcacagttttccagataaatttgttcttatcatagtctttgcaaccttggcacacagctcctctttctttcattaacttgagaactttcacttcacagaagctcctgtggattttttttaagggagggaggagaggatggtagggcaaagggagagagagagagagaatatggattaatggtgaaaaatagggaaaggatttaagtatgacctcactgggaagaggaacgaatacagtggtctactgcacatatccaagtccatcttcagggtcctaacacttaggtataaatgtaaggcaggaggggtgcataactctcctaattaggtttctattgctgtgataaaacactggacaaacctaacctcagggaggaaagggtctatttggcttacacatcccactaagaaggggaggagctgaaacaggaaccctagaggaatgctacttactgacttgctatttatggcttgttcagcctgttttcttatccagcccaggaccacctacccaagcatggcacttcctccagtctactgaactctctcccacatcaatcattaataataaaaatgccccctccagacttgtccacagacaaatctgatggagggacttccctctcgtgaagtttctctttctaggggactctagtttgtgagaagtagacaaactaaccaacacagtaactagtcagtcctgatcaagatatggtcccacccattactgacttacaatggtttagtttctgtctgtccagcaagatagactgattagttgtaaaagctgtgattttttcccccctaggagacaagttcttcctctggctgacaccgggacttcatctttcccctctatagcattccaatttcttggggttatcatttcaataatctgatagccaaggggatggacacatgtgtctcttttgaatatcctctttccagccaaggtggttatatagagatcttggccaagctgcctccccttcctagactctatttgcatagctgtaaactgaattcaagtaatactttgtgaggaagatctggaatgatgaacttgaactgtgctttgaagagctgggactgtcactttgagaaggactcctgtagtcctagtcatgttcaacctgaacactttactatatttgttcattttttaaaatgtgtgttttgcctgattgtatgcactgcactacacatgtttggtactcaaggaggtcagaagaaggcatcagatcccctggaactggagtgacagacagttgtgaatgtgagtgctgggaactgaacctggatcctctgcaagagcagcaagtgctcttaaccacagagccatctctcctgccccatattcaactcttgaccagggcaatgagtgcacaggtatatctagtttgtgaccatgcattcactccccaccccttcttgctgtcttctctctgaatatgtcccaaacctattctttcttgtccatgcctcttcatctccttgagggtataacctagatgcccatgtgtacaagccaactgaattttattgtttcagcttccaaactgtcccacactctgggatgacctcccagtaccacagctgtctttctaggtttctctgagctttactttagtccagtcttacaatttcaaaccttctgagactcatccttcagagctagcataaagagatagaagagcaggaacttaatgtctcctaaactaaagttggccacttagcaccctcactatcaggctcatggatcgacatgttttaaccaaaccatatttataaatctatttccccaagatgcttcactgtgggtacttcccacttgctctggggctacttgctccaagccttattttactttcatgttggttccattggagacttcttgtcatattccacagtgagctgcaaagcccaagtagggggtcccaccatcttgcaaggtgtttgtttggttgtttgggttgttttgttttgttttgttttgtttttttgcaatttatcccttgctaggctgggacagctggtcagtagtctgagggatgtttgtggatttgttaaagactgaagagacccttagcagctggctccctgaagcttgcagtccccacagttcccagtatgccctttccttttgtgtctagctaacttgatgacccagtccacatggggtctatctactctgggaagtactccccctcccccagctctccagacagaagcaggttttctctgattctccttcaacgctgttaattcttttctgtagtgtcttttgatgtgtcagtcacccctcctagaaggtgacttatgcctcttgctcctaccaccagcacggggctggcttaggaggagcctgggaacagttgacagagtgcctaaatgacaggtggatgggggtgggggtggggagcggtggatggatgcgcgaataggtctcattttagacctcttgttccaaatcagaaagctctgacccacacccactatgtggctgtgacagataggcccccctgtccctgtgtctgatgacatcagcgctgaacagtcttactattcgcctatgtgaagccactcagggctttctggctctagcagacttgattccaggaccgatggcccgagcttactgccaggctgttgagactggaacaggctgctgagccagcaccacctgccccttgtcacttatcccacagggctgcagcactcgcgacagtctgctgcatatgtgtgtgtgagagcgcgcgcatgcggagcgcgcatggattttctgtgggacatgaaaagagccttctcattggctgccgagggtcccagttccagtctgtgaatctctgggctgctatctctgccctcccatgggaaggcaaagcaggcaagggaggggaaagtggagtgaggcttcaggtgtgtctgacaaggaagcaggtacgcctggtggccacattgggcattccagagacgtctggatgtgctagcgccaagcctgcagcctggaagcctcgtgctctgcccaaatttcttcaggtttctcttaggactggagcccagaacccactggcagctgtcacagaactggatccgtctcccagtggaacagggagctgtatcacttagaattcctgggtagcacattccttcactggtccttgtcacactcatggatgaggctctgttattggcccctcgctcctgcaagcttctgcagatccagagagcaagcggcagcaggaatgacagctctgagagcagaggcagccagggacagtaagggcaaacgagtcgggtcccgggggttgcgggggctggccccatgtgcagactcagatgaggtgggggttgcactcagggtttgctagggttcttttttggaacctgggctgctagacctgacaggagagctgagcaagggggaggggatagagagggaggaagggattgagggagggaggagagagagggagagagagagagagagagagagagagagagagagagagagagagcgccctagcaggcgctggtccaagtaagaggttcagatctggacaatactgtgccaagggcacaagtgggatttggaagagccatgtgtgtaagaagcaaagctgaggtgatgtaagcacctggggaggagcacaggtcgaggaagaggagaaggaggaggaggaggaggaggaggaggaggaggaggaggaggcgcggcgcggcggccgcggtggctgccagtccagaacagaatgatgggcaactctcaccacaagcaaccgaggagtaagagccaaagcagcaggatgcattcagcaacaggtactctctttccttccctccttttccccgggcttctccagccagggcctccctggctcacagggcccctgacccttggcgtgacttgcaggggctggcaggggggcggggaggaagcctgagggagatgcgggtgaactcccagctcccctgctctagtgccaggctgaattgcataagtctgggctccctgagcaggcaggagctggctccttcgccagcaactctgtgcagcctctggagggtggctggagcaccagctactgaagtttattgctagcacaaggctttctccctgaagccatgcacagcttacccttcaggagtctcctttgttattcaaacctcctgctctcccagcccccagccccgccccacacgtgtacacctacacctctcagggctccacctcggctgccgcctgctcagagtaagccagatgaagctgtttcttgctgtgtaatgccctgccccccacctccccgccccagccctgcctgagctcctctggctgcatggacagctcagagtctgttgtcctcctactttcaatgtgctcttgcttgccctccgtgcccctccagaggtggactcaagggtgctggcgtagttttcccccaacaacttcttcctaaccgctcacagtgtggagattagggtctggagacaacttttggtagcttgcctttgtaaggcactgcaagagcactgtgcaaggaaacagccactcttgtcctattcacaccaacttaacttttattcccttcccccttttggaaacctaggcctcagacattccaggaaagtgcactaccagtgagctgcatctgcaaccctcctctcttggcagcaccccatttttctttcccctcacacagagtcccaggggagcccagaattccctctgtgcccatttggggagctttcattccactatccaggtcaatgggaaggaaagaggagattgtgccaagtggaagtcaagtttattgtggaaagcagcagatgggtcagtgccctcctgaaagcatgccatgttcagacacaggatgccatgcatttaagggtagttgttcaaggctagccatagtagcagctctagaagagggggatctcacagcatgttttcggggaacagctacaagaaggccaccagggatgtgctgatgaaccctactcctgggacctgttagggggaatattgctttggacttcagggtatgcagaactggctcctttggtggactaaggcaaggcaagattctgtgtactggagtttctttgtttctgagtttctgagaacacactgtgttaaggctactattagtagataaatggttcagccacctctgcctagcatctccctctctgccatggagaaagaaggaggctcaggacctgctggcataacacaaagatgctttgcacagctttgttcaggccctggaggaaagcttctcacttgctactgttggaaatgtgggcagttagtggcagttgttttatttcttagcagttgttacctgtttccaatgcttgccccaacccgatgcgtcctggagagagtggccattagagagtcctctgacagcatgaggaggctgtctcatgaccacttctccctccctaacaccttccacctcttaacctagcaccatgcctgcctactctctctctctcctcagccccagaagcttccaggaaaaactcactcccactgggcaggccaaaagagttagtgttccattacccatccctcatagtatacagcctcacaggctggtcaaagagagagaaagaaacaagcaaccaactgtgctctcagagaaaagccgagaccgtgcctatgggaagtccttcagtgaccaggaaagattttttttccaggggagaaagccttccttctttctctcatcactaaaggcaaatgtcccatcctcaggattctgtcttagccctgcctctcctctctcctatctgtctgggctaccctggggaaaccccctctgtccagttgacctctgcacctctgtctgctgccaagactaaacataaacctctgctctagctccaacctaatgtcccatgaagtactccacacccagtggagcacagcttgctccatcctttacctactgctcttctttctcccttccatctaggaacccaaactaagaacctaggagtgggcctccattccactctctccttgatctcacataatttttacctgggcatccacccaaccctttacccaacagttatttgttactgaggcttgctctgactcatagcccctgctcctcttgtccgatgccagtctctacccttgcctgttctagaactgattcctggcctctgcctctgaccttctttctagctcacctaccagccaccatagtgttcttccctgttttgttcatactgctttgttcacagtgttcatactttcttgctttgagtccaaactttgctgacttggggtggtagtatcaagactgtctccctgctgtggagggagatcccaagtggccctaggattcttgtagaaggtggagagaaaacatcttaccttttggttctgtgtgtattttaatgcctattagaaaagtctatacagtgtatctaacccatagtttctcatagtttttgttagggtaaggttaagtgcctttaaagtgagactctggataaaatgattaacagtatacttgctgcatgaaaaaggcaaaagttgagaaactggaaaaacagttcttgagctctgtgcagggggtggggagagggtttctgggataaagtgtatgttcctctagtgatctccattagtgggccctgcctgcttcaccaacctcatctgctgtgacttctcaacttaaacttgataatacagtcacattgaatggcgccttcttttccaaaatcacccattcaccacttctgcaatttgctaaatgtgttttcctctgcctggggcatatcttccatcctctgtcacgttctggcaacttcctctttgtccttcaaagccctcatccagtgtcatctcttctctggaaagttcctcatctagtctccttccttcctcactctttctgtacatttgatctggcctgcagcatcttgccagtgcagacactgctgcttttgtagtctttatttttgaaatggagttttactttgtagttcatgctgacttcgaattcattttgcaaccaagactggttatggcctccttctcttcctgcttcagcctccccagtgctgagatgagaggtgtatgccactacaatttggcactggagttgctaggggttgaacacaggatcttttgcatactaggcaagtggctgtacccttgaggtccactcctggtgccgtaattggcattgcatgctgaaatggatttcaaagactgcacatgtgggaggatgagagagcccatgattgggtctcctggctttcttgtccacaaaccttcaagtcagttgcttttgttacttgtatcttttggttgtaaacagtctgagatccttagaggggactcttagaagcacttacaggacattgtgagaatgcactgtacgaagctagtgtggaaagccttttcaaatttgaagttgcttttcaaaacgggggggggagagtaatgattgcagagcggggaaggctcccaagctgaaggaagaaatgggccctgcgtgtttgagagagcaccaggaacagccactaagctcagcagttggtacaactggatagggacaagcagctgcctggtaggagaattagggtgggatgagacagcagcagcatgcagaagcctagcaggaccttacttagaacatgggaggctgctttgaggggagaaaccttgtctgccaacttcacattctggaaatgattttctcaccagctttcaagcctgtcatttcttgagcaaatgttattgtgtatgtggtgtggtagttaatatgtacttatggccctgttgctacatagcatatgcatagctttccgtgtagtgccttgcagagaagggagagggaccttgcaattgccgtacacctattacatactaaccctctacatccactacttaacccagcgaaccaccgccagagatggattattgatgccatgttacagattaggaagtgagaaccagaaggagggctgctccacacgctgataacaaggacgatgtagaagaaaaacttgagctcaagtctgtgtgcctttgaagcttgaacctattatggcatgtcatgtgcttctcagcatctttgctgtggcaggagttagtaaccctggagactgggtgctgtggaaggaggagaccatggctctgttctggtaggatgagcaaatctctatagcaacaaagactgcaatgcccagcttggtagaagtcccaccatatgtctgtttgatagcatgtttttattgttggaataattgaactcatgaggctctgtgttgagtccagaagctagagcaggggtgcctgagctatcacgaaagtgagcatcttggatataagcctaaatcagttgtttagagaggcttcaggtccagagatagcggttatcaaattggcttccagcatcccctctcgacaggtgtgatgctgtgagcaaggtgacccacgtttcaggttgaaaatgaatgcaccatatgaggggatcatttgattacattttcatcacatttgtatagttgacctggccctttcgtattcccaagtttattgaattatatagcgtccttgctatcattaagatggaagctaaatgacagatacttaggaggaagtcaaattacacctcctctgggggccttcttcctaaagacatatttcccaaccaggcttaatgattccagggaatgatttcacttaatgcgtggaatgagttaaaagtctaagccagtgaacaaaaatatttctgagcatttcttgcctcctataactgcagagaaccttacagcagaggtgtaggtcctagaggtccgggcccatcatggtacaaactttgtattacttacttttacatatctgtgaccaaaatacccaacggaagagttcttataaaaggggaaaaaacttcaccgtttcagagggcctaatgtatgctctcatgtcagaatgtggtgacagaaacatgtagggagcagttctccacccatgggagccaggatgaagagcacgaagaagggactgggaccaagtagaagcgtcctccctgaccccagtaagcctcctcctaaagttcctaccactttactaaaatcactaccagctatagacagaacaaaactcataagcctaccaaggacatggcataatcaaactaggacacccacatttcctggaccaaaagtagaaggaagctaaagaaaatggtttaaaaaaaaaaactaacaaaaaagcatggtggccatcataatgtcaaattataggaaaaattactaaatttagtgtatccaacctcactaaaatatggtagttcagtgagaactgattaaaaaaactattgagcagcatgaacaatgctattttttgaaaaaaataaagcatagggggaaagggagaaatgttataattataacctcaagaataaaaagttaaaactatggaacataaaaatacaaaaccatctctgcatgtggtcaagagtgggaacagaatggcaaagaaatgcaaacttgactgatgtgtgatgcagggtgtgtgattttttgttttttgttttttttgagacagggtttctctgtgtagctctggctgtcctggaactcactttgtagaccaggctggcctctaactcagaaatccgcttgcctctgcctcccaagtgctgggattaaaggtgtgcgccaccatgcccggcgtgaatctttctttaacttagatttccattagtactattacatgatttgtgcaaggaataatacaaaccagtaacacacagagcaatcacactggcaagtcacaaggacagaccaaatcatattttcctgagccagcataagcaactaaaagacgtcatacaaacttgggtgtcttttgagatgggacagggagtgcggcggaattagtaaagagagcccaggtttgaatggaagcccaggtccttatgttgcatctttgaaggaagtcgtttatctcagccctcatagtcttagtttctttactgataatgtaaagataagaataacacaaccaagcgagcacctttaatcccatcacttgggaggcagaggcaggcaagcagatctctgtgagttcgaagccaacctggtctataaagcaagttccaagacagctaaggcaacacagagaaaccctgtatcaaaagaacaaaaaccaaaacaaacaaacacccaccttacagggatgtggtcttgtaaagtatcaaatactgaacagtgtaaagcagtgtttctcattctataggtcttgattcctttgggtttcaaatgacccttacacatgagtcaaatatcagagatctcctgaatagcagatatttacataatgattcagaacagtagcaaaattacaactacgaagtagcaacaaaaatagtgaaactgtattaaagggtcacagcattaggaagatgaagaacctctgatacagccttaccatgtatgtatgtgatatatatatatatatatatatatatacatatattcttttctatatctatatagaaagagagaaaaagaaagaaagggaggaaggaaggaaggaaggaaggaaggaaggaaggaaggaaggaagaaagaaagaaagaaagaaagaaagaaagaaagaaagaaagaaagaaagaaagaaagaaaatggtacttttatgttggatatgttttaaatgtgtggcctgaagatgtgtgtgctggaaacctgggcctcagtgtggccatgctgaggtaatagaagcgagacctggaggaagatatttataggtccctgggaatgtgccattacaggagactaccatagttctcttgcgatccccccaattagatcccacgagagcaaactgttataagatcaagtctgaccttcacatctttcagacttcctgtctcaccacatggtctaaccttctctctcatgaggccttcggccatgctgtgatgttgctaaagaagccctcccccaaggcctaacagatgagactgtaagttaaataaactgtcttttttttaaaaatcagtatctgcactttggtaccaaaaccagactaatacggctactgtttcccactgtgcctctttattgaccctgaagctattctgggcccaatgctgctagtggtttcagatggtgggctctttgtctcctgtggtcactgtgagcattactgaagtttgactgagtaagtgaagctttagtcttgaggggaaaggaatctggaatatgttacggtggggtttttttcttcctttccggaaatgtttaaaatctatggagagaagtttagaattattgctgaagggcataatgaattgaagacttcctcagtcgattgcatcctgagccaggcttgatcagttcaggatcgtgtgtctctaggcaggtgactatgtcctcagagttttcatggcctccctggccagtgcatcccttataggatagtggtaagaatgagactgggtgctgcatcaaaagcagctgtggtgtagcaagcactgtgtgtttaagactcccagagtagaaaggttctcaggggttttctgagtactctaagggagtcttggagaggcacagagtgagtatatgaccatgactctcttatttatttattttaaaatgttgtacaggtgaacattatatgctgagcacataccccacacctgcccttctttttatttccctataccccctcgagtttgtctcctccttccctagacaacttcacttctgcatccattcagtatagatgtacatggatttcatgtgactgtaaaaaatgtaggaagcacaaatgagagaaaactggataagtctctttctgagactggcttaacctgctttaatgtgattacctccactttcaaccattttttccctacaaattacctaactgtgttcttctttatgactgaaaaaaaaaaccaccagccattgtatctatatagcacattttccttccctcctataactcagttgttgtgggcagtgccgcaatccacattgttgtgtaagtatgtatctttaaatacatgtgtttggcactggtgatggaagccagagcttgtgcatgccgggcgaacagtcctcgctgagcccacctcatgatcatcacatttttgcatgtcaacattgaagtgtattccatgggggggaaaaaacagacattttatctcttactacgttggagcccagacattttattgtgtttattgaagaacagggaaatccagatattttaataaaaatgaggtatatggctgaaacctattcatcttccataaacctttcatttttaaagactcacagaaccgaggtgacattgccaaggtcactcagctacagatgttaaaatgggcaacagttcagctactctcttactgctgctgcccctgcatcatgggagttgtccttttgacctctgggagcagctgaactgttacggataccttgggcctcatagccatggcgtgtaaccataatgtgtccacacgggagaaactagacagggctctcacactgaaaagatgatacttgagatgataagatgttccctggtgggagctcttgcatgctgataggtcagctctttgtcaccctcaggcagtatctccaaatgatttgggctgcttcagctttctaagtgccatctgtgaccctatcgagtacttgtgcttcacatgcagccttcgtttctctcaacagcagatttcttatttcagaagttagtctcctgcccaattctccatgaacacagatggtggaatgtggggtcctaggcatattttgctccctgttacatagagtcctgttcctgatattagggaggatgtcacagggccatttctggaaattccttatagggttaggacaggggtgagccgtgctattgacagctcttaaagcttgtctcagagaggatgtgctgtcaccttggccacactgggagggagagatgaccaccatccagcatccttcacagtgctttgactttgtgcgagtgagcaaggaatgatgtctgagttgccatcattcttgctgaagacacttgggtgttggagaacctgttcctgcttctgagttctggctcagggatttctggctctgcagccatttttcccctatgcctgtgttctcacctcatggctgtacactgctgctcccaccctcccccatgccagactcttgactttgggtttgacgttagttttcacctcttctctagagacatcagggcctgacctgggagacagggactgtgaccagggcaaggcacaaaggttcaaaagttgagatctgttggggtgccaacccaaagaataattgtaatccacagaacctaaagtcacattactggatctggggatgatgaaggtggcttcattcccaccattatcaggattccaacccccaagacaaagtctgtgttacagaaacttgcacacaccatttccattttcctagccaagggacaacagtttatcctaacaccagtcaaattctaagcagaggtggagtgggggcaaaatgtaaatattgaccgggattttagtccttagcttcttcaagtgttcaacaatatctctctggctacaggggatggtgactctctcgtgtcacagcaacagcagtcagctgcatcccaggagggccacctggagtgagaaaccactgtggcaggggaggaagatgataaactaaggcttgtgcaaggcaggtcagaggtcacaggcaatgggagccaagagtgaggccaacagcactttaaaatgcttccctgaaccttgtgtagaggtctagagtgtagatgagatatgtccctaggaagagcgttgggaaacataggcaagcactggaagggtctgtactgagccagacagtattttgcagatattagctcagttcacacaatgcccgtatagtatgtgtgcttttattatcttgaaagggggaatctatagatttgcaaatgtgctttgtgtaacatctacagaggcctacagacagtaaaggaagaagctgagaatgtgggcctgggtgccagggcttccaagtctgtccttaagtctttgcttctataaaaatctgcccatgtgagggaagtaagacgctcaccccagctttgccctctggaatggctacacattagcattggatttcagcatctctcaagaattccccaccaccccataatcagcatccaaacgctgacaccattgcatacactagcaagattttattgaaaggacccagatgtagctgtctcttgtgagactatgccagggcctagcaaacacagaagtggatgatcacagtcagctaatggatggatcacagggctcccagtggaggggctagagaaagtacccaaggagctaaagggatctgcaaccctataggtggaacaacattatgaactaaccagtaccccggagctcttgactctagctgcatatgtatcaaaagatggcctagtcggccatcactggaaagagaggcccattggacacgcaaactttatatgccccagtacaggggaacgccagggccaaaaagggggagtcggtgggtaggggaatgggggtgggtgggtatgggggacttttggtatagcatgggaaatgtaaatgagctaaatacctaataaaaaatggaaaaaaaaaaaaaagaattcccctagctggacttagggacacagcctgtaatcccagcacttagaaggatcatgaacttgaagtcagctttgactacataagacactatctgggggagaaaaaatgttctgtgatggttctcaacctggggagatttcaaacttctgaggggccccacccttcagaagtcttggtcttattgctctcatataaagcacagcctgcagggagtatggaaagggtagaccagcaggcttcacagaaacaccttgaggtgtacctgacacacatctgcagtctggcctgcctctctacctgtggctgtagctttttcctctctagcaacagccagatttcctgagaggtacacccaatcctcttccctctccttctttaacctgctgtagtgtggcctctacgctacaaaatccacctttgccaagctccttgcctcagtgctgctgaagtgactatcaccagccaatgctactcttaaatgtagtcccttagtctttttttaacaatggctttttaaaaaccatgtgatagaaattggccctgaaggtaggagccccagaaactgctgctcctgtgctgagttgaaaatcttaatacaggtgatttccacacacccaccccaaccctcaaactgcattcccatctcagtgtccctggctgaaacagatgagaacccagcttatgctgggtctcctcccacactgtgggcaagaaacagtcatgcatctcctctgactagaaaatggttagtggggtgcaggccaatccctggcccatactcatttcagcagtagagccatttagctatttagtactggggaacaaaagagtctatttgtaatcggctcctggcccacacgccttgtttttgtgtccttgtcttctaagcgtacagaaacaaatttgaacaagttgtgttttcagtactttaaagccagtgactctttcatgctttgtgccccgggaaatagtccttgctagaatctgtgatctgatgtgtgatggaggtagaaccaatgaagaaggttagcagtctcctgatgccacagagagtgggactggattccaagtcccgttgtcctctgacagagtaccttaggagagtccttgtctggagctgaggttcactcacttccctcccattacctgggacctatcatctagccctgtgcttggtgagtatgctctacattgtagggtccttcctaagagctggagaaactgaattgagttacacccagctagtttacagacttgttccaggccaagagggaaagcgtgtgtgcttgaaagacttgcaaaaaacagggcctatctctgtgcacgtctctcctctgggaaggaaggggcctgcatggtgacaatagaccagggagctgactcagacagccagttcctgttcatttcccctctcagcaggacagccgctgagcgggaggtcagccctccatgaggctgggactcagcctcctttcagccgagatccttacctagagaaagataaacctgactcacagacagctcccctcactgtccatcagctgtgactgaggcgaacagaaccactgaggtcataggtggagagccaggggtttgaaaagagaaaggtgaaagtcccattttgaatccaggattgcctttcctggactggactgcccaggaacttctctgagcaatgtgattgatagggccgaactggcacagccagtgtgctgggaactggctaaggaagtgaccctgggtgctctactgaggaacctagggacaggtttggaataacgtggagcccctggggtctgggctcccagagtgagcctggcacacatttctctgctgtgtgaggattggctggaagtgggtatccacaccactaggatggagagaggcgagtctcttaccctcttctggagccggggaggtaagttgttgggaaaggaggggagctcgggaccaacttggaaccaagagggaagggagggagaccccttagttctagaggtgtgcagggaggggtaggaaggagacttggaagagatgctataaagccgttttgaaattgggtggttttggatataaaaagggtggatgtaatcacatcctaaccccgatatcttgggaacttaagggattgtaaaagtgactgaggaagtgtgtgtgtgtgtgtgtgtgtgtgtgtgtgtgtgtgtatacatatgtcctagcttctttgagtcaacttaatgtagattctttcagtttaatctcagtcaatttgaggacttacccttacctctgggacttccactgaaatgctggatttgcttttccaaggcatggtcactgggagaggcaggtaaaagggtgcttgtgactggtcgtttccatggtgtgcttcctagtgctatctagactaagcccaagccaaccctcctggtcgtaagataagtgcagggtcctgggtcacactgggaactttgtctgacttctgcgaggagaaccagtcgggatggggaatgtaacatggcagatccgagtcttgaaacatctgggaagttgccagtttttggtggcagctggcaggacagactgcaagtgagcccatggggtgcctctggggctctagtcagccctttgtagctggagtgggctcagaaagtatttatgagctcttaaaatgattagaaaagcagagagatgcaatttttataaaaagtaacatgaggaccatgttacagcctagcatggaaaggaatcagaggaaagtagtatttggtcttcaggtctttgaggggttgtcagagggtgaaatgaccagctagggggtctctgtaaagtctcccatgtcacaattgtggtctgtagacaaggaggaatttcctaacaggctctgcatagacagattgggcagcctagaggagcaaaagctcagcagccttggagggattgtcttctcccagtcagagggggatcctttgatgggaagcaggcctggcctccctcttctgcaggaaggagacagaaggaggggcagctgtcacctgggatgtaggcctggcccaaccctgcagttgcctccctgcctccctccacagctgctcctctcggttgcagccccctcattttcctccctcacactgggctcctgcttccactctccatcacttccccccactccgcagccaagggtgtcttttcaaacaaaccagaccctgctgctcaaaatcctccaaccgcctcccctcaccccctgctgaaagtccccatttcttttttttcttctctattggttcctttctctaaaaacagaacagagataagattatttctcactctaatacggctctgacatttcataaatctatgtcctagacaactggaaagggctatatttaaccttgcatcttgtagcttttaatggagggacttgctgaaggctctgccttctaacaccacaggagacctaaggcttgtctttattctctgctagcctagccagcaacctggaaggccagagtagtcctactttctagtaacatgaccctttctccatcctcaatcatccgccatcccctctgttcagaactggagaaggtccttgcctcaccttctagagtgtgcccttggctttcgtgctttcaggtactctcattaagtggggcagctggtgagcatgggctaggacagcctagaggtatggactgggatgggagctgggctaggaaacagagccaggagagaagggacatatgttgtcatgggtttggttgtgccacagactgggaggagaaatgatgcaggagcattgtgtatgttagctaatgtgaccgtcacaacagtcctgtgaaataggtccagtgagaagacgtggactaagaggaattaagtgacatgtccaaagtcatatctgttgagaaaatgacagctggggtcacaacgtctacttactttaccctgacccaggatatccctgattgaattggttctgccctttggagcagtcattgtggtcgctccctgctggagcccttggcagtctcaggctgcactgccaggcatcttggcccaggcccacctcaattcctgccccaagccaaattgtccagcctggtagttcggttttcttcttgttgttgtttcatagttatttttgttttgctttgttgggaaagaatcttacaatgtaatccagactggcctcaaacctgaggacctcctgtcccagcctctggagtgctggggttgcaagtgtgtggcagcttctctgctcttgggtcttagggacgctttttctggtactgttctcatctgccttgttgataagagcttcttggagcactactaaagcagaacactatactccatttctccatagctgctgttgacattgccaacgctaatgctttctgtggcctgggacaaatttggtctcccattttgtgtcagtttcttgagctgcaatgtggggtggaggaaattctctaaaggcacttgcagttgtccgaatctagggtgccaagggtcctgtcccctggccagccccacccctgctgccttcttagtggtattgggataaagctctccacagctgtaggttttgaaatctttgctgagccaagtgattgctccggagccagtccacaaatcgacagctcagtgacaacagccacatgtgcaggctcttttcttgtttaccaacttttcacagtgggcagtgtgtgtggtggtggtggtggggcgggcttccaaggcgattttcatggtacaccatactgctgcaaagaacactgaattacatggtaagaaaatgattctctctcccactttctgattaccttaaggagaaagtctcagtgtggtactattcttcaacctctataatgtttgctaatcttctgctctaacaaagctagacctgcctcaggctcaaatgcagggacaggcgacagcatctacttggaattttaattactgtgctctgtttcgattgcatttctttttacagttgctttctaattatggcaagtgatacttctttgctttctgtttttgtgttgcttgtttctatgtttgttaagggcaatactgaggatcatcgtagggcctagcctgtgtgtgtaatccgacagcgagctccatctccagcccttggctcttagcatggttctgggaggctgccatttaaattttatttcaatataattttatcattattattttatatttttttgagcatggataagatagacttatcaaggaaaatcagaaaaagagcccttaagcgtgggagaggttgcaagagagaatactgtatttctttgttttgttttgtttttgagacagaatctcataatgtagccctggctggcctgtaacttgctatgatgtagaccaggctggcctcatattcacaaacacacacacacacacacacacctttagaggcgagtattaaaggtatgcatcacttcactctgttaccctatttatttttgaggcagttttatctctatcaggttggattcaaacttgctatgtagacaagggtgaccttgagctcctgatcctcctgcctctcctgagttctggattttgtgtactaccatacccaactctctctctctctctctctgtgtgtgtgtgtgtgtgtgtgtgtgtgtgtgtgtgtgtgtatgtgtgtgtacacatatatgcatctataattccagctcagaaggcagagacagggtccacagaacaagctagttagttggtatccatattggatttgggtttgattgagagactctgcctcaacaaataaagtagaaaattgaccaaagataattcttcacattgacctcaagtcttgtgtgtgtgtgtgtatgcatgtgtgtacatgtatatgtatatatatgcatgtgtgtgtgcatgtgtatacacatatacacatgaaaacaaaaagaaggaaaaatattaaaaatttttttcagccagatgtgctggcatatgcctttaatcccagtattcaggaggcagaggcaggcaaatttgagttagaggccagcctggtctacatagcaagttccaggacagtcaagaatatatagaaaaactaaatgaggaaaaaaaaaaggaaggaaggtatataaatgaaaaataaataaacaaaatattttttaaagttttcaaaactacaaaaacatttagagaaaaaagcagaagtaaatagaaccactgatcccaaaccctgtgggaatggaaacaaaatggctgcagcttgacccgcataggaatgcgctattcattccacaggcatctctggagtgccagccatagaaggctttgcatggctttcctctgctctcttagcctttattgtttcattccctctaatccgagaaacttttgtgcatcctagcttgtggttccctgtctgaaacgtctctcacacagccctgtccttctatcaaacctcagctcatcgtccaagactcagtttgagcagctcttcctctagggtgcccttcttctgaatgcccgggttgcgttctgctctcgggcacgcacacatctctactgcagcctctctcacatcgatggactcatttgtttgcagacctgagtctcctgccctttggcttccaaaaacattttctaaggaaaacttggagggtggggcgaggataaaaatgtaactgcaagtgaagcctgtgacagtgactggaccctggggactgtccggctcctgggatcatttggactggagacttcccagattcagagccaatactcacacaggccacagattccgtctagggaatgtctttgaaggactgttacaggttatatatctataaagattattggaatatctttgggaattgtcatctgaagtcaaaaggaaagtagaaatggtttaagggagaagtgggttgggatacacttaatgacagcctcaaccaactacttggggactctggtgctgcggtggccagtcacaggtgttccaagtttggggggaatcattccttaggtgcaagctgttcctgcaggtgaagaagatggggagtagctttgggcctggcacctctctctgaagaggggacccttgcaattcccgggcagcgctatcaacttaaattagccttgttgaccaagggaataagatgcagtcacaaaggggaatatgaaggatgcatcacagtgtctacctaccacagagatctggccagggcccctggggctgtagtcctggggaagcagtaaaaaggatatagcagtagtttggaggatagactggcaagacctgagggggaatccataatcccaattactggagaggaggcaggagggtcacaaatactgaaccagtcagggccacagagagagttcaagtccagcctggaccatttaacaagaccccgactcagacataacaagttgaaaatggccagggatgtagctcagtgatagagcacttggctaccatgtatggcatgaggaggcagtgatggtcaacgccattaccaaaatcacctctcccacaataacaaagccatgtggtaacagggccttgaaaccctgggtatgctattccagtccctgtgcttagaggacatagagacaagaaagtcacaaggagtttctggtataattggggcagaaaatatttaaagggactattgagagcaatgtgcaaagtgttccccctgtgatgtgtaccaaaagaccaggctgtcttaacactttgttcttgcttctctcctggagcccttattatctgggtcttcccataaagcatgattattggcctcaatctaaacaggtgaaaaatgagatccagagatttgcttcagtcttccctgcaggtcagatctccccaacccccaacccccggctgggacgcctccagcacagtgtgctgtcacagcctgtgccctctccccagcaccacctgccccctcaaagacacatgcagccctctgcagtttgcaaagtgcttattacatatattttatcttgacacaagcctgcaagatagcaaaataacggtgtcagaagaaagcagatttctacctttgtttccttaacctgcctgatacgcagttcagaaatagatatattcccatcgtatttctgtcagagacattcttctttattctgcttttcttttgcctgcacgttcttaaccacctgtgaaattcttccattgcattcatctgttcttccatatcttgcctcaaaagtgagaaaattgtcatcaaaatcaagttacttccttttaagctgtgagtggagaaatagaggtttcataatttttcagccttttccaaaagcagatgttctcggtttgaaacatgaaaaatatatgagatggagactacatctggttttatgtgtgattaggactctgtgagagctttctttctttttttttcttaaataattttttttacatttttttatttgacaagtgttggggatgccatgatgtgcatgtgatagacagagggcagattgtgggtgtctcttctctccttccattgtgcgggctctaagaaccaaactcaggtcatcaagcttgcttgcaagtgccttttctcactgaaccatctcacctgcccaagacagctttcttgttgaacaagtggtactacacttagaggccaccaaaaagctcatgtttgaggagctggggctccctcagttttttcctcagcaccccttgcctgtgctttctttccttttgcagccggcttcctcttcagaccccaggccaaatctatttctttctcttcattccctgtcgaaaagattcctcagatgttctgtcttctcccatcaaatgccagtgagcacacattttgagattaaaaataagagagaaaattcatccatctcttccagtgggttttattgtagtggacctggtctcagggtttatgtaaagcaaagctttcctctagggttttcatagcagacaaccacactagcagcaattctgtgtttacaggagaaaagtcttcatacattctcagcagaaacaaatgcacacattctgtggcactgcctgattttcacatgacttcatttcccatcactgtcacaggaccctaatttaaatttcctttctctttggaattaccaaaatactctgctggcctctcagttaagcagggtggagggttcatttccttcacttccttgtagggagcaggcagtaagtaataggagccaaggtggagatcaagggtcagcgtttggttttaaagattagcaaagtcaaccaatgatccttatcacagtgtaattttcaaagagttaagacgtgaactcattcaaaaatttattgaggtcagatgtcgaagatttgtttaacttactaatgaaggaaccagcatcatggtaaagctggtttgaaaagctacataagggctggggagatgatgcagtgggtaaggtacttatcatgcaagtgtgaggacttgagttcgaatccccagcacacacataaatgcctggtaggtgtagcagcctatctggaatccccagagcaagctgactagctaaactagaaaaattgttaagctctaggttcaggaagagactctgcctcaataggaaaagtgcagggagatcaaagaagactcctaacttcaacctctggcttccacacacatgcatacacatatgaacgtagccccacacacatacacatgcaaaaaaagagagagaatgagaaatacatgagagttaaacatagaattacctcaaaaagagactggcatgatggttcagtggttaagagcatttgatgttcttgcagaaaatcaattccccaacacccacaccacggcttacagccatctgtaactccagttccaggggatccaattgctcttctggcctctctgggccctgcacacaagtggtgcacagatatacacgcaggcaaaacacccatatatttaattttttttcaagaattatctcaaaaagttcataattaccatgcaacctaaaagttcttcttacagcatactccaaggaactgaaaacacttgaacagatatctgtacatgaatgttcatggcagtagtattcataatggaaagtttaaactaacccagatggttatcaattggtgaagagagaaataaaatactgtactcaatgtaggaaatggactatttgaccacaaaatgaagttcaaatacatgctatgattaagtcctgacatgaccctaactgaacgaagcaagacacaaagaacaaattttgtgtaatcccatttacatgaagtatcttgaataggcaaattcataggggtagaaagtagattagaaattaccagagcctaggagaaggtaagcaatgggaaagcaaaagagtaatgggaaattactgctcctttcaaacacagatgtttgtttatttagtgtgtgtgtgtgtgtgtgtgtgtgtgtgtgtgtgtgtgtgtgcttaaacatgtacgtacatgcatgcgtgtgtgtgtgtgtgtgtgtaagtcagggaacaacttgagggctcagttctctccttcctttactgtgggttccaggatcaatggaggtcattaggcttggagcaggagccttcacccagtgggtaaactcccagacttggaaactattgcttgatagatatgtagttttcatctgagatgatgaaaaattaggtatggatagtactggccactttacagcattgtgaatttaattatgacattggcttcttagaaatacttttaaagggtgggtggctaaagagatgatggctcatcagttaagagaacatactgctcttgcagaggacctgaggtgattcccagctccagagggatatgacacctctggcctccatggacacctgcactcatatgcacggacacacatacagagcccacatgatggttcacaactacacataaatccagatccaagggatccgatatgtcctctgattgcttaaggtaccaagtatacatgtggaacacatacatacatgcaggcaaagcattcacacaagaaggaggaggaggaggaggaggaggaggaggaggagaggaggaggaggaggaaggatacatctaataaaaaattttaaaagaactagaatatagctaagtggtggaagtcatgcctagcacctcaacacaaaatatttttagaaatagatatgatagtcttgaaaagaaaattgaagtacgattaaaatggttgttctacaagataatataagtataattttgagggactacttttcctgctgaacagaattaattttaactgtgatcagacaaaaaatcatttgcagcttatcactctcccacaagttaactcctagcttcagagtctgggccttaagcaataatacctaatcatctagtgttctttggtgttctcacctttagctgaaggttgttcggtgatcttgtgttgttgggctttacatggtgtttactcctttcttttccttccttcctccctccctcccccttccctcccccctcctttcttcctttttttcagatagtctttcccatattccaggctagcctcctactttataagtagccaaggatgatcctgaaattcagatcttttgacctccacctgcacagtgctggactgacaggcatacattataccaccacattcagtttatgctaaggatccaacccagggcttcctgcatactaggccagcactcttccaaccaagctacatgcccagcttatattgtttttattaataccgcaaagaatgcatgacaaaaagcaatccccatataagttttcatgaaaaagccttcactttaacttcaaggcctgactctcatgagtattagcatcttggtgacatcttctggtaccacatttcagacccacttgagtccattctgaacatgactgtcaggctgatgtgctccttttgatgtaccacccccaactcattcctgatccactgcacattttctaggacatcttacagaagcatctggaatctggctaaagcttggaagagtgttccttcccgttggttccagctagaaagcatctctccactcctgactagcctgtccttgcctgcatacctttgagcttacagatattttcactgaatgttggtcttatagcctccctggcccatggcaatgtctcctgaattgccgtcatccatgtacatttgtaccattttctctctttcctttcttccttccttccttccttctttcctttctttctttctttctttctttctttctttctttctttctttctttctttctttccttccttccttccttccttccttccttccttccttccttccttttatctttctttttttttttggcttttgtgtatttgtttttgtatttgctttgggcttttgttttttcttgagacaatgttttgctgtcagttagccctgactgctctagagctcactctgtagaccaagctggccttggacatacccacccccgccctaacttccctggtgtggagtcataccccacgtgccatcagctcagctcatcagtgctatgttctaacttcaaaaacacctctctttttaaaaaaaaatgtttctaacttctcaaaagtaaagtcaatgtgctaaagaaaaagttcattagagtaccaagccatgtcctgcttgattctgtcctttaaaattgttgttctttgacaacttcagacgtgttgtagatactgtgttgtgagcattcactcttcattgccctctctcattcctgaagaaaatgccagcccccttttgcagtaccccattaactgcccacagaccctcagtgagaagtggggcttcatgaaccccatccctatatcaaaacatggtgcctttggcttcacatgaagatggtggcagcctcctagtgctcagcttcaggacagtcttcttatacacttcatcagagcatcgatggcaactagctcaggtgctctgcaaggacagtatacactcttaactgctgagccatctctccagccccaattgtcttccatgttggaagtgtgtgattcaggcactggctttgtttgttttactggtaaattaaggacattaacctttagtcatatgcattgtttgtgaccattttctcatgctttttgttttgtccctttactgttggttacctcctttgccatgcagattcttctgcattgtacataattccactaaccatatttttttgagatttcatctatttttttatatgcatcgttgttttgactgcatttatgtctgtgcattgcctgtgtgcagcatcagcagaggccagaagagggcattggattcctctgggactggagttacagatagatgttagctgccatgcattttctgtgcctgactgagtattttgcctgcctgtatgtatgtatgtatgtatgtatgtatgtatatgcaccacatgcatgcctggtgttcatggaggtcataagagggcatatgatcccctagaactggcattatagacagtagcaaacttcaatgctgagaattgaactcaggtccaatgcagaagcaacaagtgctcttaactgctgagccatctctccagtcctgcttatgagtcttgagctaagtttggacttcccaaatcaatacacagccaggctccccaaacagttctatttagtgatgtttcaaaagtaaaaggaaagcctttgtttctgctagttgtttagcatggagacaaggcaaggcatctcctctgtttgccagtgttcttgagttttgcgagtgtcaccctcatactggagcctgcctgcccattgcgggagctttaagtatgttaaggcaaatatgaaaggtgtgtggggcaaatattcgctctaaccttagatgtggtcatacctttttctgtgagtttaccactgtggtatggcatagcgaagctctccctctaagctttcgacacctcgcagatgtagagctcttggcctggtacctatctgtcattagcgagattttctccaactaaggcaaagacgtgtacaacttacctccatgctatctggctctgtagtagaagtagaattatttcttctgcccaggagaataggatgggtagatgagaaagccttcttagtcctccttcttctaaagcctgtgacattctacgaggtaggtcattcactgattgtttctttgccccaacactgtttgatggatacagggtaacaacaaagtcaccctattcctagtagtgagcagtgagcatccttgtgcatttatctgtgcaacatgcaagtattctcttagtataactttatgcaggtgtagctagtaggtcatggacaattaacattggctaagcaccaaaatattgccctcaaaaagggcctggggggtatagcttggtgatagatacttgcctaccatgcacaggccctgagttccatcatcagagtgataaaataaaagctacactctcacactttccctcagctattgtgttcccacttattcatgctacaactttcacatgaatgaaccatgtcaaatacattatgaatattcataatggcatggtatggtttcttgcttgttttgttttgagacagggtttccttatatatcccagactgctcatgaattcaaagcaatccgtctgctttagcttcttaagtgctgaggttacaagtgtgcaccaccacgcccagctatgacaacatggttatttttgtatgtgtgaaatgtaggtatatatctgtgcgtgtgtaggtatgtgtgcatattgcacacatgcatatggaggctagaggttgatggtcggtgtcctcccctattgctctctattttgtcttttgagacatgatctttcactgagcctacagttcaccacttgtctagtccttcccatctccacaccacctcccttcagcactggaaatgccgacatgctaccatgcctggctttttacaacagtcctttgaaaccaaacgcaggtccctttgcttgtatagcaggcacattactcactaagtcatcttccccagttgccagtattattttctggagagaggggcagctggggagagagagaaagtaagtgaagaataataaataaaattgtatgctccaacagtagaatactacatagcaccagtttgcctggaaaatactacctatatcagcatggatgtctctcacaaacataccatgaagcaaagagagcaaattgcaaaaaggttatgtacaattcgatgtggatcagaatgtacaaagcaatatgaaatagcttatgatttgtgagcgcatacacagcacctttttaagtatgcatgtatacttaagacacagacatccagttcgggacagcacttcctctgcagttgcggaggtactgaagcttcagctggggcaaatatgggaaaatgaatttgtttctaatggtactttggcatagcttgaaatagctcagcatctaaaatgagaggaaaagaaaagcaaggcagaagttgtttctttttttttttccttgaataggaaattgaggtgcaagttcttggatatctggtaccttggagaggtagataatcttcacaggaggaggctcactctgactcactggaagtctgctttccccagacactggactaaacccttgggatggatcatttgaatgatataattgttgccttccaagcccacaaggatggtgactcctgagttttgtgactgtcaccctgtgtgcccattgggggaactctgagtagtacattgagccaaataagaagggcgcttgaggcaagtgtttgatccagccttagatgtggccacacctttttctgtgagtttaccactgcttcaggacccagtgaaacaggagcagtgcaacacttactaggactagaattttgccatggtgcctgcctcttgaaagcagtgttgcctcattaaatgacacaactgacacagtggagtcatccggccttatcagtaccactcgatctaaaacagaaaccaggatgggtggggaaggctgtctctcagtgcttggcccccgttgccatgggccctgttgccatggttcccaagcagtttcacttatgatttccctcaaccgcttgcttatggcagccatcagcaagcaggacctagaaagtcgctcatgcagaccaggaagaaagctgataacagaaaagacaagtgaggaagggaagtaattaagcaaacacaaacacatgggaagaggaggcggaaggaatttggtgtgaggcccagaaacagtttggtttttatgatattttttttctttgagatgtaatgaactggagaggctgggtcagaatttgctgagaagtccccattatgtagctaccatgtgacacaggtacagcaactccatgacctggatttccaaaaaaaaaaaaaaaaaaaaaaaaaaaagtcctagttttaagaattctattctttgtcagactaaggatcctgattttttgattcaagaaataaggtcactgtagttacagtggctctctaagtcatccaggaaagcctgatttagaatccctcccctggctggttggcagggagtccccacaggacctgcctctgggccctaaaggcctgagtgaagtggcctcttattcagccaagaaatatcaaagtgcttcgactccacgccgctttcttcagctctgtagttctccaaggagacagagccagaatggcagtgttgtgaccctgtcagagctgcatttcaatgcgagctgcattaactcaatgaacgcagtgctgggcgccttgctttcctcgcctggaagatgaggacaaataagggccgtggcagggttattctgagaatcagctaggtgtttgctacctttagagtgcagtgagaacgttagctgctaccattcactctgtggaactgggcttgtgtggctcacagctgtaatccctgtacccaggtggctgaggcaggaggattgccaagagttcaagtctaggctaggctccatagtgagttccaggtcagtatgagctgcagagtgagaccttgcctcagaaagaaaagaaaaggaaaggaaaggaaaggaaaggaaaggaaaggaaaggaaaggaaaggaaaggaaaggaaaggaaaggaaaggaaaggaaatccactccttcattcaacagataaatgtgtcctctataccagccatgaagccgaacctagggacatgagggtgagcaaaaatcagacatgatccttgctagcatgacggtttcaaatcagaggggtaggcagactttggtcaaagattacctcatgcaaagtccaagcagaagataaatatggcagacaaattctttttctttacttttggagacagtgtctcaccatgtatagccatggctggcctgaaactctatatggaccaggctggacttgaattcattagagatcctcttgcctctgcctatagagttgctaggattaaagatgtgcactaccatggtcagcctggattcttttatttgtgttgattttattattgatgtttaggttagcatacaaagaaactggttcattgtgacatcctcatatatgtgtcattgtgcttttttttctcagtcattcccttccccagcccccctccccagcccctctccccacccccacccccgccatgtctcctgcctatctctgcctggttccctaaactgactgcttgttctgggggcgtggctcagtggaagaatatttgtctagtatgaaaattgtgttcagttcctctaaacaaacagatgattgtggctgctgggtggaatccagaagaacagagtgtttgggggacttctgcccagtgtggcaatttacactaagtgtgtgaaatgatcagctatgtgtagattttagaaatggaatcaatggaactgactgaggggattgattgtggggtgaggaacacacagtaggtattttgactgactgtatatgcatgacttagatcacttcgagtagcagccagtcccaaagctgctgaggggacactggttaagatcccatgtccctcatatagagtagcatgatgctagtccttcagtccagaaatcagttgctagacttcatcgtcaatgaccatttagcatttttaaaatatgcctttgtgaagaataataaagccagatatgcattggctttgcatttgatgcggatttccctttaaaggtaaatccttcacttccaaggtttgaatggaatattactttaaaaatagcatagttttcattaagggaggctgtggaaaacattccttagtctacaatctcctggtggggcagtatatgttctttgaattggattcctttcaaacctttagcccaggagcttttgttctgagaggccaggagacaagagggtctgaaagacgaagggatgctaagggccaaggacaaacttgagtctcataactgcaggtaagcatgcatttgagttcctatggggacttcatgcaaatgatttattgtcatattttgcaagcttttgctcctcgctgcattagctccttaaacctttcttttaagcagagcaggcgtggggttcaaataggcacccaaggcccctctttatgtgagactgtttcatgtgcactgagaaggagctccataaagaatgtgctatttttcccacaccacttgtccccgcactcatcagcagggcttgcctttctcaatctgtgcaggcccacccttcagaagccattatctgctgacaattggtggggctctcttgtcttttctccttctctcaattaaactctaaggactgcgattcccatctgcctcagagcaaacagatctcttgttacacccacttcccagaaactggagagcttgtctcctttctccaacctctatagttctccttttcagaatgcttggcccttttagctattttcaactgcaggtggcaattaaattggtttcccaaagttggaccaagccatctcaccccctacatttaccccatccctggtgacccttgaaccagaaaagaaaaaaaatcattttgtgggctgctattttcctctccctaagcaggcctatgtaaatatacaggtgatgtaatcactcggcacgatgctttttctctagatgagacttgctgtccactttacataacggctggtggtggtaccaacaagggcatggagacctgcctccacccttttaacatagaggtcagcccgcttgagaggagccaagggccaacaaaaaagggaatggctcttccattcacagagccttgtgggtttcaaaaatggaagaggagaacaaaagggacagaaaaatgaagagtaagaaaagggaaaataagagggatatttacaaatagagacagtggtgaaaatagaaagtggtttgtttttcctttactagtctgattacaggaagtattctagtacattattttaatgtatggaataggaatctattttatctacttttgttcttgtggtttccattgggaaaatctcacatttgttaacattgcaaatagtactgaaagatctcaaaggggaagggcaggtcacagtcctgtctccacctgcacccccacccccacccagcactctcaagttctccacatactccctggaggccagcaatgggaacaataactcctgtgtcattacagacttgttccctacgtacttaagcctgtgtgtgcttcacatgtacaattgaagacagcactgatcattctggcccttgcttgtttgttgttgtttaaggtgttatttggaattgagacagcatcttgctatgcagccaaagctgagttttgtgccctgtctgcttcagcttctagagaggtgggattgcagaagtacactgccacgccccccatttgcccctcccctactctgtggcgctacagactgaacctaaggcctcacatgcactaggcaagctctgggcactctactgctaaggtgtatgtatccccagccctctagttttctgagacaggatctcattgaattacccaactgatcttgaactcactctatagctcaggctagccttgaattttttgatcctcttcagttttctgagtagccaagattatagacatactccaccatgccctgtacttgctctccctcaccccaccccacctcaagccctgctttttaatttaccattgactctaatgttttcccacttcctctttgtctgtcctagggacccagggctgtgcatgtgctaggaaagtgctctgccactgagctataaccccatccctcatctgtgtggatgcagtatgacgtacggaaccattgccatccatgaagacttacttaaaatagaagatccagcagcattccaaccaagagaaatgttatgtgaactataataacaagtcacataaggatttttggattttccagtcatactcaaatattacacgtacagatctgaaatgccacctttattcttatatacaggagcttgttttagagtatctattttgttccattcatctctttagcagtttggcagtagtagcctccatttccagtagtcacatttcaaaattaaaagaggcctagagccacaacttagcagtgcagcgtttgactgacatgtgtgaagtcgggttctacccccagcaccccaaaaaaggaaaagaggtgataataatttaatgacatattttatttaatccaatatataacaaaataagaccatatacaatgcacattaaaattattaaagcattgtctattgttggattttgaaactagtgtagattttacaatcccaacccgtttcaaatgcttacgagtcccatgtggctggtggcagtggcaggtggacagtggaggttgagcaggcatggaaatctaaaatgtcacctgagctgtgagcctctgtggttggtaggagtggataaggaagttagatgctgtgacctctctagccttgagtggtgagcaaaggcaccaaagacccaaaaggtcttcctcttttccatgcgctccagttctgctagccagaaatgaagaaagagcctgctactcagggctctcctgaggctcagcaccagcttccttctgtccaccctcagaggcagctcttcttacaagtttcgttgtatttaagacccagtgcccatttccttttcttttttttcaaaagctgaattgtgtggcaagagggctttgaggaaagccctagctctgaggtcagggagggtgtggtgggaggaacccacattgtggcttactcaactgtgagatcttaactggggtggcccacagctactgtggtcctgcgcagcagtggtgacagccatggcagcacagtctggagcttggaatggtgagcaagggaacagtgactgactgtaaggggattggagcttggggtttggtacctcatgggtgctggccatgtggaaggagacagacatctgtagagcccaggtgatgagacatccagctttggcccagtctgaatacactgggccagtttagggaagcacttggactccatagtagctttgaggactgcccccaaccctgaggttgacaggatgctgagaaatgggattatcccttccagggccacatacttttcctgggcaaaggtggtggctcagtgccaactgcttgatttccaagccagtcctcctcccttgcctgctcttcctaactggccagctaccaaaacagagcctggggctagccaaggttcagagcagctttgctgcaggagaaaaggatttattcctgtggtagcctgggagggagctcttggtcaccagcactgcctgcagtgtccccatcacctccaaagtgcatggtggggcgccagcattcctctttcatcccgaacactcctgtggccagcccagcagccagaaactctcaatggtatcagactcctgaagggccaggcagcaagctagcttctttctgcctgatcacacaagctgtaacctcccaacaaaccaagcaaggctagtaaaacagggtgattttatggcaacttaaaatgctggctagcatgatgactttctggctcccaacaccctgcccctttaccggctggccaagatccaaatgtccatagcacaaagattcgtggagagtcgggcacgtctatgggaactacccagtagttgctccagatgaatgaatgcatctatggatatggacacattctttcatggtatcacatggtctgggtattgttttgtttgtacatcttactctaaaagtccccaaatttaaacttgtcactttgtcactttgaacatcatgtatagacacctgggtacccactgatctcctccactaagaaaaggtcccaaagtaaaaccaactcgggactcttgagggtaagctcagaaaacagtctcctggccctgtctctccccacatcattgctttgaggctgttccaagctggagcatcctaccttaaaattacaagtcttaagcctgatgactcttacatatctttagtcaaaagatttttcatctccactctgtaaaatggggctaagaacaccctggagtgcagcaagaaacaaataagaacatgtaatagattgaaccctatgaaattgccctaagcaattttccgcggttccatataatattttaaaagtgctttataaaagagaaaatgtggctgaagagatggctcagtgattgctcttccagagagatcctgagtttaaaattcccagcaaccatgtggtagctcacaaccatctttaatgggatctgatgccttcttctggtgtctgaagacagctacagtgtacacacattttaaaaaaaagtaaataaatttataaaaaggagcaaacactaaagaaatagtcctaaataaatatttttattcttaagagataacaattaagatgtcacagaatattgcttttgaagccactagtcctttcttttatgagcattatgggccatgaagtggcagaagccacttctccaccaacaggaagttgtgggcgttttctggaacacttgagcttaggaagaggggaatcaggtattttttaagagatcagactggttcgtggaaagcagaggagatgagcagaaggctgactcctgatcattcctgcctatcgataatattttcataaaagcatcctcttgctccaggtaggagtggtccctccctgcctccagtcgcaattaagaggctgttgaagataggctttcttttccatgggacagaaccagaaaggtcccaagtaccagagacttagaagaaactgaaagtggacacccaccaaccttgcccttcacaatagtgaccatgaggcataggcagagcctcttgtctttgtgtagtcctgacaaaacttgcctttgaactccagtgtgtgaagcgagggaaaaagccccctcaccaactgtgagaaatacagtggcaatgcaagctgtaatgcaagcggggcctgggaaaaaatcaattgattctgcatcaggtgccagcacccagaccaccaaggaccactgaggcactaaatgagctgtttcagggtgtctgcccagtgtttcctaatgagggtacaattgcgatttgtacaagactgtgctgtgctctgcatgacatttacacgtggtagcaagagaaggatggagggctggtgagatggctcaacaggtaagagcacccgactgctcttctgaaggtcctgagttcaaatcctggcaaccacatggtggctcacaaccatccataacgagatctgactccctcttctggtgtgtctgaagacagctacagtgtacttacatataataaataaataaataaatcttttttaaaaaaaaagagagagaaggatggaaagcactctggaagcccgagagcctcgtggtcacttagaatcttagaatgactgcttctactaggtgttccataaccatgaatcctgggtgttcttttctaaaagcctttttgtgattggttggttggtttttggtttttcaagacagggtttctctgtgtagccctggcttttctggaaactcactcagtagacccagctagacgatttgtttgttatatgtatatgggtgtttttctgcatctatgtatgcaccacatgcatgcctggtaccctcttgggttagaagagggtgtcccaattctctggaactgagctacagatggtagtaagccaccatgtgggcactgggaatcgaactctggttctctgcaagagcaatgaaccatctcttcagccccactggggctttctaattaggccaatggaggcaagtaaagtcactcaagcaagactggaagcagagagtaagaaggccagtgaaaatacccacctgctctgagcactgagttgtgctgctctgggctctggcatcttgtggcagaaggtctacacagagagtggtgcattcgccatcatggacataggctacatgacatttgttcaagtaagtactaatagccaatcatagctatggttagagtccctgtcgcacagatgtgctcagccagatgaccacaaacctctaattggaatttagtctgtttcccaagcaatgcattatagtagcattaacagtatctaagacttttgtctctaaagaaaccacagatacgtttttgtgtcactgaagctgctgcagatatcttgagaaattattccagtcaatggatacttcgaagtcttggtagttaccagtgccacggctaaatcctgttacttaatgtgttgataatgaagcataggttacctacctcaaattaaaaatctgtatggataaccttaaatccagctgacttcctttgccatcctatgtgttttatgcttgtgaaaacattctgagaaaaggtctatagatataaggaacccaagccatataaatattaagagatcaaagctggagagatggctcagagattaaagcattggctgctcttccaggggacttgatttggttcccagcacccacatggtggctcacaactgtctataaccccagttacagaaggatctgataaactcttctggccttagaaaccaggctcacacatgatacacagacatacatccaggcaaaacacccatacacataaaggatttttttcccattaaaaataggggctggagaaatggctcagaagctaagagcaccggactcagaggacccaggttcaattcccagcacccacatggtagtttacaaccatctattataatttcagttccagggcatctgacaccctcttctgacctccatgggcaccaggcatgcatgtagtatatacatatacacacaggcaaaaacacccacatacataaaatttttaaaaattaaaaatattttttaaaaaaaactatgttagaggcttaacaggaaagcagctaattggggtcaatgggaatggccttgaatgcaaatataggaaatagtacttggattctagagttaccaagggttctgaccaagatatgattctgaagtctgtttccagcttagagctgcagacacgcagcactaacaacagaaactgggggagaagaacagggttggtgaatgacgacgattctttctgcctttagtatgttgaatttgagacaaaaaaaaaaaaaaacttagatactcaggtgaagatgtctccctggctctgggaaatgcaagcaggcaggctgggagtgcagccatggcaacagaaggatttgggagtcgcccttcatttgagttgatcaaggaagcactggagtaattgaagtcgccaacagagaaagggcagcaagagaaacgaggccaagacaagggatcggcttctccagggaccagatttccaaacagatttgtacgcagcaggttttctggtaattgattgctttttgaagtgggagggaattgggggaattgtttgtttctgttttattttgagaaagggccttactatgtaaccctggctggcccggtacttactatgtagctcaggctggccttgtactcactgaaatctcccaacttgacctcttgtgcaacttgcttgggactgctttgtagaacagtccctttagtgagtggcagtggcaggaggcagagacaagagttaaactctttcatacttgcatgaaagacctcagtccagctggggtcccaacagaaatcagacagctaggccttccctttattgcctcaacaagatgttgtttagattctgggtgcagacaaggggacgggtgccttggttctgtactgggtctaagcagcagcttaaggtctgagtgctgcagaaaaggcagttcccctacacaggcatctgggcgagcctcatgcaaccttccagagcaagaaagccattggaaactgtaggaccaaggagcctggttatcaaaggaactagagttcttggtaactataattcttggtccttggtatttcctccaacggctcccatttagagctgagctacacagcctgggttcaggaaattggagggaatggagccaatgccatcctcagcacaaactaagcaagtcagtgccacagaagcaggctctgtggtctccgtgttccttccttccttctgaggtgacccatatctcagagagagggtgtcgccatattgaggttacagccctgttctaaggcctgcgggttgcctgggaaacctaatattgttagaaccaccaaggaaaaggagcttgagcttcattttaaaagacagaaatcaaaaaaaaagttggcttttgattttgacttttatgtcctcataccaactgacaaggcacaaattcttctcaacacttgaaatttagagtagctataggaaaatggaaaacagagagagagagagagagagagagagagagagagagagagagagagagagagagagagagagagatgttttggcatttggtagttgataggctaaaaggccaagtgtaccctgacatcattgtacacagattttacataatttaagggctaggatttttggtacatgcctacaatcttagaacttgggaggctgagacagaaagatctcaagttcaagggtagcccagactacatagtgacagtcactctccctcacccccgaaatgaatgtctggaatgtagctcagtggtagaaggtgtgcctcacatgttggatttgttcctcagcaccaaaataattgggttgccagtgtatttgttttgtttttcctttttgagtcactctgtagcccaggctgaccctgaacaccattccttctgcttcagcctcctgagtgctgggattacagactcaagcctccaattacagacaccaggcttccaatgagtttgttgggggttttgtttgtttgtttgtttttaatatgatgtgactataatggaaacatcagctacaactgaggagtgctgcccccttctgggtgggcaggctggactgtaagggagcaagatatgctctgagggaggagaagcagcaacctgcttgaagttggttagatgagaagtaatgaggctttgattgggggaggtgccagggagtagaggaaggaagggatagaccctttaggagaccacaccaactggtcttggtgacttctcagaggaaatctgcgcacctggcacatggatactgcctgtggtcccagccacaaattagctgttgtgttttcagggttctgtgacactgacaacccttacccatccattaactcaccaaagatcacccatctactgtctagacagcaggctcttgtcatactcattaggcaccaggcagagggaaacccagtcctcacacctaccctgtgaagtacatactcagacacacctcagataccttgggctaacataatactttaagccttagtctacatccttctcatgtgagctaactgaggcccatcgtgtcaataggatttccccagggtctcatcaataaaataagtggcagagtacgggtttgaacctgacctgtgaagggcgctgcagagcaaaggaacttgcctaacacacaggacctgttgactactctatgccaactagagtaggctagtactacgtgcaggctacacactgcttctatgcccaaatctgctggtgaccctgcaagttcaggggtcctgcctacaaccaggaacggaggaagaacacactgagcataggtcaccagcagtgcaggcaatgaagccaccagtttggtcatatgtcatctcattcttgccctaaatccgcctttctagtagctttcagttatgctaggtatcacatctaaggtccagaccaatggtctaccagacctcatggcaatacaactcttgcccatatatgcccatatatatatatatatataaactatactccccttcagtcacactccaaagataaattgacccctacagtcattctttcccactccagaacctttgtacttgctatttccctagcctggcatgctatttttatctcttttgtgtggctgctttcttgttgaactacatagttcttttgcttaactatgaactccatcttcttcactgttgtatctcccagtgttttgtgaccaatgcacagaagaaattctgtaagcacttgttgagtaagtgaactcattattgccacaccaactatgccttaggccctttacaaatattcttttagtgtttggaaacatccctataaatcagctgtgattatctccattctgtagatggaccactgaaaggtgttgtgacttaggctggctcccctataacatcactccaaagtgagcattcaaatgtggtctttcttttaaggtttttttttcagatttatttatgtatatgagtatgggtgcatcaagtgtgttcctggtgcccaaggggtcagaagaaggtatcaggtcccgtggaactgaagttacagaaagttgtgaaccatcatgtgggtgctgggaactgaatccaggtcttctaaaacaagtgtttttaactgttgagccatctctccagctccattaagtggaatcttaattgagaatattatggactctttcttccccatgtcagttgactgacttgaacttcctcaggaaggaactgaagcaattctgggggtcactagctgaagttgtttaaccaccctggttgtacgatgttttcattcttgttaacaaagacctcagaaagacctcagaaagcaaaacagaatggcccacccattcaagtgaaaagtaccccactccagtgggaaatggagctgaaacctacagagctaagcatcctctggaggatgctaggaattgacttcccgatggccctgaaatgttcctcttccaacttctaatttgcctagctccttgcacctcaaagtaagatatgacaacttgggacgacctacagaatgcagaacctctatgtgccctcctttcctacctactgaatccctgcccactttgcagcgaggtccctgggcacttgggcattcctaagcacaaacaatgccttgggacagtgtcctagaaggatcgcccctgagtactggactcagactccccaaggacagggaggaatctcaacactgcctccctaagacctctgtgcaggcctatcccaactagtattgcttgctgaatctgaccacccgttgtcagccacaaatggaataatttactatgcatgctctgcagctctgcccctttcttctttcacccctcttggcctgtgattttcatgatggagatccagcaatgtggtgtttatatatgtaagccacagactctagaaagaccttgcataggcttgtctcttctcctcctcctcctctaccctcacaccacaaaagcccccaagaaggaagttctaaggtgtcaacactgtagctttccttgtggccccagcttacctggccctatgctacttctcagtgtcccctggaagttctagtccttcccaaggtgcagaaggtgttgccaagtgctggctaccgagccctcaccgcacacagcaccaaaataaacccccgttgatatggaaacgggtcaaattattttaagaaaaaaattgctcctttattaagtcgtgttgttatagaaaccagaattaggaaagtaacttggccatggaggttaagtgcaatatttggggacagggacttttccaaatagtggaaatgatgtgtgaacacgtttgcctggcatttgtctctatgccgggaatgagggtgaaggtcagtttagggtcccattgtcccatctgaataggtcactctgcagggccttgcaagtgcgatacaccaaggcataaatcattgtgtaagctggagctaactgaaggggtgtccagcaccacccagtatgcaaattagcaccccctactcagcagcaaactgagtgtcccaacttcctggaattagaaggcagctaggaactgtaaaagtggctcagtggttaagagcactggctaatcttccagatatcatgagttcaattccaagaaaccacatctgatctgatgccatcttctggtgtggtgtgtctgaggacatcgatggtgtactcatatacatacaataaataaataaatctttttataaaagcgctttaaaaaaatccaaaggcaactagacctgaaaaagttatcgatacctgattttcactgtcttttttttaaaagacagaatagccttccttaaactcactctttataccaggctagcctcaaactcacagagacccacctgcctctgcctcctaagtgctagaaaaatgtatgtgccaccacattgactataaatgtaattaaaaaaaaaacttttctagaagaaatcctaactgagcctggtgtagtggtacatggccataatcccagcactcaggaggctgagaacttgtaggctagcctgggctacagagtgagccctgtcttgatctcaaatgtagtgttttaaaatgactggagatagagtttgatgttgggtgcttatctacccctagtgtcactgctctgaaaagttgaaaccttatctgttttttcacaaggcttttaaatttgtcatatatatatatatatatatatatatatatatatatatgactaaaagattctcaaggagcctttaaaatccattttatccaataaataaaaacataaaaaattgcacatatcaatgtttccatgaatgtatatatcagatgatatttaagtcgggttaacagtcagctcttcaactgcatatcttgaaactctatctgcctttgcagagcagattgggaaattaacttctggagggacctgaatttcaacatggacctattgtttatcaactgtgacctgcgcaatttatagtctctctcagtctcattttcacagtgaaaatgtgttgtgggaattagagataatgtatgcacagggcttgtctggtacctgacatataatagagacccaataaatgcttttggaggcttgcctggggagcttttaaaaacagttcatgttgaacacaacttggagcaaataagtcaaatgtgaagctttgaataggtatttggatgtccccggatggttctaaagttcaggcagggttgggaacccataccttcaggcagatgtatgcctaccctgggctcctatttgggcagaaagataaacatgcttatagagaaaacactcaagcatacaaaagccaacactcagtcgtctacctgtggatcagactgtgggcttccagaaatgatgattatggcccctcccctcaggagggccttaagcaatagaaaggacaaatgttagcaagcaaccacagtatttatggccaaggctgcatgtagccggggtgctgtgtgtgtgtgtgtgtgtgtgtgtgtgtgtgtgtgtgtgtgtgtgtgtttgtgtgacatcaagtagtgaactctacgaaaagccagctgtaagaattacaggactaagcatggtggtgcacacctgtcatctcagtgctagggaggctggaggcaagaggatcaagggattgaaggccagtctgcactatatagcaagaccctttctggggaaaagtaagagagaaggaaaatttgcaggagccatcgccttttagtggccggtaagggctgtggggactctgaacagtcatattctgtcttccttagatgacagagtgggtattttcaaaaacagctcaagtgcaattcatgtacttattcatcccacatgtatttactgagcatctcgtatatgcctcagactatgctgacaaccaagacagatgagacccctggcctgctttcacaagcactttaataatgatatcagtaaaggagaaaagtttgaaatggtggtaagtactgtgaagaaaagcagagtgattcggctagagtggttaggatggggacagcatagcacaaaatcacagaagccttcctgaggggaatctctgagcacattcaagtagtgtttctggcagagtgaatagcggtgcaagaagatcttaacattggaaattggcctggcatatttgaggagcagcaagaaggcctctgtgatgagaaggctataagcagagagagtgatgagcagtgaggccagactggaggcagggagcagaggccagctagcccagcccctggctcatgctaaaaacttgcattttagtatatagtgtggtgagaaagagtggggagaagagtgggatgtggtttgccgtttttctttacttgaagtaaatttctcttgccataaaagtcacctatctaaagcatacaatccaatggtctcagcatagtattcccaagtatgtgcaactacaatcacatttgagacaaggacattttattatcccccaaaggacacatttcactcacgagcagtcattttctccttctgccaacacttccatccatccccaccacccatctgtttccaagctctatggatttgcctcttctggacccttcgtataaacagaatcatacaatgtgggaccttttgtgtgcaacttctgctacttagcatgttttcaagctccccacatgataggccaccgcgcagcagttggttcttttcatggccgaataacgtccaactgctcttctcttaccattaccatttgatgaacatgcgggtagtctggtcattacttttctgttgctatgataaaacaccatgaccaagacaacttatagagtttatttggacttacagttcgttggggttaaagggcaagatgttgagtagaagaagcaggcattgcaggtctttaaactctcaaagccagtgacagacttcctctagcaagaccacaccacccaaacctctcaactgtcatcagttgggggccaggtattcaaatgcccgagactatgggggacatctcattcacagcaacacaggaggtgtaagctctccatttagccatctgaggaattacaaggctgttttccatagtagctgcaccaccattttcctccccaacacagttaacagcagtttcctgatgctggccatcctactgggtatgaagtggtccccactgctgtttagtttgtatttccctgtgagtttgggcttcttgtcctgtgttttttggtcatttgaatcaagatttcgctttgtagcccagagtggcccagtactccctgtatgcacccaggctgacctcaaactgagcgtccagcccctgcaaggcaagtactgggattgcagatttgcatcaccatgcccaactgttatttgcctttattctttttaaatttatatttatgggtgtttgccttcatctatgtctgtgtaccacatgaatccagtgccagaagagggcagtggatcccctggaaccagagttatagatgatcgtgagacatcatgagggtcctcacaatagaacccaggtcctctggaggagcagccagtgctcctaactactgaaccatctctccagcctttcctttttattattgagttatcagaatatacaatactctagataaaaaaaatccttatcaaatacatgattggcaagtattttcttcatttttttgagttaacctttttcttttttcccctctttttatttgttatttgagaattttatacatgcatataatacattttgatcaatcccagccctcgttttccctccagttcttcctgcctctcccaccacttttcctcccaactttacctgctctttgttaaaccttccctgagtccacttagttcagccagtttgtccgttgggtgtaggaccatccactgcagcctgggcagcctatcaggaaccgcatctaaggtaaattgactgtccctccagtcacagccattaattacctatagctcctcagctcggggtgggacctcatgagcttctcctccccacccaggctggaattttggctgccttgatcttgtgccagagccctttcagtttcttgacggtgaacttggaaattcaaaagtttgtaacctcagtgaagcccagtgtatctattgtttcttttgctgcacatgtttgcttttggtgtcatgtcaagtaatccacggtctcattcctaagtgcatttcaagaaaatttctttgctgtgcaaggagaagataggagacggagctacaacggaccaagcaagagacaggctcagagagaagcactttgtccacagcttccttactctggagagaactctatgcacagcatctgatttctggctgagggtgaagcactgaaccctttgaggtgatctggacctaggcacactgctgagctagcctcattctcttgcaagacttttatatacatgtcacttccttcttctatcctgctttgagccctgttgggcaactcagacatttgaaaagacacaggctccgggccaggtcagaaggtaatctgagtggtctccactggccggggaggaacctctgtggtgtccattcagcgtaggacccgagaaaagcccttcttctggacctcagtttccacatctgatgcgtcagggagctggataaggtttctgacaagcttctgagccttcgcttctcggttttcacaaggtaactaagcaataaatatttatcatggtagcaagggagagcctacactaactaccaagtaatgttgacagtatgatcgcatctttgtttgccatagaaaaacttccagaaagatatacccaaggtatcgacaatgcttgcctctcatgccacattaggctgttcctctttcaatctgtttgctttgatctctaatggtgacaaacttgttttttgaaagaaaaagaaaagcatgatagataaaagttgacaaatttttaaagagagaagttgtctagaaactattagcagacaagggaagtgagaaggtggcagcggagtatcttgtctgtcagcagtagagctgcccaccccacaaacctctcctcatgccaggtcagctgcgaggctgacattagtgtgggacagctgttgcaggaggctcttgggatcttcatctgtgaaaagtgggtgggtcaagggactgctgtaaactcagtgctgtcaaaacgaaccccttctccaatacctcctcaatcctgggcaggcctttggtgctaagctggaaactctgagttgccttaaattgggatgaggtcgctgctagagaaggaagtgtgacattagataaagcaatcctcaaatatgttagctaatgagatgccttcttttggcaactctcccctcaggagggtaatcatttatccctgagatgatacctgggtggctcttcaaagcacccactccctagcagaggtgacctccatgaaggtagacaatcggagctgctttgcttgctcatttacttgcttactttttctccttccttttcctcttcccttcttttctttcttgtgtatatgtgtggtgagaattgaacctaggtcctcacacatagtaggcaagctctccactactaagctacaaacacacctaagggatttctaacaatgagagaaaaaaaaaccattgtttaactgtagtgaggcctgactgcacctgtcactgaacactgatctctatccagactcctgtccttgggtaatgatctttgcaggtctacctaggtaggtccttagtatcccaggatccaggcactactttaagccctatgatcctttaacgtctctaaaagttatcattgaggggaacctaagttcagggagttcacacagctgttaggtagaggcagtctcaaagctagataagtctagctccaaggtgcacccccaccccccaccccccgggactataactgcccagacttgccaaccatttgtttcttggtccttgttagtgctgtgttcaccaatcaacatttgctgagctgggctcactcagccaaacccagagctgatcttgacttagtaaagagctcccttttcgacaagactgtttcctttgtgatgacagctttttttccctaccatgaacatgcctgaatttcctcaagtttgggggacagaggaggctgtaggcagtccagctgagttaatcttgagttaatcttattagtctgtgagatcaattggctgccggcaccaggcaagtgacagcacgggcattaattcagcagcagttggagcagtctcacagccagggactgatttatcaatccctttaatggatgggatcacatttagctaattgtgtctgaggctggcacaagtaagatggcctccttgtaatatgggtctcctgcaaggatgagggaatgagagaagaggctaggtggcaagtcatgccattttcctggccactcctgtttgggttccaggtatctctgaacgctgtgttactgtctcgaaggcaacataggcaatggttatcagagcatagtctttgtaccaacagcattagcatcccttgggaacctgttaggcatgcagatttctgggtcccatcctcaccttcagctggagtatctgaaagtgatgctaaatattctaggtttttgtttctccaaagagttgtgaacacaaactctggtaccaggcagcctgagttctatccgtatgaccttggacaagctctgtgacctctcagtgtcttttaacttcttcatctgtaacatgagagaaataatataatctgctttacaggatacacacacacacacacacacacacatattccttcagcatgacagtgattctgagtggatcataaagtcaatatgatttgctaagtaaaattctatcattactttggcggatcttatgtataaatgtatgtgtaagtggacagggtgaagttcttgagtgctttctttctacagtcacaagcttttgaaatatgattagagataatatatcttcagaatctagtgagtatactctggtgaagtagataaacatagtacttcctgaataagtaatgggcagagtggaagtcaggactactgttgaagacttagggtggtcccactgctatttatggatcttatccccacctaggggcaggagggtaggtctgtgctcctcaggtgacattgcagtagcatcaaactcaaggttacaacagtttagaaagcgaaagatatgaacacatgcctgttgcaccagaggaagcttaaccacagtatggagtatagctgacccagggagatccgctggggagtggatatgagactaaaggggtggacacaacagagagggagagagtccatctaagatgcagggaggtcttggaagctgcccaagttcattgattgctgtggacatatctgaattacctgatgagagctcaagtagattttaatttgcaaaggtatccagttggtcagtggagtctctactcttttgtcatctccatcctgattgggctgtgaaatctgatataaggctgggagaactgattgcaagaccaagttccagctcaggtgattgagggaggggtacagaagtagggtgtgacttgaagctccaaccacatatgctacttccagccctacctgtccctttttaaaactatggtgcccagaatctatattctagtaagagtttagcatggtgcttgcctctaaagtgtatttctttgcattccaataaacactttaattcttgatgggcccagtgcctagtcacgtatggtcactgcctggggtttactgagatgcactgggatttttgcagtgtgtcacatagtcctatcttgtcttgatgtttcagtacggtactatggtacacttctgctttgtaaggcttggtgttcacttgtgggttttgtttggttttgtttcagaacagctttattgtgacaaagcatgaacacaccataaaatccgccccttcccagttgtgcaattcagtgagtttatactacactagagtaacatcagagagtatgcagccatcactatcgttatcaattttagagcatcaccctagtgtttctattatgggtcactcaccattgcctctcaagcctctctccagccttaggcaagcattgatatattttctgattttatgagtttacttgttctggatatcataaaatgggatcacttactatgtagccttttgcatccaaattctttcttttttttccattttttattaggtatttagctcatttacatttccaatgctataccaaaagttccccatacccacccacccccactcccctacccacccactccccctttttggccctggcgttcccctgtactggggcatataaagtttgcaagtccaatgggcctctctttccagtgatggccgactaggccatcttttgatacatatgcagctagagtcaagagctccggggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccccaaattctttcacactgcttgatgttttcaaggtctatccctattgtagaatgtatgaagacttctgttttgctgtatgcttcattggtttatctactggccagtttgaacatttgcattgttctactatggggctaggataaaataattaagcgatgaacactcatgtttaagtttttatgtggacatatattttcattctcttgggtatattcctagtagcaaaaacgttatatcatgcaataactctgtgtttgacattttgggagattgcaaggctgtttaccaaagtggatttatcatcagtctatgaggggaatagtttctacacatcctaactaacatgctgtttgtttggttgttgttgttgttgttgttgtagctatcctagtggatatgaagtagtattttttacttctatttccttggtgattaattgtatattgaacatcctcttgtgtgtttattggctatttgtgtatctttggagaaatatcttttaagagactttgacagtttttgatatggattatttatctcattgatttgtaaaagatgtgtatacattttagatgcaagtctcttatcagatacataacttgcaaatatgctctcacattctgtcttttcacttccagcctggaattacttgtaacaaaatgttttaaatctccaaatttgtattttttcttttattgtcatatctaagaaaccatgatctatctaatctaatgtctcaaagatttatacctatgcttcctaatttttgtagttctaactgctatgtataatcctttggtatacttgggtctgcttttgttgtgcacatgagaatggatttcagctcctttttttttttttttttttgcatttactcaatcagttgtccccaacaccacttttgttgaaaagcccatttctctttgaatggaattagcaccttggtcagaggttatattgctttatatattcgactttaagttctatacttaaaattttaattatcaaaaacttgtataaagttttgaaatcagcaagcgagtcttccaactttgtttgtttgtttgtttgtttgttttgctttgttttgtttcaagattgttttagcgattttgggccatctgaattttcatatagatttgagggtccctatgtccgtttatacaaagaaattggaagtgtaataataattgagtgtatctgtatagcaatatatggtagtattctaataatactaattattctaatccataagaatggaatatctttcttcttgctctcattgttaactttttcatgttttgtagctttcaatatacagatttttttaaagattcatttattttatgtatatgagtacattgttgctgtcttcagacaaaccagaagagggcatcagatatcattacagatggttgtgagtcagcatggggttgctgggatttgaactcaggacctttggaagagcagtcagtgctcttaactgttgagccatctctccagcccctcagtttgccttcttatagaacccaagagcccagggatggcaccatccacaatgggccctccctgcttgatcactgattgagaaaatgtcttatatctggatctcatggaggcatttcctcatctgaagctcctttctctgtgataactccagcttgtgtcaaattgacacacaaaaccagccagtacagccctccttttcattttaattctttgaggttttgttttataagacaccatctcactatgtagccttggctgacctggagcttgctctgtactccaggctgaccttgaactcatagagatccagcttcctctgcctcccagtgctgggattaaaggcgtgtgccaccatgcccagctataaatatatttttaaaaagaataaagcctggtggttccaaggtctccatctcaacaccccatcctaaagtgtgagtttacttagagagagaggggtgagtaggtaagtaggtaggtacatacatattgtggtgcacatatggagttcagaagacaacttttgggactcaatcctctcctttcaccttattgaggtgtttccattgtttctattgctgagcagtgaattcctggatagctggctcacagattgccagatgattctttaggctctgcctcccatgtctccataggaatagcattatagatgctcaccatcacatctactggcttgctttttctttcttttcttctttctttctttctttctttctttctttctttgtttattttggtggttttgagacaggattgttctgtatagtattggttatcctggaactcactctgtagaccaggctggcctcgaattcacagaaatccacctgcctctgccttgcaagtactgggatttaaggcgtgcactcctccaaatcacccctaccaccccactccccagccacatcaactttttacttatatttcagacatggaagtcaggtcatcaggtagtgctttttacacactgctttattatttttatgatgacattgtaaatagaataggcgtctgatttttaattagtggtcagcactggattctgaatgaaccttatatatgtctgaccagagcttttccattgaactacaggcctaactctcttttttaaatttttatttggagatgtggtctcacaatgttgcccaagctggccacaaattttatatcattctattattgtcttctaaatagctgggattatatgctcgtactatccatcattcctgattaattttcttatttcatttcagatttttattataagcatttagtaacacatttttataattcatatcaaacacattatttctaatagatttctaatggatttcttagaatctttcatgtggtctttgaaatttaatttacttcttcctttccaatatgtaggtgtttgatttaatttttatttaatcattctgattacaacctgtatgtattagctacttttctgatgctgtgataatatatcatgatcaaaaacaacttaaggaggaaaggatttattttaccttatggctctagagggatgaagtccatcctagtgaggaaggataggcagaagcagtaagcagacagatcacatttaataccacactttctcagactggccagtgatataaataatgacactgagtctttttaatattttaaagcttagacctttgctgggcaatctcccaactactctgttccgtctgattctatcctctgacctgactcgaagtcaagtctatcgctctgctccatccatccaccccaagtcagctggcaaatcacccttgtctgattcttctcccagcgtccctctctctgcccatgagatccaccctccacttcctgcccagctattggctgtgagatcattattacaaccaatcagatacaattttagattaccttaggctggtgaggaggaatgactatttacaaaatatgagacggttgatggaccataaggaaaaaaaaaaaaacaataccaagatcctgccagcatttagccctctgctagtacagaactaacaattaaataaacagagacacaccttcatacaatgtaccccaacaacatctcgtctgtgtaaaggaagcagacaactggaacagaaagtggggttaggccataaaaccctcaaagcccacccccagtgaggcccatcctccagcaaagctccatctccaagaggttccataatttccaccaaacagcatcaccagctggagaccaagtgtttctatatgtgagcatgtagaggagaatttctcatccaaaccaccacattccagtataatgttgaatggaagtaatagtgagtaaaccccactcttatttctcatcttagggagaatgtatcctgtgtttccagacatactgtgttgtcttattgtgagtttctcttacatggttttttttttttgtcaattcttagtttgtttgcatgcttttaacatgaaaggatgttgaatagtttttatatcaaatccttttttgtgctaagattgatcatggttttgtttttcattaatcactatgacttgttacattgattttcaaatgttaagacaatctcacattcctaagataaattctactcggtagtggcacatggttacttttctcttcctggatttggtacgctaatgttttgttgggaattttgacatcagggatgatggtctatacttgtgttgtttgttgtcggtgttagtgtcagattagaactggcctagtgcagtgaactggaaggcattacattctcatcaatattgaatgagtctatatcctcattgaatgagtttagaaagagttagtgctactttttctttaaatatttggtaaacttcactaatgaattgtttctggtgaatttttctctttaagaaatcccactgtgtgtacactatattttatttatccgttcattttcttaaaagatctagtcgtttgtattttatgtgtttgaatgttttatcttcatccaaatctgtgtaccacatgcatgcaatgctcatgaaagccagaagagggcaccagattccctggtcataaactaccgtgtgggtgctgctaccgggttgtacaggatcactcctcctaatcagttcaaacagttctactcctgatgactaagcattcaaatatatgagcctataggagccattggtgtttgaagcaccacaatgtgcagagggcagagaaccattttctagagtcagttctctccttcttccgtgggatccggggatagaacgtcggtcgtcagctttgcacagcaaacacttttatctgctagaccatcttgctggcctcatcttgagtcatttttgacagtttgtgtctttctaggaacttagtcatttcatctaggttgtctttttggcttacaactgttcacagtatcattctttcggattctcttgcttcttaacagtcaattataatatcccggtgtttacttctgagatttagtcaatgagagccttctgcctctctttcttggttagtctaaccaaaaaaaaaaaatgtttttgaaatccgatttggcctctttctctctgtgtttggacatctaagaaagtccttcacaggcaaaagcctatatctctcccgtgtgtagctttcagccagagccccaaagaatacatttctgttccttgtgccaactgaggcaaatcgattttgaaccagcgtcttcagtaactagtgactgtggcgcacagggctgtcacggtcctacctcttgctgtgggaattaagctgcagctttttagtacatggccctcagccaaagtggctcgttttggagtaagtatgagggcctggaacagagccgaaagcatcaagttcagaccagcaggaaccctggagcaaagcattgtggataggcctggggcttgatcttattgagcaatgtccacattgagtcctgaatggggacagaacaaggaaggcctcctatcattctgaccatatgcctccttggtcacagtgcccaggactgtgctgtcctggttggcagggattcagatgacaggtgggagactcaggaaggcaggaaaaggcatttgagatgtggggcaagggctgattctgactgatggtctagggttactgacccagttggtgtcttttcctcttttcgctgcatgccccaagcctaacctaggccctgtgcttaaagtatttactcgttcagaactctaataatccatttactgttacattcaataaaatatctacttctagactaatgagacatctgtgtctcttgtaagcaggtctcaattttaaaacagagcaaaccccaccaaaatttccttaatgagaaaatgaagagagagagagagagagagagagagagagagagagagagagagagagagagagagagagagagttggggagttaactctctggaatgggtgtgtagtgtacaagaaacctaaaccaactgtgacagcttcagccccaccccaggctgctgcctcaggaccaagaggaagagggagctgccagacttcatgatttctgtaaacagttcttgaaaaagaaaccacacacttgtccctctgccagcccgcagcttgtccccacagctgacagggcagccattgtcttttctctgatgccctctggcagaactccttaatttgaactccgtggctctctagcaggtctccagctagaacttaggagatctgagaacttgtgtgggggggatcatttgatcttttctccactaaccatgaacaggaattttagcatttccttgaagtacaaacgtaggcaacacatcacaataacattagccgtatcgggattttctcaccaagagaaatcacagctattttcctatcaggttacagttgttatgtctcagggatcaccagactctaatctccagacttgccattaggctttgtggtttaatctattattagtgatagaactggaccacaacgtgataaaaaataaatcatgacaatctcatatgatcgatctcctttgccatactgcatatcatattttatgcatgtaagacaaggaagaatgtatctcaaaaaatattcttttgagataggatccaggtttcctaaactgccagaggcgttcccacatgactcgccaaagatgaccatcctgcctgagcacttaggcgacttgtgctccttggacctagttttgttgttttgttttggtgtttgtgtgcttttgtctgtttgtggagatggttgaggaggcctcactacatagccaaggctggctttcaagttaatgtcctcctgcctcagtttaccaggtgcttggatgaaaggcatgagccaccatgcctgggccctggttgtgtgtcattcttttttgtttttcttgagacatggtcttactaggtagccatatctggcccataactggtcatctatctgcctcagctctgggattacagatgtgtgtcaccatgcctacatctcctgggcttcacttctgaactatccaactttgcctgtctgcatgctagtgttacaatgcctgttggcttcacctctgtgctgtgtgtcttaatctaccaaagcagggcgagtggcactgctcgtaggaacgttgtgacaataatagaaagcatttgagcttgaactcacagttactctagctaaccaggtattgactattatcattgctggttcatctccatatgctctactgccacctccatttttagaagaaggaaaattaaattataaaggaacacagtgatcaaggcaagggcatgcatcacaagaatggcagaagccgagttcaaggccacaactgtgtaaactttaaggccagtggaagtcactcttcacaacagagaggaggtcactgccctccaagggatgatggacattaccaaggagctcagctaaagagggaacagctagctccttggcagtctgaatgagctaggctttgccttctgccctcaatacaccagttaaagagaaaagtaataatgaaaaccagataaaagtggttttctgtgtggccacattgagaagaggtaaagaggtgtaataactcccaggtccatatttggagctatgggtgtggtgtgggaactaatcacccattatagtctgggctctattctgtcctgcaggttggtctgataagttgtcagaactcttcctaggaggcaagttcctcctttggcgaacaccaaggcttcagcctttcccttctgccagcactgcaattcctgggaaatttttagttctttgggttccattgtttcagaagtctgttagcagaagagaataccagtagtctgtcattagaatgtctccctctcttgcttatatggctacaatccctattgcttcccctctagctttgttgtgaggacctcctagctccatatgcacaacaccagccaggtctaagggaccagtcctccttccaaaggcaactactaatgcagcatccatattccatggggaaagtccacattctcacattgcacagatcctgcagcaatgagctcaggttgcaacccagaacacccttattctagcctgatggttcaatggggccaggagtacagggcaaggaggcgctctgcagggcagtgctgtgtgggagcagaggtgctttcatgaaggaagtgatcttggagttgagcagattgccagtagactggagccaagagtgtgaatcccacctcttccccctttctcttctcctgattgtcccttttcctttctccttttcctttccttccctccttcttcagaaggttctcattatagtgtgcaggttggtcttgaactcctgggctcaaacaatcctccagccttcgcctcccaaataattaagactgtggggtcatgtcatttcattctgcatgtttgagtttttaagacagatggatgggatgttcaaaggcccagaagtatgaaagggtgcggtgtgtaaggagaagaaggaagtgattcaacatgtctggagataggacagaccagaagaagaaaggaacatagctgggcagatgagggcatgcctaccttttgaccagataaagaagaatgtcagaatcaggtccaggagccttcgtctccaggagagccattgacaatgagatttgtaagttccagagcagcaggtgtgtccatgcacacatgcattcaaacatactcagtaacaccaccccagatacatagaaagtgggttgattagtaggagatagtagagtttagaccagcaaggaacaatagcaatagtctaggggagagatggggagaggctcaactgaggggatagggagtctgggctggattgtctggcctagtccatccctcagccaggttcatttaagtgcggtgagtgggaagaaagacaggaattgctggggaactgagcctccttgtttcagctgtgtgtgggtcctttgatataagctcctcccctaagccatggccagcacttcacgcatttcattttaacctttctcacattaacatctggagggggacccatgttccagttcccacccaaccccgatcctccattaggagggctgctgaggtaaggggcccctattctacatctgcatgtggcaggtaggaagggaagggggttgcagggagcaggtcagggcctgctcactgtcacgggaaatatccacccctttgagcctttaagcaactgttttcttccaagtaggtccccctgttaccaaggcaacttgagaactctgggctttgtgtttctgcccagggtccctggggagagatagcctgctgagctttccctggtctgggcaagatgcaggatgcactaagtggaggtccccattccttaggtgctttttttcaggaggagccttcgttaccccttcctgagctccataagccagttgtgaccatggagggcacagtctgcacatcaataggcccagcttcttcaagacaaatgtctgcacccacctatggactatccatagatataaaacataagaatctctgtcttagaatctgaggtaggggtcaaggaggggtcagcttacagcagaccatggtatatgctgggcaatcatcgttatatagatttctcaactgtgaactgtatgttagaatcatctctctgaactgctgcctgctttgggaactgtatgggaaggcttgtaagaaaatggccagtaaatgtcatctgggctacttagaccctacaactagactggcattagaattgtgtagaaacaaaaggacagccgagccagtatcttaggcagcaaaatcctctccggctcgcaccatcttttaggaagagggctttgggaagccttttcatcttctcacccttctctccctccccttcctttcttctgttctgtcacttccttattcttggcatgcaaaaaggctgctgtgaggtgcaaggtccccttaggttgggtgcccaagatcccaggtggggcctgtctacctttgggtggcagcagcaacccagaaaagcagtggtgtcttcaacacacactgcttgctttttcaagccacatctctcccgagcaggcttttatgaggcatgggagagggagggagtcagttgttctctattttcttaaacctggttgcattttcactttcaaggttgccatcccctagtcctctaagcatctcaacatctacaggtatccttagcagctactcctagttctccatgcagaggcttatttatgcacctgctttttcaacaccaaactgctgctgctattctgtcgtgtacctcatcaactgggctacttagttgcttctgtgaattcaacagtgactgaacaagcaaagagggtgtgaccaaagagagggtggggttgatgacaggcctggaagcccgagggactggcacacagttcccttttcctctagtccttcatctccttcatctgctctcattagtccttacaaaaactgaccctaattaccccctgcctgcagcatcatgaaaaatcccagggctgctggcatcccatctgaccacctaaaaccctagaaggagacccagtgctcactgggacagctcacagcctgtgcagccccgtccttccccagaatggacaatcagccacacgctcagcactgccactgggctagccttgctgggtttctctgcaaaacagaaccaccacctgtctggctccctcagagccccccagatgcagcccacttgagtcagagtcacccccaccccctcattggacccaaggttcctgagatttgggttcctcagatttaaaaagagacaacattgcctggctggattatagcattgaaatgttgggtaaaatagttctctgccctttctgcctctcaagtaaccaggaattttctatgaagatgcagagccgggcagaatcaggatacaggtctgccttcttagacagcggagtgggggcagagaggagctgttctgggagctgactaccaacaaccacaggattgtaaagaagccgttcactgtcacccttagggcagtggcttctaagcctgtgtccgtccttaccttaaagagggtaggactaataaataacctgctgcccaggatgaaggataatggcaggttctcagggcttagtccagcactcgcaagcaggaaggctcagcagaggggaaacaaaaacgttcactcatgtccgagaaagctaagccagtcccagaatgagggtgcagttctttctgactccacactctctaagaagcagggaggtcttgctgaccctacttggcctgctctgggaatttggttccagctacttcactggaatcccatagcaccatctagtgtcccaaagtggaagggcgctttctcgccaccctgcctgccttcactccctccttccaagaactgcttgttgttgctggacgtcaaggtttcaggctagcaccgatcagctaaggtgcctgcgaagtaagcatcttgggtccccgtctatgttcagtaacacagacagacacaatctttacacaccctttatttgttttattgaggagagaaagctttagcatacagaacaatttatcttcacagcacaataatacaacagtaacagtaaaaacagtaacacatttgtttctctggagcctccgggtgtctttggatcacccttgtaccctgcatgcatccccacccccacccccacccccctcaacccaaggaggcactcagagcttcggacagctcctgtagctgtcacatcacaacaaatattgaagaactgggaaagaagggaaaaggttaaaggaagttcaaggcccctctgcccccagaggcccacaggccagtttagtgctcatgtgcttggtctccctggtcagggccacaagcattcagactaagaagcaccgtgaagacaggcaaagcctgtgtgtgccaagggggatctctggaatctgaggtacaagacacctgcttcttgcgcttctccacaaggacacaggcagcgtgaccagtatgttggcatcagcagacagggtccatagcttcaaggaatagagttttcccttctggaattctcgcttgaggaaataagctgaaaaagagacacaaaacaaagtcttcacatggttccctatcctcctgccttggtgggaatgggcaaggcaaacaactgaaatgtctaacaactgactcaggaaggtgaaatgattctgcgtcacacagatgacagccattttcaggcctgctgctggccctccagcaggatgacctcaccttgaagaaagaaagaaatgctgcctctgtgtggcgaggttctgaatggtcgggaggaagctattttgtccttatggcattcactacttcccatatttcccataatgactatacgttaacttctctctttggaggaaaccatggtaaaaggtagccgcaggctataggaacccaattcgactgatcttcaggcaagaaatggaagtgctaaacaaaaaggccccttacctcttgctgatgaatagagagctcaccgttaaccagtctgaggactaggtctgtctaggactcctcttcctcaagttccttctctggtcttaagttcaaactctagggctgggttctcatcttcagactccaatgaggaagagacaccatttgctgctttcttcctgctgaccacggacaacttgggctccactttgcccagctgctaggcaccgtgcagcaagttcaatgtccaggaacaacttgggccagcagtgaaccaggctgccattttgtggccagaatggacataatacatgtgtacttcccactgcagcagcagtattttcctggacccaaaagtgaacagcaggtctttgactaggggcacctgagttggtgcccaagaagccccaggagtgtgcaggaggcagtcgcctcttaagccacactggttaactgaagttcaacaacaggcctaggagaggtttgcccctcacgtgagaaccataggggtgttggccagcaatgctgcaatgagtccagtctctgcagagccagccctgttttctcctttcagttctaaggactccttagagtcagaggggcttaaagagtgggccagcagggctacccccacaacctagaggacacagtctcctcagaggcctctggctgggactgcagtcttaaagcctagccagaagagggccctgttcctaaagcaagattcactccttaggatgtcaaactgaactatggtgctccagccacctctgcctcctcctccccctaatgccagtcctgtaggcaacatgaaggccgaattagccaaagtctgtgcagaggtcctgaggcaggagtctgaggggaaggtaaaccccagcactcaaagtgaggtctgtttgcccgccatcccccctcccgcccccaaagagagtaaacctcagtcaagttgtccattgcactcatggctttgcaggttctcgctgctctaggtgtaggttcccctttcaggcccttctgctggaaatatggcgagtacatatttcttggtgtcatcctgctcgttgtctagtaagtggcctcagagcattaagagtttagatctaatgcctttagatcattggttggggcagatcactcaggcattggggtaaagtcaggataacactgtagaacacagggcaaagaagcacaggagaggcgaagattggggacaactagagttggagacaaaggtgaccagtgccatttacaagaacaggccaagagacttgctttgcaactttgtgcgaggactgagccgagtacacagcaagaggactgttgagtcctgacctctcctttcctggatggccctggttgggcacttttcactcttctggttgtggttgcgaaacaatctggaattctgcaggtcttctttggggtcttcctccagtctggggctttcgtacggactggtcagtagatggggcacgtacagcagcaatagcagaggcaagggaagcaggggaagggtgtgttccccgtggccaactcacccccagtgttcacactcgaattcgaccttgagtagctcggtggcccccctgcctaggagtgaggcagaagagcactgagggacatcttcgcatttggcgttgccccaagcgacctgcatggcgcatcagtggtggcgggctgtagaaggatgaattggtcccgggaaggccctccagaagtgggactcgattctggctcctctgtctgctagaatgcattacagaaggggatacccccaggtaattttcagcatggtagcctatggcggagctaatggtctgggttgacgtgtcaacaaggacaggttcgtccatcaccatgagctctccatgtaggccgtggtggtgggcagcaagtgtgtgcacatgggcgtgtatgtgctcgtgcacatacacatgctcgtgctctatctcctccctctcttgctcctgctctggctccaggaccctaacgataacttcatcttcttcttcatacttattctcatcgctatcctcattcttcatctcctcctccttgtcttcctcctcctcttcctcctcctcttcctcctcgtcgtcgtcgtcttcatcctcctcctcaaattcataatcctcatcctcgtcctcatcctcctcatcctccatctcgtcttcctctttcctcatctcctcctcttcctccctcatctcttgtgggaaagctgtcatgtgctgcctctgatccttcagataaagcctgtacccgcctgcctcttcaccctcaccctcattttcactgtagaactccacaccttcattttcatcctcattaggaattagtgcaaaggggcagcagctattttgaactccagtgagcgaggctgtcttggggacacgcactttcctttctatcttgacacactcaagaatcagctcatccaggtcggccacttcagttgaccataagagttcctttcgaaaaatttctgacaagcctttgagaaattggttttggaggcgacagtcatcccaagacaagaactgggccaagaactgaaaagcatctgcatagctgcccagggtacagtttccctgcttgagcttgcgtatggcctttttagccacgcgtgaggggatggggccacagaattccttacggatttcatccaggaagcgcgggaagttggcatgcaaggagcttccttcctgagtgactgagatagcccagtctctcgcttcccctgtgaaaaaggagatgagaaatgccacccgttccgcgcccccagggaagtgatcctcgtgatctgctatgaaagtctctagctgcatcagaaattcagccaggtacactgggtcgcctgaaaagggttctatgtctggccgctccagcggtggcaaaaggaactcaaaggttggctcctttaacatgggggagtgcagttccggctgggacgggctgggtgacagaggagggtcactggacccgtcggggttggtatagtcctggaccacattaatcaaaagatcatctgagacgtactcgggatctgtgcgtggaggaggccagcacaggaaaggcacctcctcctcctcctcttcctcctcctcaggagtgggatcagtctcattgagcaggaactcaaagttctcctcggcaaggaccggtactatgggcatgggccagcggatgtagctcgagacattgccccgcaaggaattaacctcggccaaggctcttccgagctgcaggcccagctggacattctctcctcgaagggcatttaactcctctcgcagggccacattcgccaagcggaggctattgagatttcccgccgcttcagacattgtgacaagttcctggggctttgagtgctgggcacttgggggtagggagttatggggagtgcaggaggaggcagaaatgaggaggtgggcgtgggaggagaccaacgtgcggcgacagggcgacccggcgcaagcgagcccgggccacacccacaggggctcggtccgggacgcgttacctcgtggcaggggtcggagagagagcaggcagcagctcgggacctggaggcggcaggcgcaggagacagacgagacgctggcagaggtgacgccaacagaggcaggcagagtaggagggaagggactgcggcaggatctgtcgaggaaaaatcttgcagacagcgatccctctcgccttttaagctcagctacgcgcgccccccgcaggggcgggccttcgggaaccgagggagcccactggctcccgcggctgcgctctcactcactctctccttccctagctgcagctaactcgggtcgggaaaatgcgacagcgactgcccactcgaggtcgtcatggcgacagccagtgaacgtgttcctctcctcgggcaggcccccgagtgtagaggaactgcttcgcgaggcgcagctcaatctccagagcctgttgcaaggtactgcgagggtggggggctgccttagaggcagctgcgcagcaggagggaggcaaagaagaaatggggagcagcaaaagaaaagaaaacagttccaaaccatctctcttttcaccttccagactgatgatgctaacattctgtttccagtgctgttgctcccttcctccctccctttttggttcagtagtccataaagggagaaaggatacaggctgagacagggtagtggtcaagcaattcacggagaaggaaatgggagactccctcaatggggacccacattccttccagccctcctgttatatagcccatgccttgggatgctggcaccagaaaacaaaggggtttctccttacctggacttcacacactctgctcttgtaataacctcccaaccacaatgagctcctccatatatctctccaagctgaggatgtagcttagtggtagcatgtgcaaggcccaagcttctatgtccagcaccacaaaaaaaaaaaaaaagccatctcttgtacctttgagtttctcttactacttgagtttttcagagacactggacacagggctgaattcccccaggaggtgcccaatggatacgaaatgtacaaaatatcttgtcagttcttatatctccgtgccagcatatattaatcccagtgcagaacagaaaacatctgatgggcctcccaagggggatacagtggaaacccccagctccccgaaaagggcagtagtgaccttagagaagcaagatgctaagagataatcatgagccctgtgtccaacaaggaagagctaccatgcaagagggggaggggagtgaatgtgctagtttagcaaaggtagaattaggaccaggaagcagaaactcagagagaggcagacctccacctccagacaaagaaaaacttttccaacatgcccaggggccacagttcaaagggaagagtgctctttgggtatctgccctgagacttaagagcacctggaagggcttctgaagagggaatcggagcagagagcgcagacattgctgcagagaatcagccctgagagcagcctcagcaccagattcagagcacacagagcctggaatgtccattctgacctctcactttctgcatgtcatctaagccatggctttggtcaggcccgttcacatcttacacatacttccgtcatcatgtgtccatgaacttggctgtcttctatgccaccaccttcggtttcctgacttttagcctccctagacctgaccccacccacagtggaaccagacctagaaaacatcaatcgtgagttcttgcggccaggtatggcggcacaagcctgtatgtaactccagcactcaagagactgaggcaggaggatcttgagttctgaagccagcctgggctacatgtaaaactttgtctcaaagaaaaacaaagcaaacataagttcttgcaatccaaggcagggttccagactggacttctcagtgtggttctcttccggcttcatgcacattgctcctgagcagtgctggagaacagctgaagagctgcagagcctcagagaatggaactttagcaaaggatgtcctaggtgtgggcttccagttgagcacttaaggtggggaccactaagagaaagcttggtccccaaagcagcacagcttggatttactgactttctttcttcctctactctcatggtcctggaaaccaagcccttttccatttctgaatccaatggccaggaaatagctcaaagaagccatcgagtcagcctgggcagcttggtgtgggagactggctcatggtccttccctagcctggcacctggctgaggccccctagagtgtgtctccactatgctgtctttcagaagaatatgaggaacagtattcggaggccagacttctggggcagaccttccgctcttctgatggggcccctgagcctactcccagcccaaggccccagtctgccaagcgtctggagtttgtactgatggtgagttgcctctgccccaacctgggagagccagcgtgcacccaccgacaggggatcttgaactgtttacgtgacacccccacccctggaagctgctgttcatcactgctcactagcagggctgccatgaggccccactgggaagggtcctgcacaagtgtgtgcctagccaggcagcctgtacatgctttcctgccttcaagaggacgcctccagtcattctgcctaagcagccagcctatgggcaccagctcctcaaccgctcagaagcacaccctttccatcaccctctctcccaacagcctgcaaaacggcagctgagcgaggatgagaccacgacccagggtgtgagggcccctgaggcctgcctgagcctgtctactgccaacaagcaaagtgcctggaatgaccccttccctctacccatcctaaaggagaggctctggcttcagccctgctccacacagtctgaccttgtgccaatcaacatctctggtagagttgctgaacaccacctgtttgcttcccttcatgcaagccgcctatcctctccaaatgcactgggtgctggggagggagggccactctgtctgctactggctcatcctgcactgtccaggtcatgactccccagggagcagaggcttgccgaagaggggactgtggctgctcttccctcaccggcccctatctgcactgccaatatacccgataaccatgtaatagcaaacaaagggttccttacgggatgtgccgaacgaacgggttgctgaacgtgggtgtccttttgagtttaaatggaaacaaagtttggaaattttgtttgtttcaggtaaaaatgatgttataaacccaaagctgtgtctggaacagacaaataatagaagaggggacgcagagtgcacgccgtttaattgtggcataacaagggaagggacacaaaagacgcagggcaaagacagaaagaccaaaaaaagggggcccaggatgaccctgagaatagtgagaaagcatttgcatttgtcttagtttcttttcccattgctatggtaacagaccctgacaaaaggcactacaagaaaaaagtatatactggttcacagttcaaggggtggttcatcaaaggcagctggagcttgacagcagctggtcacattgagtccacagacatgaagcaaaggaccatgaatgcttgctgctgctcggttccctttttccaggatcccctgcccaaggaatggtctcatccacagttaagctggctttgcttgtataagttaatcaggtccgtccccacaggcgcacccagcggcatagctcccagagattctagatccggccaagttgacagcactagttagctcagtctccagcttaggggcccatggaactcctgcttctcactccagtggttgtaaggcaaagggccagttatatcaggaaacaagacttggggccttatgaaagcaagacctcaaaaagggactagaggaagcctggaagttgttatggcccctactgtgctggggaaagttggggaaagcaatggctctgtgtgctccttgggtatgggttgatccactgcccccaaagtcatcttgaaaaggaggggcaggaagtagagcttgtggcctagggaattttgccaagggaagtaaaaacatgatgtgagactcacaaagcaacattgatacgctctgtcttaaatgactctctcacttgcaggctgttcttgagtttctcctgtggagccatttgctgggaaggggctgcagtggtgtggtgtgccggggggtagggggaaggtctgctcagccagctgtctagtaagagacagggggggtgcctgtctagccccatggaccatcacctcaccctgactttgccccagcaaactccagaactaaacgttaacccagcactttaagagaactagatacggctcagtgaacacaaactgccagtttggttagtatgtggccaggtggctgtagaacagagtaccaggctgcttcttaaatgttggagtcagtaaaggatgccatcttcacctggaccctgtgaagacctagagaaaggatcttagtcactctaggcacgacagaacatacttgtcatcacatcgctcttgaggcagaggcagggcgatgaggtcaagtccagactggactcacaaaagcaatgcccaggagtccagactgcatcccagtggcagagtacttgcctggaatatagaaggctctagatgctatccacagcgccagaggagaaactttaatgatcattatcaaatgccatgtagcctcaggccagcactctcctctgcaagcagtgatgctcacccctgtacccaaggactcctaggcccttctacctaggcccttctcccagaaagttgaatgttctggagttaaggtcatagaatttcaaaggctacctaacttatttcagtatggaaccagagttgaaaaagcactgccccagtaaacctaagaagaacaggtaaaccaagtgtgtgtgcccagcaccaaattgggagggatggggaagaagtgtcacctgcctggatgctattcatgttcattgctactgccatcatcccttctctctaccgcagtccagcttccactgtactgtaaacagaaaccaggatgcacccaagtgtctttattttgactacagggcagcagtttgatagacatgcaagttttcgacactcgttgtttaacacagagacagccgtgaaccccaagtccaccctgaggcggaggcggaccattattggattctctaacttttctcagcgagaccaaggtgaccccaataaagttgatcccctcaaatcttttcccccaacccttcccactattcctgccatgcaagtggcattgtgtcagtagggtactggaataattctggggagagggactttgaatatcctgagaaagccaatgtggtaattaaatggtaaccaagggcttttagcaagaccagcaattgagtttggagagcagatatcttgggctaataaatattgaacaataaatcttgaataaaaaaagtccattattgtttgccattataaatggaatataatttagatatgaagtacacacctttaatcccagcactcagtaccagaggcaggaggattgtctccagtttaagaccagcttggtctccatgagttctaagtcagccaaggaataataatgaggtcttgtctcagaaaaaaatgttaacatatatgccaaattaggtaaataggcaaaagtggggaaccatcccccaactcatcatcttgtattgactacaatacaagtagaaactgaagttatttgtatagtctgcctatcatgtgcctgggatatagtcaacattcaacaaatgctggctattatgaattatcatataggtaaagtagtaataatagtaatgttataacagtcatagttgtgattgtgagaacacttttggagactggaacatctgaatgctgtggtcacatctgtgagttatactaagtcttttatgttcaaaagttaaaaagtgacagatgccagaaatacagcattctggcaaactccagattcactgctggggctgtgagccacgtggttctgtgatctttagtcagtttagaaactttttttctcacctcaggactgattaaaccttgaggtcagcttgtttcatgaatccagtgataaagtatgggggaaactcaaggtagccctatgtgacacttctactctgaaaagagtcatcaaagctggaaagcctttggtagccatctgggcaattcaagggtaccccatgactcactgtgtggtgatgggcaagaacccaacttcccccagcattctcatctgtgaaaataaccaaggaattctgacaaagctgttggcaagtggtgcttggcacaaagttgatgttcttgtcacaaagcagctgatgggggaatcccttgctgtaccactaatgtgtattttccatccccaggtcacagcagcagccccacaggcagcctggcccgctctgccacctcagacatcaggcctggccactcagctccacaagttgttcagggaagagttgctgttgggcaggaagctcggttcccaagtctcacctcaccaggactgagacactcttctagtgagcccggagacgctcaccaggcacgcagtgcctcagaccatcccggcatggagagcatggcagtggtgtacagtgtccccagttcttgcaatggaccaacagagtcaacattctccacttcctggaagggagatgctttcacatacatgaccccaagtgccagcagccagggcaatcaagtcagtgaaaatggaaaaaacccttcctcgggcaattcttgggtccctctgaacacactcccacctctggttcctaaggaggcggccacgctctttgtcacccgtgataacccagcaggatgcactgggctacccagctactctgagcaccccactctacgaagacagataccagaaagacctcccaagattggccttcttgcccgtggtacctcaaggctggaaacaggcccaggtgggaccaacaggttccgggagcggtcactgtctgtacccacagactcgggtgttacctcagtggactatgacgaagaacagaagaccagtgagacccgcatcctgccttatgccagtacaagctccgagggcagtaacagtactgacaacattgcagccctcagcactgagcaggaggcacggcacagaaggcaaagatccaaaagtatttcactcaagaaggccaaaaagaagccctctccacccatgcgaagtgtctcactcgtcaaagatgagccagccctcccaccagaaggcgaattggtactgcccaaggaccagaggcctaggagcctttgcctctccttggaacaccaagggcaccacccacctcacccagatgctcaaggtcacccagctgtgccaatgctcaaagatccaggaagtacgcagttctctcaccactggtatcttactgactggaagtctggtgacacctaccagtccttgtccagctccagcactgccaccggcaccacggtcattgagtgcactcaagttcagggaagctcagagtctctggcctccccttccacctccagagcgacaacaccctcccagctctccattgaggtggaagccagggaagtagcctctcctgggaggcccactggactgatgtccccttccagtggttactccagccagtcagagacacccacacccactgtctccatgtccttgaccctgggccacttacctcctccaagtgctagtgtcagagtacgtccagtggtaccagaaaggaagtcatcactgcccccaacatcaccaatggagaaaatctgcaagtcacggttatcatttgacctaccactgacctcttcaaccaccctggatctgtcggggatgagtatctccatccgcagcaaaaccaaggtgagccgccatcactctgataccaattttggggtcaaactggcacagaaaactagtccaaaccaaccgatcatgcccatggttactcagtctgacctccgttctgttcgcctgaggtcagtcagcaagtctgagccagaagacgacattgagagtccagattacatagaggaacctggagcagaggaagtcttcaccatgccagagagaaaagtgaaacctcccatagccgagaaacctccattggcccgaaggcctccaagtttggtccacaggccgccctctctccctggggagtatccactaacttctcctactatggctatggcatccaggagctccattccacacatgaagcagcttccccaagacagctacacagtgttgcggaaaccaaagtcacccagcttccccggggagtcaacagcatcctccagccttgtcctctcacctcttgccagttcctctggtgctttcttctcaggaacacagcaacctccccaggccagtgtagaagacgggggccccaaggtgagagccctgcctgaaagaatcggcctccagagccaggaagaagctgagaaaaagatgaccaagattccacctccggtaccaaaaaagcccagtgtgctctacctgcctctcacctcccctgtagctcaaatggatgcctgcatggcagaaccaaggctacctttcagccccatcatcaccctggaggaagatggcaagtgtccctccactggtgatgaccagaagtcacctggtaaaggggtgacttcgcctcttcacactgacacagaaaaagaggccatctctccaggtgagtaagctgactgttggctttttccttcagttgcaaggagggataagggtgaccaaatcagtagggggcacatctagagggtttggattaactctgaaaaggaattgctgctcggccttatggtcctagggatcaggactgacccaggacagatctccaaggctaagtctggacaatctacccttgagttgggcattacattagcacactggaacttccagactacatctgccaaaccaggtatgcagtccctgccctaggagtccagctcaccagacagtagttttctttagccacactacatttagattaatgcacaggactcagtactctgtaagaccaagttcaagtgtcctggaaggctagcagggttctaaaatgatgtgctgtgttatcacctgcatcctttttcagaagaaagggcacagtcttccttaaatgatttaaatgatttgaatcttcctctacccataagactaagctagttaatgattctccattttggttgatgttgtttctgtaggttttgttttaattgtaagatacacacaacacttaacatttttaaccatttgagggagggagggcacaggttgtgttaagtgtcttccgctatcactctttactttatttttgagacagagtctcttatagaacccagagcttatttattggccagactggctggccagcaagttcggggcatccagctgtttccgcagaaccagatctggatcactaggatcacagacatgcgcaatggtgtctggctttgacatgagtgtcagggatctgaacccaggtcttcatgcttgcatagaagatactttaccaactgtgccaccttcctggctccaacccctccttttttgagacagagttttcaccatgttacatagcttggcctggaagtcacagttctacctcagcctctcaagtgctggggttggatgtgtgccattacccctgccttaatttcagccatttttccctatgcagttcattagcagttaagaacattcatgttgagttacccatctccagaacgtcttttatcttaaaaagtgaaggtctagatccttgaaacaactctcccttccctccctccctcctctgctgccctggtgaccacggttctacttttcaggcctatagatttgactgttctggatgctgagtggaatcacggatttgtctttctttgtgacttgcttatttttattaatgccctcaaggctcagtgatgggtttctcatcatttctaaacccttaatactgaacatcaaaatctcatgaccttctttaagctgatttaggcttccagtgtaagttaatcactgcgccgaaagcaagtgagcatgtcaaagccacgggttattttcacatatacttcctccaactccacaggctccatccgactcaaacaggtcccatcccccgccccccactgggtgaggataattgctttaccgtgctctcagtatcttgagttttttaattatgtatttataacaaggggggctggggaatatatagctcagtgccagagagcttacctagtgtctgcaaggtcctgagttccgtccccagcgctattgttttaaataagtaaataaacaagaaaacacgctcagaccacctgttgtaatgaaaagcatacacgagaacagggatctggactggtcttcaccatgtgggcattgaatggcctgagggtaaattattaaccttcagatctccatgttcctcctcgacaaatggagccatcaaagcctctgtcctgctgtccatccagagttgctttgaacatcaagggaaataatgaaattgtatgtgctttgtcctggctatcatggtcaaagtcattccttttggttcttatgcctagggaggtcagtggaaccgagtgctgaagagaaaagtttaatcagtgataaaacagccgaatggattgcagaggaggaggatgacgtgtttgtggcttcccgcacaactgaagatttatttactgtgatacacaggtcaggatcattttccttcattgtaattgtaattgctttccccttctctacttaaagaaaaactgctgcctctgagcagccattagaattgcaagtgaacattaagtccaggtacctacatttgtgagcagtctggggcctcacatctcaaattcactgatgtctttgagtgaaggggaggaggggaggaccaggtgctgagagaggcccctcgtctcctagcaactgcttggcctattgtgtctccatctgctccctcacagctctgtctgcagtcagagatgtttaacccttcacagaattccttgtaccacagaattctatctcagggtgacatggagccctgggctgaatatgagagcagggacgtaggcagagagggatcaggggtgggcacaggggcatgacacaggggttcgtgagcccagttactggtgtggcacaccagttttcaaaccagtttcaaaaccctctggctgccttaattcattcactgagcgactggccttacctcttttaagtctgtccttgatctcaaaactaataaggactgaacctgtagcatagggcaaaagattgcagttgtgagcattgaaaagcatgtggagaacacagggccctgaaagggacctgggagctaagaggtgagaaatagccgatcatcacaaggctgtcatatgcatactatttagcacatcccttgctggcaatttttcaaagctttgctggctttctgctccccgaattctctgaactctctcagacgagtctttctctcctttaggtccaaaagaaagctactgggctggaaagagactggggagggcttcacgggaagcaaacccagctcccattcaccagtgaagaatacagctgattctcccaccggtgaggctgctgctgccccagggccaagtagcagtgcctgcctagatgctggtagaaatgatgatttcaaggccttgctccagaagaagggaagtaaggcaactcccaggacccgcccctcagcggccgagctgctgaagaccactaaccctctggctcgaaggattattgcacagttctcaaaagactacgaacccactgacaaccccagtacctaagccctgcttctaacttcctaggcctgagtagagaaggagaaagagagagagctttagaaaggaaccaaccacaggaatgacaaaagaatcgatgtctttgatgttaactcacactctgaacagcagagaggacaacacaacaatggagctcacctggcactcagataggcttcagaccttccacatttccattattccatccttgccatgactgaacatcggagtcctacttcttgtctctagccctgtgcactaagagagcctcagattggagagccaccttttcaacgtcctattgtctttgtccattggctcctgtcactgagggacacagtacggagaacagattgggaccttctaaatcaggcctggggacagagggtaccagttcccactgttgattatctacttccttgaagaggccttgatggccctttgtgaagacacagaaagacaccaaggcctcctcaaccacagtgtgactttcctccagagagagttctgtaggcgtgcactaattacggcatggggttgattggatggcttttgtggtgcaaactatgactgtgactcttccaaaacttcatgcctttttcagtttgattgtctatgcggagatcagggtgatgagttttaataaacttctaggacccccccccattagctaatgaaccaagctcagccaaggtaactcgcatgcacgccttgaggtctctcgagtgtctgtcaacataggtagccaggatctgtgcccagctcatgctgtatactccaagaacgctcatttcacttgcatgtaacattcattttacaggaagtacttaggtaaaggaccggcatcatggaaggctccaggagtggaaagaatggtatcttgtcccgataccattcgattcagattgtgctattttgtggttgcttcgattttgtttaaaggaagtctgactctttcgaaagtccagaacctgtatactaaaaaaaagatccactcaaaatcaaaaaggcagccatgctatggcccaggatacaagggctactttttgccatctaggtactgctatttggccaactttcagttagctgtggtggaagacagcagatgtggaaagacttccagaacaaccacaatgaccccttcttttccaaagtcatcaggcactggccattcttgtcaactcagttttgtaagcaaagcaagagctcctgatttccatatacctgctttctggggggctagggataagatgggcaaaacactgagcagagaaaccgtgcttgcctgtgttggaaagctctcggtcttctggtcccaagggggccaaaaggaaatgaacttgtatcgtgctttgcaaaagcaaacaaacaacaaaaaacggttccctgcacccttcctcctgtacccctgcccacggcacttctgcccttccagattccttgctcactctcctggaggatgcagcaagaggccagaaacaaacagatctccattttgacaatccttatcaatgagaagcaagctcttagctcaactgcccacactccagcaaggcaacatggctgaaactgaaataaaactccactgagtgctgagaagactcgagcccctggcatggaagccttaggctgaaatccttggttgggttggtctaattctgaattctagacaaatgaaaataggtcaagctcaccaactgtcttctagcacttctctcagacttaaggggaaaatggtctcttaaataataagacagttctgagaaactatagttgttttggaagtgtttaaaacatttgacatgaagatcttaaccaagtttcctaagttttgactgaattgaaacaagagtcaggcaggaatgtgtgatgcagttttgatcccagcacctggaagatggagccaggcagatctctgtgaggttgaggccagcctgatctacatagctagctccaggctgctgaggctacatagtgagatctggacttcagtcttggccttagtttatatagaagtatcacagctgacctgaactcagaactccaaaagacagaggcatttgcctctgtagggaaatgaaggagcggatgcccatgcttgtgtctaagagaagcaaaaggctccctggctctgcccttcagaagcatcgtgagtggttgaacgtgtgagcatatgggactctgtatagggcttgctacttttgctgattttttttctttgcaagtgtcttgtttgttccttctcatgggttttgcctctcccctcaccttgctacctctggaggtgttcccccccccaaaagattgtaaaactgaacgcttagaccgcttgaggtggtttcagttgcctgaacccttgttttcctctgcaaaactctgtgggcccgggatgtttagaacatttctgcatcactatgaccctcagaaacccattagcacaaaaggatttggggcagagacttcacagtcagagaaaagacttaggcctgggaatgtccattcagtgtttgcaggagtggacctagtcctaaagaaaccagactattggggaaaagatttaccactcattgatcagcacaccaccaagcatctttctaatacttaaccttctcttattcaactctcttccctgggtacaatgtatgctgccggtgaggatgggggaaagttgaggagaaactcttttcagggaggttctctgggaagttgcttccagagtgatctctataggtagaatagacagtaagttggagggaactcaaattggccccaggtagtcagcctctgcttcaagctatttgtattcccctgtttccctccagcttcaatctttagtggtaggtggctctgttagagtgaatatagacaaaggttggcaagacgcccccccccatccccaccccaagatgcaattaatgctttgtacttggtgggtattgatttgtggttcaaatgtgagtggtggagagcaggctagtcttagtacaaaggctgactttgcttgtggctcctcccctttgcctgtactcctggcctgcatgggcctccaacttgtcctccagtcctaacacccgtgaactgcactggtaccaacagctcagccacaaaggagtcaaggccatgggcagccaatccattcctgttagcttcatgaccccaaggttaaggttctgccaacaagcattctgcctgacatctactttatctagacaacccagatccagttgtctccgtaccttgtcactctgagcagatctacccatgcacctgtccacccccctcctcctcacctttgaaccagtcaggaaaaaaaaaaaaaaagactagttatctatcaatcactcagtgctctgttgctcactgctccgccctctatgttagccaagtctgtggcacaatggtgagcttttcctttgctatgatttgccagggccaggactagggtgaggcgattggggagacgcccactctcaaggcccccgccagtgccttacccttgccttggccctgcgatttgcactctgtaaagttgtatcggttactcttcctgagtgtagttgtgatttggggggcaggttctgcaccaaatgtttctttgctgtttctccatttgttgccagaagcctttgtatgcctaagcattagagaatcttaagtattatcacaagcatgtctaaatggcctgctccagctggcaaatgagcaccccggtcaggaggaacactatggcctgagcccttcaacagtcagttgggggtctgcccctgtgaccttctgtctgttctttctgcttcattctcccttgtagtccttgtggcccagcaccgattctcctcagtgcctcctactttgttctcctcctaagaagaaaacatgctctcaggaaagggatggattcgtttgctttgagaccgggaggcttaatgctaccttttctgagggctgcttgcatttgaacaggggaacagccttaagccaaaggaatgaagttcttgcagaatgttaggcatcaactacttgtacaagttcttttcaccatggaaagaccacactccctgacggctgcttccagagcagagaaaacaccgttttctcctggaatcattgtagttagtagctgatggtcaattgtctagctaatagccctgtgctgttttcctacaagggactctgagataaagctacttaaaagcctctgagaaggcctgtaccaatcattcatattgtacattaacatgtttgtggaaatgggattaatattacttgccgtttaggtaaaagacacaaaagatttaaggagtttgtgaagtgtgtcctgtttgtgcaaggtgactctgtcgaatccgtttcttactgatgtcagtcgtccaatatcagtggtggttattgattggttggaggtacagttcctaagcacaggcctccactcccctcctgccattttgtctctgttttgtgctttgactccgccttggtgtgagaatgagaccttatctaaaccagagcccccagtcccttcaatgcctttgcatgtatttcagctataagtgaccaagatagtaagaatttaaaaggacaagagagtaggaaagaggtacaaaatagtgcctttgtcaaaagtcagaaaaacagtacgatgatttttaaattacacaaaagaagccaagtcaaattattttaaaatactttgagatcaacttatggaggactatggtggtgagtggtttttagacacatgatggaggcactttaataagtttagcaagaagaaatttgcctagtaaggattctgtgaaataagtatatacttttgttcagtaaaggcccaaatataggccactggttctcaaagtgtgatcttggaaccatcaagagcaacatatgagagagaagaagggggaggagcgggaaagaaggaggggagagggagagagagattactccttcaagccccccaaatcaccagagccacacctctccaacaagctaccagtctttcctactgttacagttaccagtctctggcaaagaggcatgtgtaccatcttggtcagctacacgtttgctcaatgttaagaaattgccagattgaatcaggcccatctgtcctggattggtttttaaaataacaacaacaacaacaaaggggacagtggtggttgccgtggtcccatttgatattaccagcccttaaatcaatgtcctcaccttggtgactgttccccaggagggctccagcagatttgatttttgttgaggttctgcttaatgtaaaaagtgtggcatttgatagtattgaccttctccctacagggaatcaaatgaacaccagaaccagggcagccagttaacccccctcagcctcttcgtactgctaagctttatagaattattccgtatgtggtcttgagattttctatgtccaattttataagatgttctgcatgcaaacacaacattgtagtcaccgtaccagtcacctcaaagccattcctcctccatatgtgtgctggtgaagaaataccaacatgtatgttctaatgttttctgatcagctgtaaattacattttcattaatttttaaatgagatatatttactctggctagcagttaaaattttattctttttattatctttcattgctacttttttctactgactccaaggcttactttgggggtgggtgggatttcttatttctagattgatataattctcttatttctatatttatctataatcacagagtgtaagagctgaaagggaccaacctccctcttttcatagaggaaattaaggcccagaagagtcaagtggctcactgaaggtcacacaatgagtctgaggcagggcccagcatcaattctaggtccctggtctctgggatgaatgtcttgtcatttaaagcactatatttatgaaggacccatgactggcttctacttgtctgacattaatttcccgggtatttcagtgaaaaaaaattctatatgctttaagggaacatgcgcaagcgttctttagtttatgaatccaaagaaaatctggtttttagtttagaaatgcatctccctccatgtttgctatctgtgccctacttcgtacaggggatgtttttcctaagagctatgtagaaaaatggatttatatagaataaatttcatttttagtaggaaagcttccctatgtaagggaatcttctaggggattcttttggaaaaacaaaacttttcttgtcatttgttctttaaggtctttaattctttattagtgtgaatttttgtacttgctgtttagttaaagtagggcaaagcagtgttagctttcccagaatttactagaaccttaccttcctcatctttttgtgaaatcttcagactgtggcatgcttatgaactactcaattatgttctagaaacttcacctcgcttgatattttaccaatccctgggctcaaaattcctccttgatctgatcagatactaacagagctccctaatcagtactcatctctacatgtggtctcttttccagaacattctttgccagtattccttagtgtgctcttcctttagccatctcaggcctccttccataaatcacacatacctcactgtcctatggaccagcaggcactataccttgagggttatgctatgatgctgaggaatatttcctgttacttccatgttctcattccccttggatcttctctggcttccaggctcaatgaacttatctcaccagagactgatggtttggtttttttttgggggggggttggttttgttgttgttgttactgttgttgtttgttttttccattgtttcaggaaatcaataaacttttttctacaaagggcctgggagtaactattttaggtttttgtgggtcacgtatgatttctggaacagattctttttttgtgtctatagttgtttgttcattcacttgtttttacaaccttaggaacataagaaaaccattctcaactcacaaaccatgaaaggctgaccccctgaatcacactttcttttctgtgaccagccccatgtgtaaagtgggtgaggctggcacgatgcctcagcatgaacaggtacctgccaccaagcctgatacactgacctaagtgagtagaacccacaggtagaagaagagagtcaactcctgcaaactatccgctgacctctgcacacgtgcagacacacaggctcacacatacaaatagataaatgtaataatttacaaaggttttctttaagtgagtcttgtactaaatgctgtcactaacttccatccgaccattctgtccacattgggacaagtacaggtctacacatgacagtctttctctgtgtccccctattattcatatatatatatatatatatatatatatatatatatatatatatgaataatatatatatcaccttatttccttatatggatctgttccattcattgtgtctctgtttgcccaagattggggtaaactggtaggaaagtttacttagaacttttgtcctgtccttgctcgtcctgtcttggaccacctgtcatatcccacactaccatcaccaggttagggtgctgttattcaaaaacacatgctataagattccacttcagtttacaatttcctggaaaaatcaccaacttcctggttccataggctgactttcaaacccagaatacacacatatctctgtcctaacgcaattgatgcctaccactggacagcatggaaccccagcaaagaaaaaaaaacagggtgcaggaaatatttgtgccaatgtcccctgcctcctgagtccccatgacctagagtgtgtcattacattcctccaaccaacccaacacaccacttcctgttttcttaactctatcctgctcccatcctacccctcccactttcaggaactggagttcagattcacagttctcacactgtgtgcacccatggctgcaaacattggaaagctgtgtgtgttttctgcagctggctgtgaattggacccgagtgtgtgcataacatacagtgctctcattggtcctctgcttcgggaccagatctcaggaaagtggttaaggaagggaatggcagagagaagggtcctaatgcatatctctctctctctctctctctctctctctctctctctctctctctctctctctctctctctccctccctccctccttcctttctctctctctctctttctttctttctttctttctttctttctttctttctttctttcgagagcttctttgcattagcttgtgctagctgactcctctcctatggaaccatttaaaggaactcctctgtgtcattcctgggcaggacagcatccctgcccagtcaggatttgtattgcatgtggactcagttactgggacatagatgtggcttttcaaactcaacaaactcactccttaggccctttagcttgatttctgtcttttgagcccagggatccatctctttcccgaaatctaaaatttcaaacatcagaatcaagtaagtttcaaagtaactttcaagcacccatgacatgattcatttctgccttctgtttaggatttccagaagtaggaagggaaggaaaagtgggttgtgccttggacccaagaggagctcaaaagcagagtgaggactaagaactggtcagtcctgctgtgcagccctggtacagttgtgttgggttagtgctgcactcggtgctcctgggcccactatgccctgaagacaaatgccagatgagaatgtacagactgatgacctgcactgaaaggcaagggtaacgcccacccccggggtgggactgtatcctggattcccgttccagtagcagtaagtaggagagatcacaaacccagtctttggaggattccaacacaaactagaagagagccctctgtgggctgatattacaaagcggtttcttgtctttctttcctttttttgttttgttttgttttgtttcgtttcgtttcgtttcgttttgtttcgttttaagattccttactggcttgctaccagcaattgaactgtattattctttatagagctagagctgtttgttgtcttcttaaaaataaacctttttctgttaaaaacca

SEQ ID NO: 590 - DNA, 242674 bp, mus musculus; identical to SEQ ID NO: 589

SEQ ID NO: 591 - DNA, 242674 bp, mus musculus; identical to SEQ ID NO: 589

SEQ ID NO: 592 - DNA, 100251 bp, mus musculus
gtgcagcccgcggggagccggcgctgcaggctgtgaagccgcctgcccgcacagccgcccgtgcctctcgctcgcccgcgcccgcgtcccgggccctgctccaccaggaccgccgctgcctctcaggattcccgagtgccacaaggctagcggaccgggtcggtccccgcgcccgcgcccgggatgccgttctaccggcgcactgtggtgccccagcgtctgtgcccgcgcaaccctccgcagccgctggctgagctccgcgacgtgagccacctggccgcgctcagtctgctccgccagctcgcagacctctgcggccactcgctggctctgctggaggacctcgaggggcacctgctggctctggggcgccgcaccgacagcctgtaccggcgcaccgtccggctccgccgccgccttccctgtcgcctgcttggcccggaggatgatgaagaattgctaggtaaaaggcgcgaggcgcccgcgaccctctcccacccgcctctggggatgtcccgctgggtctgcccgtggccgcccctcaaagatcgagggacacggcctccaggacgccctcccgccgtccgatccttccgggatccgctcgcccggtcccgagtggccctctgcttaggtctgggggctgccgccacctctggagtgcttggtggagagggaggggatccgtagggtcctgggcggcgcagaccaaagagtcccggtggctccgggaaccgaatggccgtgcctgcgtctctcctgatgggccactttggaaatcgcgcccgagctgcccgcctgcctcccgggcggcgggggccgctgcagccagacccgtgggacctcgtgccggactgcgaacgggcttcccgcgcccagccgtctccgagctcccttcccgctcgcttctccccgcacactccgcgttgcctcgctgggagtggccggcagggggaggggagactgcccagggcttagcggattccataccccaaacccccgccccagccgctaaggtccggctgcccagatttgcgggagagaaccatttaaagagactgtcatcggttttcttaaaaatgtgctcgccagccatgcccgagaaacgccaggtcccgggagtttccttactgaacactaggaacctgtgagactggaggcgggcgggagctcaggctctttactactttggatctcaacactttggatagggaggacctcttctgcaaaaaacgcagcgttcccttagaatgtgggacttctcttaaacggggtcggggctgagtatgtttaaaaatgctgagagtagaggaggaatggcaggtaacagggccaattgccacctagggaaggctaggaaggggtgtcgggggagcagtgtgccagaaagtttcagaaggaggtggaagatggctacttgctgacttttgagggaggccttgggagagaattgtctgggtcagcctttcttccttgcagactccacccctaacaaaatgacaggagtcagaggttctggcgcccctcttccttcataaaggtctctgtcctttgaggtagatggcagaggtcactgctagagaaaaataaactgaatcctttgagcaaaggaaggtggaagacacagatgactgccagatggaatgtggccacgggaccagaagcctctgggaggtaggggaccaggcaagccaaggcccagggtctggctccttctcagttaacaaagagggtaagaaggtcattgtttttctttccctggggtcccactgattaacaggattagtctaggagaaacttgataagacttggagaatacttttccaaatctctgtacagcctgcggtgtacagcctgcggtgtacagcctgctgagagccacctactgagttcagcagggtaagttgaggactaggaggaagctctgcttttccaaagtatagctttctgtttgctgagtcagacagcccttcccatgggctggggtgttgggatagcttcactaagtcacttgggggcctaaccctttctagtgatctattgggttagaaagagatagttttatgctgcaggtatattgttaaaggggggaaatgacacttaagataagtgtcattgagttagcctcttggaagcttgcaagagctgagaatgggtctatctcttttctttagtgtggtcacttacctttgagaacattcatgttgcttggccctaatgcattccaagaactactgcacacaccaaaccttctgtgagtctctaagaagagctgcttttctagtttgctgccctagcctcttattgagattcccagtgtgcacttttcagtcgctgggatgaggcacaagtgccaagtgcaaagagaggtggggagcataatcagagagagtaccatctggcacccccttgttgctgaggcataagcttcaacgaggtgtccagcaggctggatattacattctgatcataaacaaacaagcagacattgtgaggtctagtcctctttgtttattctttctcgtaccctttcctccctgcatcctcacacctttactgaccgtcatgctgagggtcagctcttcccgttaacagtttaccctgtagactgcctatctagcaggacttaccttcatattcttcctctagctgtttcttccaatcctagtgggaaagaaatctgggaaggagggaggtttggaaccatggccagagtgaatgacagctgacagaccagcagcttgttggcctccctgctgggacaacttggctgccactaaaggactgaatagtgacaagtcacactgacccacagcatgcaggctgggctggggctctgggaagcagcaggggaggacaggacaggagggaagttagaagaggagaaagtggatgcgaaaggatcacccgcttctttacactgtctcaggtcaagctcccaccatcttcaaggttacaggggtgggactggactagcttggttgcctggcaacactccccccaaaggctgctctttggtaacttgagcccctttgagactgccctagaaactcttgtaactggcatggggcaggggaagagggcccactcagctctgaaccaggtctcttgtctatgaatctatggcagttgccataccaaggcatgaccttgcttctaaatagtcccactttcccctccccacatatggctttggatgtgacccattttgttgcatcctgtggcctttactctgtgatcttctcaaacttgttatggtcaaagccagtgggaaatagctccatgtctgctgccatgtgctgagtcaatccaagcaatcctattcctccctcagagatctatttaatgtttgtagatgcttacatgatgattacaaaagcaatcagggcatcagcctaggggtataatatctcctttaagatctaggtagtaaaacactatatagctctaggtatgtttagtttagtttattacattttatttattgtgagtgcacatatcacagagagagagagagagaaaaagaagaaggaggaggaggaggaggaggaggaggaggaggaggaggaggagaagaagaagaagaagaagaagaagagaagaagaagaagaagaagaagaagaagaagaagaagaagaagaagaagaagaagaagaagccgccacagtgcacatgtggaggtcattgacaacttgtggtatttggttctctcctcctaccacatgagacctggcaatggaactacagttatcaggttcagtggcaagtgcctttaccttcagaggcatctccatagcccctctagttatgtttcataatactggagagctattgtttctcactagcccatgtattttctttgagaaatatgctctattgaatttttgcaattattttggcttgactgcagtcagtgagatccacagcagaacccccctctttgttaaatacctctgcctctcaatattccaacattgtggcaaccctggctgcaaaccgtaaaggacagctggcttattttgcttgcaattatagtctggagcatgttataactctgcgtcgggtgaaaaaacaggaagattgcacctcttgactacacaagtttgctatgagatgagatgttacactgttcttgcttagaagactgggacatggtctctggagtcagatggagcttaggggatcttgggagacttgagacacacttttccaggactgattttgtctttgtcttgcttgtcatccacagaagttcttgggacagtgggttgacagaaggggttcgggggtgggaaacaaacctactttctttaatttttttcctccccttcccattttctctttaaataccatgaaaatcttggtctgcttcatggtattttcatttgttgaaaacatcttctctggaaatttgaacaccaaaatgtccactagaatttcctctcctttagaaacaagaaatgtaatcttctccattttagacacgcggacagctaaagtgacaggagcgtcaggatgtgaggccaggagaataccagaagacttgagctatggcttctgggctcacatttgactcagatgaaggtgatcaggtttcaggagaagagtggcgccttgctggcatctgtccctgtctgtacctctctgccttcggaagagtctgttcccactatatgaactaaaaactcagtcattaaactattgtgagcatcatagcgcttgacagctaagtttcactcaggaagagggaaaggacctgtccaaagtcacccagacaaatcaagcttcttagtagcatgggcctcagattagaccagtcattggttggcctcccccacaagttctgtgccaccattgccccagcacatcttgcaggcaggacagattgtagtttgaaggttgagtactaagaggattttagtgcctccacatatgtgaaaagggtagaaccttcaaataaagcattagtcttttgaaatgactcaatgatcaatgtttaaattaaaatagtttcttactagattaattttctccctctcctctctcttttgtattcctgttgtttgtgatctacaaatgtattcattctgccagtgtggcaatgtggcagtggtcaagtcacagaaaaagtcagtgacaaaagttcttgattcagaaggggcttctgacattctaaaccagtgttctgacctctgccatgacattgtgttccaagtcagttcattgagaagccctgctctggcattttctttagctggaatttgtccagggtaaggaatgattcccgatcccatttactccccgagggatgctttaaagaacagcccccaacccatggttgtagggcaagctggagctggagaggaaggatgcctaaccctgcatggcacagagagcaggtgggaggcaatgaacgcccctgttaaacctttccgtttggagtgaagtttgctctggagcaatgctcctcagatgggaaatggtagttagcctcggacacactggattctgaagctcacctttctaccagggcttttttgtttgttttgtcttgcttcctggtccttctgttgtctttattctggctaaccacctttggagattgcagttctgtcacgagtatgaggctacatcttggctattttctgttgctgcagtagagagtttagttggcacttcaaaaagcatgtttattaaaaactaaggggaaaaagaaagtcaaatgattgccagaaatgcatttagcatacgtgtttccagggatggattgcttatcctgctgtgtgtaagtagcttaacaggcttactgcctttgctcttctgtactctttcagaggccaaaattcactttttctttaaactttgcagctttgaagagtaggcagaagtttgttttggttcttactgttgtgctggattctagaaactgacaggcaagtagactgggtctctcccttcagagtgctcctagtctgcagggctgggggccatctctgttccacactgtgtcagcatggaaccgggagtggaagagagcaaaacaaaacaaaacaaaacacaaaacaaaacaaagccaaaaaacccaaaacaaaaaaccaaaccacccccccaaaaaaaaccctgataaaacaacccctccaaaaacaaaacaaaacataacaaaaccagtcttctgaaagctgaagaaagctaacaaacagaatcaagatcccacctcacaccccagcttcaactcagtctggtttggggctcaaaaatggagttagggcttccagagtcctccatggtaacaattaaaccctaacacaatagaatgctatcaacaattacattttatgttcaaacataagaatagttggctattcagcacataggcaatgcttagtgggtctggagtcatcacaaaccttctgtggtagcatagccttctagatatgttctgctccttctgctcctagttgggaatgacaaattttatgttcttggtttaaacaagaaataagctctttgcataagttcattaaggcaaatttattttatttttatttattttaatttttatttgtgtttctctctctctctctctctctctctctctctctctctctctctctctctctgtgtgtgtgtgtgtgtgtgtgtgtgtgtgattatgtgcaggtacacatgtacaaaggccagagatcagccttgagtgttgttctctttttatcctctcacttgtttttgtttgttttgttttaaaataatttagttttataattacataattttccccttccctttcctccttctaaaccctcccatttaacccctccttgctctttcaaatttaaggtctcttttttcattagttgttgttacatgcatacacacacacacacacacacacacacacacacacacacactcctaaatataacctgctcagtctatataatgttacttgtatatacgctttcagggctgaccacttagtattgcataaccagttggtgtgctcttccctgggaagactatttctcccactctcagcatcccttagtttcctatagttttgtttgttttgtctcgggttggggcctcctgagctttccccctttcatgttagcacgtttatcagtctcatccttgttcagcctcatgcttagacagtcattttggtgagactttaggatgttttgtttaggttttgagacagggtctctcattggcctggtattaccttctgaactatcatctccccagtttacttttaattaacccattaattaacttggtgaagttggggattgaacccgtggcttcatgagtgataggcaaatggtctatcactaagttatattcctggtccttaggttttattttctttattattgtgtttgtgtgtatgatgtttatgtggaggtcagaggacaccttttgggaggtagtattctctttccaccatgtaggttttggggtttaaactcaaattatcaggtttgtatggcaaatgcctttacccactgagacatcttgctggccttattatataaaaaatattagataagagtgtgataattcagttcatgtgtacaatatgtaatgataaaaattaaggtaggtaacatttccatctctttacccatttaaaatatttattagtacatagtaattgtacatatttatatacgatgatgtgatagtctaatacatatatttagcatgtactgatcaaatcaaggtttttgtttctgtctctttatccttagtctgtgtttggagacttcaagagcctctctcctggatattaaaaaaaaatacatataaagggttcttgtgaactgtagtgccccctctgtgctgaagaacattagaacttaatccttataattgcctgcattttggtgtatattgcccagtttccctgtaaaactcctcccccatcatttccaccccctggtaatcactgctttacatttagcactttaaaaaaaaaaaccttgtatgtatgagtgagagcacgcattgtctttctgtgcttggcttatttcactcaagataatgctctctgattccatgtttactgcaaatgacagtgcacggaggatggcagcatcctaatggacaaggctactttgataatgccacagttgggtgtgacaagtgtgtattggtataaatagcttacaggaaagcttgtgtgtgatgggtgttggggctgggcatgcaggagacaactggataccaagccctttaacatggaaagtttgtgcactcaaacagctctccatcctttcttcccacccttccgacagctcccttctctggaaattataagcgcctcaatatagtgtaagacctttgagggtacggatacttgtgcgttcactgctgtttctccagctcctaagtcaggatttggcacctagggtactgtagctgatgagatgaattccttccttcctcttttctagccttggcccatcctgtgatagtttctggtaggtggagatgaagtagaatgcaggtccccagcccattgggaggaatgattctactgctgtgtagatgaccgaaggatccagggaaggtgaaagagacacagcagactcagtgcagagatgtgtccaggaggatgtgatgtctatgtctgaaagacagtgtgcattattgtgacaggggaagaggacaatgtggacttctagttcaggaggttatctaagctagtatagggatgtaagagggagctgatgtggggagaggattagctggagagattcaggagagaacacaaggccccatcacagcagcagaggtggggtgagggaactccttacatcctgtttgttggtcagggagttagagagtgttaggacggtaaaacaaaaaggtatggttaaattgaagctgtacttttgaggcagatagggctgaggttacctggcagagccacagtatctccctccctatacccacccccagcccccaaagtctctagcaggagggaccttaagaaaaagaaagaaaaaaagtctacctgcttatgtgtctctggcccttgagaccgaaatctattattcatgccagttttgctgtgagttggggcgtttgactgcatcttgcgttacttttttttccctaaagaacacagattctttggcgtgatcagcatgttctctatgggaaaacaagaaaaatagttttcttccctttttattttgtggtgctgggaattgaacttatatagggcctacctcatgctagacaggcactccacactacatcctagtctaaacaaaagcatctctccctttggaaaacagattcaaaggaaggataggtttttaagatccattcctttttttttctcttcctttgagcagattcatttgctgccgagagccgtgtaattatcctcctgacaatttagtctggttcctcagtataagcaaagtaccaaacaaattattccccccaactgggaggctgtgaggtgactgaggcctcctaatgttactatactcagaggctcccttcccttgcaggaggtagcactgcagagctgctagccagatagctcttgttatttatgatgtgcctcattttgcccagcaattccatgtcaggatcttatgctaaagaaaaatcagatattgcaccaggagacttggaaggatcttagctatgtagtttgttgtttgtgttaacccaagaaatgaaacgttgactaacagtagagtgcttatgtaacttttgctaggtctatgagagaagtgataaaatagtatacagctatgaagaaccatgctgcgaactaatatgtcttagttgactgatgttctgagccacaggtctttatgtgtaaaatggggttaatactacctatttcagggggttatttccagggtctaataatgtgtataaagtgcttggtgcacagcccacaatcacacataccatcaccagatactacccagaaaggtacaatttttttgaagttgttatttatttatttggttttgatctaggatctcacaacgttgcttaggctggcatgaaactttctgtcctcgggcctctgccacatgagcgctggaattacacccatttgccaccatgtctggctgctttgaaggtttttgaaacccctagatggagatcctgtcaagtctgttataagaaaaacgtttcctagacagctccaaattacagccattcttctatagaacttgtggagaagtctcatgtatgcacagaggagcgcatctcacttctggggctgtcagctcatctctcccggccctgggattttgcttccctttcagtccttccttcattctcccccactgaatttgttcaacacctcactgccaatcaagggtagggggcatcctttgtaattgaagcaggctgtctattgagaatgctggcagccttgggatagtcattggtatagattgatgcctgctgacctcagacccagctggctaggaccctggaggggcattaacaaagcagcagagtgtagattctgatccaccagtctagtagctgcctttgcgagtgtcttgttagctctgttctagtctcctggtatggggaggggcatgtgtcctggttttgctcactagttttgcagaatcaacttggctaagggtgaagaagttttttcctcctaaaacatactgagcagtttgcctgaaggttcaacaggtctatctttcaccagtgcttatacggagtaactcccaatctcacagccaagcagccttgagttcacaggaactccttgaacatttgggcattgtctacaagatgcccaaaccactaggcaattctgtcatctccttggacgtgccccacttataaccagaagttctagggaacggtgttcaggaaccagtatgttttaaaagtttccaaatggttataccatacagctggggatgaagacttgcattatagatggctaagatagatgtcaccaggacagagtttgaccacacaatcttcctcgtctttctgctccttttccttctctttctttgctctgctaggggatattttgtgcatggttaatgctgccagtgagctacatccccagtgcttcactatagtgttttatatattatatttgtggatagataataagcatgaagtataatgtaaactgaggttaagacagggggcaaaatggtcacacgtatgaatcaatcacaaacagccatgcctccaaagttgagtaatatactttttaattttataagtgaaggaagataattagaaaaaattacttcatcagtaaaaagagtatatgctatagcaaaggaaaagagctttcatctcatgttgctttgctcatgttatcaaatccttgaacattttaaatgaagacaacgtttttctttatgttatagctacatagcatcacattttatgacactgggctgggtctctaccttcaatcaacttttcaacaaaatagaaaagatttttgtttgcatacttttttgggaatccaggcaaaaggaaagacattttcactttatagtttcatgcttcaaattaggccaggcctgaaagtacaaactgaagtgaaatggttgcttctgcatggaaacaggcagttgactccatgctctcctcatttggtagtccagaccatgcatataggttattgtatcatatggcataatagaacaactgaataaacatgttcagtattttcaaaccatatttacttgaacagtttcgatttatctttttcatgttttattttgtttggttgggggtgttgttgttgtttttgagacagggtctcctgtagcccaggcttaacttgaacttaatatatatatatatatatatatatatatatggatgaccttgaactcctgatcttcctaccttcacctgctgggattacagacatgcatcaccaagccctgctcaaaagatgcaatttagaagacagaatagctgtcctttcttcatgatacctacagaaatacttttagaatgtggatcctggccaacagccacccagagaaagaaggaagcctggtccaacagcatcttcgatgttagtggctgtatttgggcttcctatttggaacctcctctgtagctattttggggtcccaagacttatttgattctgtcaacagtcactgggaaaatactggcacagagggtataagggggagggggacactttgagcatgctcatctcagctgtgatcagagaagaggtgctataaagggaacccccacaatctctctctcaagcagccctgaaccctggggatgaagacaaggcagaaagaaggattccaaaagtattcaccaggaggaaatggtggctgtttagagagactgaggcccagactcacagataaaataagcgtcttgcgctgtacacacatcccaaagcacttcgtgatactctagttctatgtataatttctgtgctttcatcagttaagattttcaattttcaccagcaaaagcacacactttaagtttaaaaaagaggaaggaatctatttatgaaggttgagaagtaggttttaaggcactgttccgctcaaagtgcgacaggaaaggtcccttcctgtgatgtgggaacagtgcagctcagtgagcagaactgggaactaattttgtgaggatttgggggtagtgaaatctttccgtgttccagattctgggccagattacctctttgaataacaggttacataaatttactccccgttgtgaaaatgcccagtgaaatcttttccttataactccaagttaatgaaaacagtagaattagggaattagggaacgagtgtcaatcgtgtgcagagagcttttgtattttgtgcccagggcttcctcactacctgaggcatgtgaagagtgagggaggaggaaaggagtccaggtggtgaatctctttgtcgtagggaacatttatggaattccaggtgccaataggggctgctagcatatgtggcagataggtgtcccctgtgggtagaggggtggcaaaaacagtgcctcttctaggtgggcaagttagggagacattcctttagagataactattaaacgatggatcagcatcttggcggacccaagcttaaaagctgtcttctccattacaactaaagaaaagtacccttcttccatgggcagtcagacagacaggacaaccaacttcactgaactgtggccacaatttgaaactccttttcaggagccccctccctatagaacaacactgccaggttctctgaagcaccagggacagagattggtcagatagaccccgtttgaggaatttccaagcttgcccctccaactcctatcttattgaactagcctgatcttctgccagttctcctgctgcccatccttccaggcacagtcatttggtggtagtagactggctatccctcagatgcccaggtgccagctacagtttgagggaggcatcagccattcctctgtctgtggctctactctagaatgaacaaccagggctacttgttaactgtgactaaaacactgctttgagatcctggatgggaaaatgccactatcatttcttccttcacaatggtttaaaaacttgactgtgttctcttgaaatgagcttcaaagtgggagtttagagtctcgtgtggtggtgacttaccatgcaatcttagcacttgggaaggctgaagcaagaggatcaagagttccagaccaggcctggactctataacaagacactgtctttaaaatggctgagtttgggcatagctgagatattttcccttttcatgttcttgtcccttaataaaagaaagcagtttatctctaatctggtgatttagagttggctccaaaaactaattcctaccccgatcgtcacactaagcctgtgctggcctctgtgccagatattgctgatacgtaattcttaagagttgcctttaactctggagtcttaactctcagggagatagtgcagaaagcagtgttactgcagacacccaagtcctgcttggaaagcactgggcacaggggcagggaaagcttccatagctctttcctcttgttctccagaacatttattcatccttccagacccacactcagctcctgccagttctttccagccttctgactccctctgctgtgccccgactccagtttgcagccacacttcctccagtgggggatgctagtccatgcagaggctgccaatatgtactgacctttctcgaaccccacttttatttccttccctttactacctcttgaatgcaatgtaaccctcagtcataggaacttggaagaacactctggtaactcctttcttcagatgagccaggagctggaagttagagcagtctctccctggtggaggtaaatcttgtcttgatggtggtagggacttggacatagcatgcagctgctggagcccttcagatcctgagggcttgggacgaattccaagtgtctccctgagccagacttcagtcaagtggttgtgggtagtgagccacagaccttttggggaggaagaagccccgttgtgatggttgtgaagtcgcatgcctttgcttatttggcctctgataggagcagagtcctggtatcagctcacaggagtaacttttagttccgagcctctatttttcttgtcaggaagagcagaaatactcctctatggaaaaaaaaaaacctttggaaacaaaacctcatgcctacaatgttacatattatccttgaggaaaaggacagtggctgactcatccatctgtcttcaacatctagttggaaagtagggatgatgcaagtgtttgttgaatgactaatggctgcttaggagatgggtttttaatttttattttttatttattaactttggcttactacctaataaatcctctgtatcaatgaatactttctcttagacaaagtattagttactttttaattgctgtgataaaacaccatgaccaaggcaacttataaaggggagggtttatgtgggcttacagttctagaggtattggaatccattggcaccatagtggggaatatggcagcaggcaggcgtgacattagagccacagctcatgtcccgatcctcagacaggaagcatggaacacactaagagtgccacaagtctttccctttttccatttgttattagcttatttttcacacaatatattttgaccatgtttccccctcccccgactcctcccagctccccttacctacccaacttcatgttccttgtctctctcaaaaacaaacaaggaccatctcccttcctggctcaggattctatgcagagggaggaggtggaaagtctgtcagggtctgaggtggtggggtgactcctaaagagcagcagcagccagactcagaaggactggtgcatggatgaactcacagagacagcgacagcgacagcgacacagcagcaggcacaagacccgtacaggttcaaaccagacaaagttccagccttgagaagggaaagggacactaaatcccacccctcctgctgggagagggaaagtcagttttctccaggagctgggtgtgtcaacttcaccccagggcagaccccatggtgaggagtacttagttaacacaaaacaaactctgcactttggttttgggtgttgcctttttgttttgaagcttcaagcccacccccacctccttcaatacacctccaccaacaaggccacacctcctactcctgttgccctaactgggccccagtattcaaccatacgagcctctatggccattttcagtcagaccagggcagctcctttgtaacttctgcggttaccaatactgtgagtctcacaggactccaatactcaagaggacattgatgggctctttgctattttgcctacaataagacataccgctgccatgttaatggtggcttccaggctgtggccttatttcatttcatttcatttcatttcatttcatttcatttcatttcatttcatttctttctttttttttttttttactgtgtttgggtattttatccatgtgtatgtctgtgcactgtgtttgtgcctgattcctgcagagaccaaagtaggacattggttctccttagaactagcattacaggtggttgcagaccactgtgtggctgattgtaatccaacccagttcttctggaagatgctcttaactccagagcatcttcctagccccaactatgaccttttacaagctcaggtctcgaaccagtttcctccaggctgcgtgtcccttccatgcccatgcccccaacccaaccacagtgtgcagttttgctcaatacccactgttaccagagtgtggcagttaggctgcctccccgcagcccctgccgccgcctttcattgtgctggtggttgaacctagagcagaacacacggtaggcgaatcctctagttgtgagatacccccagccatttaaaatttcttttttaaaaactttgatacagagtctcacaaagttatttgagctactcttaaactcactgtgtaggccaagccatccttacatttatgattctcctgtctcagctgtgccagtgggccatgtaccccatcttatttttgtacaccttttctaaacatacatttatatctttttatttagcataaacacccccaatttttaaattggaaaaaagccctttgttaataaaagcatggctcatattctgatgtttaagagcaatatgtgccttgccaacccattttatcctcaagggtttcatgacagagtcagccattgtcatctccatcttgttggtgaggcaacagtctcaaaagagaggaagtaatttcctcaagggtcagaaggactgagagttgcagagactgtgggcaagtctatcagggtattgtcttaattagtgattgatattaggtgtggcacggggggcggggccactcgtgggcaggtggtcctggagtgtataagaagtcaaggtgagtgaagagtggggagcaagctaggaagcattgctcctccatggcccctgcaccatcagtccctgggccttgctgccttgacttcctcctctgataggaagcttgatttttctatgtaagagtagcacttttgcacattgttttcatttatgaagtgtctttacatatattttttcatatgggcctcctgtgagaaatggaaaaaatggattcagagagattgggactggcttgctcatggtggcaagggaaaggctgtgaggaccaagaaccatttgcaccgctttagatgccagagatacgagtatataagatgggcaaaaaaaatctttgacctaacagagtgtataaaatgaagtatgtgtttcttttcatttatcctgcctgtcaggcaagcgatatcgattttcgtttttgatcttggctgtgtgctttcgacccacctggcatgcttccataaaaacaatgatgtctgagggcaaactcatgtgtgcactcaaattttacagctgctcagcaaggagtgagtgtgcaactgagcttgagaaggcttggctttgagcagtgattcctgaaatcaccttgggagccaggcgtggtgatgtacacccagagtcccagctagttggcaggctgagacgagcaggaaggataatttcagcccagactgtgcaacacagcaagcacttgggaggcagaggcaggtggatttctgagttcgagaccagcctggtttacagagtgagttccagaacagccagggctacacagagaaaccctgtctcaaaaaacccaccaaaacaaaacaaaacaaaacaaaacaaaacaaaacaaaacaaaacacctcatctcaaagaaaagaaaagaaaattagagtcaagtaccgtcctcctaagactgcagaagcagcagggtgtccacatgcaaaagaaggcagttggctcctcatctcataccacactcaaaatttacctcaaaatgagcaaaggggttaagtgtaaagactgtaattataaaacatatttaaaaaaaaaacaacaacaggaagagttcgttggactgggcaaccaaagaaaaagagataaattggactgcactaaaattcaaaagagaagactccttttgcgaacttaaaaataaaacataaacaagaagcaggcagatctgtgagtttgaagccagcctgatctattgagcaagttccaggacatccagggctacacagagaaaccctctcttaaaaaacaaacaaaaaacaacacctcccaaaaaaaaccccaaaaaaccaaaacaaaacaaaaaaccctgaaaaataaataaacaaataaataaaacctcttacccctcaagcacacgggtcattcattcattcatttcattctcacaacaaatatttgagtacccattgtacccatgtaagttcctttcctttcttgggttcttgttctcctctctctataaactaagagaatggggcatctctaaggtctactgcaactcagtcttataattctgtcggggaccggcactggaagtgaacatagtacacaaggtccactcttcgaatcttggccttactaagcatgtccttgatactagcgtatattttgtttgagagacaggagggttttttgtttggttttttgtttgtttgtttgtgtttttgtttttgttttttaaatgtgtagacaagtttttcttgtcttgttttctattgctctagtaagcagacaacctgtaaggagcaggtatattttttccttctcactcaccagttttctgacaccaagttgaccacacagatggctgtccaagggcagcatcaggggggagagctcaactggatcagactatgaaagttaaacagaggaaagaaagcaaaactgtgtgcctgcagataaaagtgctcactgagtacacggaggaaaccctaacagaaagcctaccacagtctctcttctccagctttcttgttcttttgctcgtacatctgtgcatatgcaggccagaggctgaaagcagttgtcttcctcaatcacacccaccttagtttcaaaagctgttttaatgctatgtgtatctgtgagtgagtgtcacatctttgctgttacccttggaggccagaagaaggtgatggatagatacttggagctggatctacaggctgttggtggtgacctgcctgacatgattgctgggaaccaaagtcaggtcctctagaagagcagggagcatgctcaagcgctgaaccatctccctagcccttctaccttatcttctgagacaaggcctctctttctaacccttgagctcatatatttagctagattggctgtccaggaatctccagaggtctacctgtctccgagtccccagtgctgggatttcacacatatgcctcagcactcggctttttatatggggactggaaaactcgagcttgtatgacaagcacttcaactaagatatttctcagcccttgtaccttactttcctttgtacccataagaagagagatatggcatggttcaaatggtggttaagtgcttgggcttttgagtcaccctccctggggttgagcccttgttctttccttcactatgaccctggataagtagcctgacatcctgttgcattagtgtcactgtaagtaaagagttgtcataatgttatttccgagcccaaatatgaagattatatatgaagcttagccagcattatattttgtcatctaagtgtacatatatttaagttacttgcatttgctccttaatctttattttatgaaaactgagtattatttttttccagtttagtagataaataaaccaaggcacagagatattgtcactatgttagtactaactaggtcatttttgtaaccccaaaaagatagcctagtcagagtcaggacttgaccctttatgctcacttaaccacaggactgcacacaagccatggaattcatctcgatatttacagataagtaaccggagtcagctctagggatgctgagcagcgtgtgggctccacccgtggaaatctatactgtagataggggcagaagacatacgtgtaagaagggtgtgataacggacacatcctatcacaggagttcttactagctttgtttggctgtggcctaggtccttaacagatacagggaggggtttgcagccaagaaaagctgagtgagtgaggcggggatggaaggactctgggaagcatttgtgcattgggcaaaacaccttttaccatattgttggagcattcttgccaggccctggaaactcagtggtcaggtccgggaagtatctagtgctgtggacttcattttaggatcccatggaagtagctcatatagaagcacacagcgagactgtcttagatgcatagactttgagatttgagcccaaatttgtcatagcatacatgagaaaactgaggcagagagcaaaggatgatccctggctagcccacagcaactgtagtaggctttgccacgttaatatttccaacctgcatctgaaattctggaccattggctggagaaatccttcagtggcatcccgatctgttcccctactaacccagagatgttctttagaactctattgaaagttcctgcttcaggaccatgtggggtgtgacatgtatctcttaattgcagcccttgagaagcagaaacaggaagattatgaatttgaagacagcctgggctacacagcaaaaaccctgtcaaaaagcaatacaaacaaacaaacaaaaacaaagccattaagtctcctgcgacataaatggcctattctactacaaatgaagtcttgagcaaagagtttgatgggcttgccatggcatcacagactgagttgagagaaagacagaatagaggtcttaaaatgaggtgtcaacttcacccctaccatgaaactggcattttcaatctttcccagcattgtctcttagcctcagatggtggtaccaacctgtaatcccggcattcgggaagcagagacagatggatctctgaattcagggcaagtccggtctacatagcaaagttttaggccggccagggctacacagtgagaccctggctcaaatatatttctaaatgacatctattgagttgtaatatgagtatttctcagttctcccatttcaagtgtatgtacttaagtagcttaagatagtcatgaagttgtgcaaccatcaccagaatcagtttttaaaaagactaattattttattgtatgtgtgaatgcctacatgtatatatgtgcgctctctctctctctctctctctctctctctctctctctctctgtgtgtgtgtgtgtgtgtgtgtgcctgtgtgcccgtgtgcccgcacacccacacatgcgcaccaacacaggccagaagaggctgttggatccctgaagctggagttgcaagtagctgtgaagttgcaagtagctgtgagctgcctcatgtgggtgctatgaaccaaacctgggtcctctacaagagcagaaagtgctcttaaccactgagtcatctttccagtccctatcacaatcaattttataatactttcatttataaatttataacatttcattactcctaaaggtaagctctccttacccagccaagtcctcaggctaatctcccttttctcttctgtgtgtttgcctactctggaattttcccatttattattattgttgttattgttatgatgacaaggggcgcacatgccacagtgtatataccttttatgtatgtaactaagacaaagaactgctggctcgtatggcaactctatatttagacatctgaggaactcccacattgttcctcacagagctggcatcccttgatttttcctgccagcaatgtgtgcagcttcctgtttctctgcatccttgccaaatcaggtattatcaatatgtttggtcatagccatcttagtgggcatgaaatgatatgtcattgtggttttgacctggatttccctcatgactatgacgttgagcatcttttcatgcacatagcgaccatttcaattactgtttaaaaaagtctaattatatcttttgagctgggttgtgtgtttttgttttgtttttagtgaaatcgtaaaagttcatttgttttttgtttccttgcttttgtttttgcatctgagacagaatttgagtttgtaacccaggctggccttaaatttgcaatccttctaccccagcttctcaagggctagagcataccatccctagcttataggagttctttgtgcattctgtatattgatacctactcatatatgtgatctgttcatattttctcaattaagaagttgtcttttcagtttcttgatatactttaatacacaaagggtttaattttttataacaacttctattctcccctggctgttcattcttttggcagcatatataagaaagggttagctggagatgtagctcagtggtagaacattttcatagtatgcatgaagacctggttttgatcctcaactctacaaagagtgtgaaatttctgtttcagctcaggccatatagatttaatttgtttcttttcacagttttgtagttttaaacgcttatattttcatcttctagcccatgttgagttaacttttgtatatgttgtgaagtaatagtccatgttgtaggataaaacatcatctggacaccttttataataataataattataatgcctataataatattattataatattttgctgatattaatattattatgtgttaaatatgccatgtatatatatgacagtcagaagacaactttatgggcttgattctctccttcatcctatatgagcaccccagggatcaaccctgggttgccaagcttgtacaacaagcaactttaccccccaagacatctctctaaccatctccactcttcttacctttgctgaattatgttgagaccctcaccaacatcagttcattagagctggactcaattttgtctcattgctccatgtgtgggtcattatgcaaatgccacaatattgtgattattttggttagtcttgattgctgtgcagcagcttctgagattgggaagtattgatcctctgatcttggttttcactgctaagattattttgtctgtgcggggtcccatgaatttctacatgaatcttggagtcatttctcagtttcagcattaccttattttttgcacagttcttagctgtttgccaaggataacaacaagcatttattaaataatggctgaacacctaccacctgtgttaaattttggagttatcatggtgggggaaaataactgttaattctgccttcaggggactaagaatggagtgggagaggcaaacattaatcaaataatcaccaaaatagaggtgacatgaataataaattggctaaatcagaatggggttggggaaagcagtggggcaaggaaaactttcttcaggagatcagtaaccagaaaagtgcctgcagctagaaagccttcgggagcaagcactaagtagcagagaatgaacagcactaggtaagggtcacctctgatcctgcaggcctgggggagtacccagggggtttgtcctgaaagcaacaggaagtcgccaacacagagaagtgacatgatctaattttgctttcaaaatactagctctggatgctctaaggagaataaactggagatacaggccatggccataaagagaccgtggaagtttgggtcagggtggtggctctcgagacaaagtagaaagactaacagttacagatgcaagagaaaacaagacggtagaaagagtctttggttagagagtgggataggacggtgttgggcgggttggttctttttttttttaaccaagattaaaatacaacaacaacaacaacaacaaacaaaacaacaaacaaacaaaaacactaggtagctttgaggggatcaatgctttcaattttaaggtatcttctagacattttttaaaggctatgtgaccattattctgaatcatccctgcaaagaagccataaaacatttttctcattttgcagatgaggaaactgagtaccatagggttaagtggcaaagctagccaggatcctattagtctaaaaacatccacagtgctccttctgttccagggcactggggctgacttttctagaagagtctatttcaaatagtttcaggtaacaagagaaaaatcattcaaagcatgtctccccctgtaccaactcctctcagaccccagagctcatgttcctagggcagcctttactcctctttataaatctccacagtgtaacagccagccttcccttcaggatggacctgagcccccacacctttcattcctggacccagactgctgaccacgagcagaaaactacccgtttccttttcctatagtgatcacgctatctgaaagacgtcattcctcttagagaccattgtcaccagtctgtgggcaatgtgtggaaagctgagatgctaagacatggagccagaagttgggtggttaaaaaagaaaaaacaaaacaaccagtcaaggtgagctcagggtttttggtttttttttttttttttaatgtctaatggggtgtgtgagggcaagaaaatgaatggatggtgggaaatgaggtggaatgaaaagctaggagaaagaaagacaaatctaaaccttcatggaggaagaggaagagaaaataaagtgttcgaaggaagaaagttgaggaggaaacatcctgcttccaaatcaggaatctgacatttactagctggatgatgttatgcaagttactcagtgtctctaagtggagataaaattgcacgaactttatggggtttgtgtaaggattatagggaaggcatgtattgatgtcctggacacaatgtgtgctgcatgataagcacccgataactctcagctgttactctgcctgggcctgccctcctcattctcttgcctctgcccccagttgcaaggccagtttatctcactaggtctggatcaggcaggaaatagtctgtttcagcacacctagaagatacaggacctgtgacaacaattagtgtcacttccaaaggtgctccttggactctctgctgcctcggcttgtttcctcttcctttccttgtctcctccctaccaccccaccgttagctctaatctctacccagtcaccgtgctgcagtatccctctaggaaaaaagtcctgtcctttttcctgctttagacagtaattgcccagttgctgaacaatctcctcgctgtacttaccccatcatgacaccactgtgtgaaacctgctagcttggcttgtggattgcacccactgaatactgtgcttcggcccttgtctgtttaggatggtggctaagataactctttaaagtcccagacttccttaggaatcagccaacgctctaaagcctgctccggaaacgtctgtgaactcattgtcagccaggaaagagtaagttatgctaccaacaacaaataaccagggcttgctcatgggatccacacagagagctttgccttgcagttagtcactcagggatccagactagtggagaattttggacatgtgtttctatcattgttaaaacaggaagacgggctatatgctctgaattctatatttaaaagatcctcaactgctatgtgggagtgagctcggttgcagcaagggtgggaacagggaggccattgaggaaacttgatccagggtgagttgttggtaatatgagctgtactggtgtgtgtgtgtctgtgtgtctgtgtgtgtgtctgtgtgtaggaggtgatggatttggaatacagtctagaaaaagacaggcaagattttcctttagattggatatgaggagtaaggagaataatggagtcaaggctggtttttggccaaggttttggcatgaatatgtggatggagaacatccatccttaactggcatggaagtggcagaatctgagggtttttaagataaagcccagtaacacctgaagggaaccccagcttggagttctttttatggggagccctgccagctgttgcacaatgacttaaaaggaggaagatttttaaagagaactctttgataaaggacacacacagtcacagccacaggaacacaaacatgtccacacatatcatatgccacccacactgctggccagtcccttctggacctcacacagtactattccccaggaagttcttcaaggtctccaacgtgtcccatccatgtttttgtttctggtgggaatgaacattgtgctgatggtttctggttaaagaaacaacatccatggctacccccacaccagtgcttcctcttaggtcaaggccctccttggaggactcctgggagtagggttagcggtgatgcatgacctaggtggtctgaagaatcttttatcctttcaaagtgctttccaacctagggaaatgtggaaaacatactgatagcacatttattaaaccaatgtacatagtccaaggcagtaatctgtcactcttaggcaccgtttctaacaaaacatgtagtaccgttgcctggatagctcattagaggggatcggggttgtggaaaactggaaacaaagtgaagacgccttggccatggaccggttagatcctggcaattggttctgactgaagctcactttatagccttgctatttccagggtccccaggctggactttgcaaagggttgtaaagggctgcagtttaagttgccagacttctccacaaatggccagttggatagacagcatccatcaggctgtgtgcttgtcaggcagagtagaagaaaacagagctcctgagctgggagagatgagccttatttcagcccgggctgggaagcagcctgattgtgcaggaaaagcccgtgggatttgtaagaggccagaggcttcccttggctaggagtcaggattgtggggaaaggaatgactttccctcctgcccaagtaaaggagaagcttgtgagctgcctgtcttccaacctgtattgactgtgtcctctagaaatgtagaaagcctatataacttatagtagccacatacagctcttgtgagatagtattgcccacttattagagtagtaatggagccaagccacacaactaccaagtggctgtgctagcttttggatctagttggtaagctctggatagttacaagtgaagctgttccctaggtatacggacagactggctctactctgcatgcatagaggtggatcagagggccaccatctgtcagccagccttactgcttcctgtcattttcaggattgtttctagcccctcgaaccatcatctcctcaagtctctaggcctgttttcccatccagtaacttgggcagtgggtcagtggagagagcaaaagcctactggctttttgtatattgtgtttgtttttaatttgtgtttgtttggaggtggaatttttaaaaaaaaaaagttttccgagataaaatttagctatatagcccagattgatttcagactttctgctttagccttgactgtcaggaatacaggtgtaagctaccacccttcccagtacaagggatttttgttgctgtttgcaatactgtggactgaacccagtgcctcatgagtgccaggcagtaactcgaccaattaagctataccccaagttgtcccctgctccttgtgcagtgctgaagagcctttttgctcagatgtaactctgagcatctgcccagcctgagcccagcactttgccacgtgtgatccactgagccctaaggaatctcacagtggtgtttcgagggctgctgggagcagctctgctttcatatcatatgttggaggtgtataggtaatttcttttcaaagatgacacttgttgctgtgctgggaatcaaatccaggggcctcggtgtgctcagtaagggctctgctgctgatccacctccatgaccaaaggtgccacttgtgatcacaaaacaaaccaaccaaaaaccaagtgaaacaacgtttaacgccctgaagaagacaggaatgggaatgaatggtctgctctgctgagagtgccacaccggaggggtgtgtgtgtgtgtgtgtgtgtgtgtgtgtgtgtgtgtgtctgtgctcgcgcctgcgcatatggttgttttctgagaggagtttatgctagaacaaaaagaggaaaaccaaaacaaaagaatggggaaaaagtttgagtcagtgggatggctagttgccattttgaagaagaaacagtagaaaagagaagagaccagggtggggggggcactaccctcctggtacctgcccatgatccagtgtttctgcgtaaagtctcacttagaactcggcactcacttcccaccttgagcttcaagggcagatgccccttggctcaccgtggggttatgttcctaacaacccattgtaagctaaaaatactgcaagtggaaaatgcattaattcacctgatctttagccgagccgactttaaaggcactgagacacattaccttatggttgggcaagtcatctactgcagaagctattttatattaaagtatcaaatagatcatgtaatttattgaacacctgtatcaaaaaatgctgacaatgcagaacaccagagagaggccgttgtttgctcttgtgaccgtgcagctgcctgggcttgggctgactgatgcttcccagcatcagggaagaggaaagattaaaattccaagttcctcttgcattaaatgtttatgtccttttgattcactgtaaagtaaaatcaatcaatcagtcattagtcaaaccactacatgtgaaggaccatctgtattattgcccctattttaaagaagacattgaggcttcatgaggaaaaaaggacttaattacgatcgtatagaaagtaaaccagcttgccgcaactcaagctgtgcctctctggtccctaaaagggacttgagatcagggttgaggaagccatgtgagctttgctgttcttcaaaacttttagatgctactgataagacactgttctaatctcagcccacttccaagccagagccctttctcctaagaacttcaccactttctgcctttatctgcctgtttcctggacccaaagcagaacagggattctaagagtagagttgtctttagaactcgcttgagctctcctcttgggtactgcttctcccatgtacgaacactgtctcagataaccagggagctgcctctactgtgtctggaacgggacatcacttgacagtggtgggattacatcctgtgtgggtggtgagggggaggagtcagactgagtcatcattgttatttccattgcactctcatcaatctctcaaggctattgaaagagttagtaactaaaccatagtgtgactcctgttctgaaagtcaagagacagttgaaagcacaatgcaaagctagtgcaggaaacagagtaacaggagggtactgtctcttgactctcggattaggaaggaaggtctgggctgataggctcaggaaacacaggacctgtatttggagaaaggaggatagagtatgtacacgtggctggcactcactaaactaaatgggtgactcagatttttttgctgtgacaaaatacctgacataaagcattttaaaatagggaaggtttattgtgcttttagaagtttcagaccattgccaatggccccattgattctgggacctcggtgaggcagaatattatggtggtaaaggatattcacctcaggacaaacaagaaagggaccagggcaagacatagcccacaaaagacctgtttccagtgcactactttgtcctgttaagccctgtacctcaagttacttactgagccagctctcaagcctcctgcttggatttctaagtctagatttgccactagctgtttgacctttggacaggttccttaacccttttgttctccactttcctaacttatggtcttttaatgagtaagtgaaataatatatacagaatgctttcaagtgtttctggagtattcaaaggattcgatcaatgttagttattatgggcaacaaaaaagaatagcttccacagaaacgatggtgaggtcagatctggggaatgccaacttcagggcttttgtttgttttgttttgtttttgtggagcatgcaagtgaaaactgactgcatgggtttgagcttggaattcatttaggccagaaataggaactcgagagtgatcactttctttttaaagaattattttatttttacgtatatgagtacagtgtagctgccttcagacacaccagaagagggcatcagatcccattacagatggttgtgagccaccatgtggttgctgggatttgaactcaggacatccagaagagcagtcagtgctcttaaccactgagccatctcttcagccaagtgattactttctaaatggtcattgaaaccttggaagacgtttacaggaagaatctgttgggaaatagaagatggcttaggaacaatccctaagagccatcaacattttagggagggacagagacaaaggagcccactgaggtggctgggcagtatctagagatgggaaatattttggggagaagcaaaataactgcttagcaggcatgaggccctggcttgcatctctaacagtgggggaaaaaaatcagaaagcagcctcacagaagccaagacaagagaatgcatcggctgtgactgagtgtggtggggcttaggagaggccagtgtaagggaagagtagagaaacgacaatgagacttggacctttggtccagtggtttccatgaaggagtaaaaatggccaccaagaatgagagtgaaggaatggagagaactcatgtaaatggtccttcactgaagtttgtgaaagggaaatgagagaagataaataagagctgggctgggagaagaaggcaggctttattgtccacaaggaagaggcagagtagagggaaaggtgtgagatgccggagagacagcgggcagctgagacttgagattcctggagtggtaggaaatgagcacagatgtcaaggacagaccatgtgaagggctacgggaggacatcaagccaatgcagaggtaaattgctgtgtgaatgcgtccctttctttgtggaatttagagatggtgtgtgacaatgctataagcctgtgggtgtattgtagaaaaggacatagtggtcacagagtccccacagaaatggaagagagggcccaacggggcataacctagctgtctagccatatggaaaccctagtgcttttatgatggttctacccatgtggtcctgaatcagtagcagaacgtgtggactttttttttttttttggatttttttggaagtttgggtaatttgcaaaatggatgaaggatggtcagtgagaaggattttaacaacaaaatccaaaatgtccactctttctgctactaataatttctctctttcccactctattacgtcttagcttctatttgctaaaatcctttgtattccttcttttggactacacaggagaactgagatgggtatagcactggtcattattatggtgtttgacagctcaagacaccttgctgcctgctggacaaactatagggtctttttctgtcctgagtcagaggattatgtctggtccaaccagctgtacttggcatgagcattctttagaacgtgttctgggggagcagaatacttataatttgaatcctggatcagcaagatggctccaaggatatagaggtgtctgttgccaagcctgatgactgaagccaatggattgaccccatggtgggatccacgtggtggaaggacaaaactgacttctggaagttgtcctttgaccttcatttgtacactgcagtgttggcataaaggtgagtgtgtgcatgcacacacacactgaaatacatgcatgcatgcatacatacatacatacatgtaatgaaagataaattttgaaagaattttgtttttgagccagggctggcagtgcagacttataatcccagctcttagggaggctgacataggaataaaagttcaaaccatgcctgagttagagtgagttcaaggccattctaggcaatttagtgctattctgccaccaatgtattatttaagtaaaaggaggagctaggtgtggtcgtgcgcacctttaattctagcactcaggctatgagtccaagatgagcctgatctacatagtgagttccaagaaagcgagaactacacagtgaagccctgtctcaacaaaacaaaaccaaacaaaaagagaatgtggcctttcactcagtggtagagtgctagcttggcaggggcacgatccaacaccccctgtcccacacaccacacataagcacacacacagtgttctgcaatgagactacttgagtctgaatccaggttggctcctttagtgtatagctttgggaaatttactttccctcccccccgcccccccaagtttccttctttctaaaatggttcaataagagtacctgctttatcagctctttgtaagggtaaaataatacatgactgtgtccctgacacacaattctttctactgtaaacgttgctatttactgtcattgctagtgtgacactttccctaagaaggaagtataaaaggtctagccgactttcagacaaagtgtggaggtgggattcagactccatcacactgaaagaacagccttctctcatttttgtatgtcctctgccactttctggtctgctggtctttccccagggaatgctacccccaggctctaaaagcctgaagtctgccatggtcttgggccccagctgctgtgtctgcttgttgtcaactgggaagcaatcttggctgtctgacccttccagcccagtccttggtttctatgagtcacaggcctctatgcctagcaactccttttagaagaggagtcggatgggggtgggggaagaaaggaagaatgcagctgcagccttgcctctttctgagaatctcagcccaagttgtaggaatatttcctttgcacccatcatgagaggctttggggcctcactgagtgcagactgccgtgggaggagacatttcaactagtccacacagccccagatagctgatgtgggagcaatactttctcaggcaccctgacatccaggacatccatctcctatgtagctccagaaaaaaaatgtaaattgctgacacaggaaaatggtacatgggctggagactgcgtctctcaaagcatctccctctcccatgctcacagatcaggtcccagcttacttggcctgagttggtattttcccaagatgtatattttcaggattctttggttaagattgtggttggtgatacatgaagtgattttaggtggtatgtggctgaagatacacattttaaaattttaatatccatgagttgatattttttattttaagttcattagtgcttttcctgcatatatgtctgtgtgaaggtgtcagatcccccggaacaggacttacaggcagttatgagctgccatgtggttgctgggaactgaacccggatcctctggaacatcagccagtgcttttaaccgctgagccatcccttcaacatattttaatatgttgtagagtaaaactagctagcacattgaatctgccacctttaaggatgttatttgctcagaaatatatgggagtgttttttaaagcaattttaaaaaatattaaaaagcttattgagacaattgttaagcatgtgacaaaagtcatgatggtgactggaattttaaactcactagtcctaggtaagtggcatcttttcttgtgcttcttttgaccttaccccaaaacttagtctgtctccctctccctccctcttcttccttccctctccctccctctctgtccctttgcctctccccctccttttgcctctccctcctccctgcctccttcccttcccttcctttccaagctccacagttgcactggccaatcccccagtttctcttcttcccccactcctttagaatgtctcctgcaccatgtgtgaccgtctagctgtcatcgctcatctgagtcccatgacctcggtctgccattgcacctcgctacccaattaatcttcctccagtcaactttcagcactgttcctttctgaattggtgctccagtcagtagcactcaggggccagttcttagcaagttgtagccttaggatagacctccagcctatactatctgcccgtatcttccattttctgtctcagacccatcttagtcttgctgctcctcagacagacattctgtgcagacttccaggttctgctctccctatacaccttaagattctttcctcggcccttaacatgtgtttattatttttcatacattgctatttatgtcgattttgttgttgtcattctgagacagagtcttgtgtattagctcaggctggcctgggattctctacactgcattgactggccttgaacttatggcactcttactgcctcagcctctccaaaactggggttacaggtataagcctctatgtctggctagttgcttctttttgttatttttaaagggaaaccttttaagaaactgtctctcatatttatttcattaaccataactgtcatgtgctcagttttagatcaggtttagatcaatctgggtcttccctgtctgatatgaaggtatctttaggagccacctgaacaagctacatgtctgctatcaagcaagatggtgcagaaagtagctgttaggtaggtagctccagtatctaccctcgacccagcaaagactgcttcagataaccgtcagaccattctgatctagagtcaggttctgaaatttgccacagttaagaccaagaggtttccagaaaagaagttatctttttgtgccccacccatctgcacccaaatgtccctgactccatgttggaaggccaaggtgagttctcagttctgcctctccctctcctggttgagaagaagagcttgggcagatttgaatactgtcctgctagatgactgccaggtaagtgggcagcttcttcatgtggcccgacagcaggagggagcttctttgtgggagaaatcacccccatctttggctcttaggtttccatatatttctaaagtacttttgaaacagaatttgcccaaagcccattatatagtgttatttattatgacaacagatagtatcagaagagccaatagcagtgatctgactaagaagactctgtgttagtatgttcatttgtataatatagtcatcaaatgtgacaactatgcaaactactgatacgtgaaaatacatgcacagaagaatattgagtagaaaggtagatcaggagggtgggaacatactatgcaaaaggcacatagatgctttgacaaataccaagggacaatggccaagtttgagatcaacgccattatcaggctgagggtatggctctcgtttagctcagtggaagactgttttcagggcatccacaagggcctgggtcccaacctattactgcatggggaacgaaggcataggcgactgagtccggtggctgagattgaacagtaattccaaagcagctggaagtcactgatggggtgctcagttcacctgaagttagagagataggtctctagcgctgtcccatttcgtgacaaagacagagatgctcagctagagtgagttcttgtacttgggctcactttccagaagactgttctgaatgtggggagagatctaacctcaacgggcaccctcgccaagcctgccaactggtaagatccccctttcctcgctcacagatgatgaagcattttgatggcagtgtctactgtcactccagaagagtgcacattactgtgtggagacccagggtgagttccttcttgaggtttcttggtatgagctatgctccccccattccagatgtcatccaaggtttagactgtgaatttctggacaggacatgaagaaaagccagacctccgactctggctgcttgactggaagctttgccaagggtgtggtttgatacagaagatatctctttcctaagaggttactgaagaggattgtggttttgctggctcaggtcttccagctttattcgagagtctgaagacaggggggaaagcaggatgggtgtgtgtgaggagtggagtcttgttttgtacccagcaaggtctgttatttattgagtgaccatgtgttacccccacaagctccgacacaacttactcggggctgctgttcctcagggaacaaggaaggctgatgcactcaatgcagtttcttgagtcacttactctgtacagcctttttgatgggttctgggtatgccattgtggacaagaccaggctgctcccctcagcaatctgcagccctgggtggcattatagacaagcaagcaggcaataacagataggatgctgccttcccagaagaggaagaaagtgaggctgtgggagggagggaggaggggtgcccatcacataaagaacaggaagtggggtatcagcaagagatgtggtatctgggattggatctggaggaggaagaggggatgagtgaagggatgtagagataagagagccaggcagagagtagaccacttaccaagagccagcatgtaaagagaccacagaagtgggccatgctgacacgcatacctgtgatcccagctcttgggaggctaaggcaggagaatcagaaatttgaggctattttgacatacggagttcaaggccagccttgtgaggctgtgtgagggatagaaaggtgggaggaaggaggctgtgccttggaaaaccgcacagagccaagccattcagtaggtatggctatgctgtgaggcaagactgagaagtggacaagggctcctgggaagtgcctgtctgagtttaatttccagcgtgctgaagagccaggaagcagctctaagcaagagagtgataagacgtgctgggcagtctttttggcttagcctggcaatggcaaggagaccagtttgtaagggacccgcacaagtggccatcctggtcatgccagggatatcatagtggcttagttcagggtggtagaaccaaggaagtggcttatgttttgggagaagctaaagcacttcctgatggaattcaggtggggaaagaatggagggaggagctaaatcatgtccactggacctcagcttgctgttgaggacccaggggtttcagatctgagatctggggaagggatgtgcatgtactttgtcatgcacccagcaccactgaagtgctttgtgggtatgtcacactcattataactgcttctgttaatgcagtctttctgatgggaaaaaggaggcacaggaagattaaataactaccgggaccctggctttgtgctgtattccttcttaagctctgtcattgacagtcataacaaactttatgaggttgtgatgccattcacacaatgcctctttcctgtgagctctgtgagaatacgggacacagtctttgactttgcgtcgcagaaagcctggggtctgtgcttaagtgagtattttgatttttgttgttgttgttgttgttgttgttgtgctagggtttgaacccagggcttatgagtgctaagtaaggatgctaccaagagctacacttcctccagggccttgtgtgtggtactttaggatgctgtcactgagctacactccccctaacaccagtgcagtaaagactttttgcagtgacttgattgataaccctattgtttcaaggcaacatggcccagggcaaaactccaggacttggggcttttcactaccttcttggcttggacagcttcattttactgagactattttcctcaactataaaatgataataaaaagtcttttttttttcctagagggtgtgagcatgcaaaggaggcttaatgacctccaaagtggtttctaaattgttatgtgggatgtcacacttagcatactataaatccttttaaaagatttatttatttattgaatgtgtgtatgtttattagtgtgtctgcccttcagaggtcagaagtgggaaggaatggttccttagagttacacgtgcttgtgagttatgtgacatgagtgttgggaaccgaactcaactcctggtagagcagtaaagactcctaaccactgagctgtagggttggtggggtcccgcatctgtttgtcacagggctgggaccgtctgggtctcaggctctcggacacccaggcaccgctggaagctgcagaagagctgaggatggagtgggggctcacaggctagatctagcccggggccggggggtgtgacggggaaaagaggggagctccggatcgtccgttggggagagtccttggcttgatggctgcaggcttggcttgagcttgacttggtggtggctgtggctgggagcatagagaggccttctacgaaagattagacagtggctcttgaagcgaagaccttctccatgtctccccacagtgaatcctagtgaaaagagacaatccatggttttaaggcattattgtcatggcggaaagtggatgagtaaaactgaaccctatttctcagggcggtcctagggttaaatacctttacagggaggagtgtctgggaaggaaagcttattggctaagcctccaggcctttaggtacctcattaaaatggagatctgtcttgagcctacctgtggaggagcttgggacgttgaccttactgaaggactgaaggccacaaatctatagggagctgcggctagtgacaggggtctggtgcacctaccgtcgcttaagttcccagggtttctagccttagctcaaccaggaaccaggctgcctttcacggtcccacaccaagccacctctacaacccctaaggttttagtcatctggaactgtacttcctgaatgctaactgatgcccttcctttataaaccaaaaggagaaaaataatgatgtagtttttcataaagccaaatttctcctcctcttcctcctcctccttttttttccttctcctcttctacctcctcctcttcctcctcttttccccttctcttctttttccatctcctcttcttcctcttccccttcccttttttttttttgcaattctcacaatgtcattccaacttagaggtgctaaaacttttttttaattgatgacatcttggttttagtagatgatagttgcttgaaaataccactacttaatgctggcaccactatgccagagcccccaagtgacaaaactagtactagctgcccaggaaaaaaaaccctgaaatggatggcagagatgagggctttggagtgggctttctgaaggaccctgagaagagtccataaggttgagaagagacacagggtgagaaagacacaggctgagccaggctgggtctcggtgcccagatgctgtgggtgccacgcagcaagatggcacctctagactgccctcgccaaaggttgtagtactatggagtgttcaggtggaaaaaaagttgctgtaatccaaatacacagttaaagatgggaacctctagaccactgcatcagacagcaactgagcatctccactgacgcacagacatgacggctcctgcagtccaccctggtggctgtagccacactgcttctccagtccttctttttaaaataagatttattttattcattgattatgtgttgtgtgtgtgttctcatttgcatgtgtgccccagggggtcagaggtgtcacctctggaattcagaccactagaagagcattaagcactcttgaccactgaacaatctctcttagctatcctactgacctttgatttctagtctcatctcctttgctcaggtcagcttcagcaatgtaggaatcactcagttctatgagaatggcaggagctcacagctggaacacaagggctcaatcacgagctccacacaccctttcactcacctttcacaccccaaaaaaaaaaaaaaaaaaaaaaaaaaaaaaccagggagaagggggttggggcaaggctggcttctcgccctggaatgccacatggcttgcctggggattcgggtggggaggtgaagtacatacacaactccctgcctgctgtgtgacctctggcctacaggcaaccacaggaggccctgggcttctgcaagtgccaggactttccacaaggactcccagtgtcactacctgagcatgtgccttcacattccaagagcacgtctggattatccatttcttagatttctccagacctctgttctagccattagaatttttttctctacctggaatcctttggccagtggatgcagccacaagttagtccgctaaggacataggccaggtgtctgctggctgtgcatttggcccaggcaaaaggcaacgggtaacttctaggagaaagcccatggagctggagtggaagggaaggccaaggagccgtagtagctgtgtccatgcccagacccatgacccaagcctgaccaacaatacttggcaggcttcctggctccctgtttagggcaggtcgccatggtgctttgcctgctggcacatagaggctggaaacagagcagaggcatgagcccaggagtgggtgggggtgtggttactacaggggagagcaggacttcttgccctagttctaactggcttttgagtcctctgcagggctgtgtggctgctataaggagaagcccctatgatcttatggccccagggattcctgacactgcgagtgcatatgcctacaatcttcccacccaaggacttgttatctgtgccatggttctgcttcttccactgactggcagatctttcttatgcctactaagctcttcctgtatctgtggctgagcttggacagctgtttatcattcccaccctgaatcaaccagacagttctatgggtagatgttctctataccctctcaatatctgtcctggcttgatgtttagaagcagcctatagaggactggggagaggacttaatggtccttttgagggaagcattagagctaagtgtaaactcctggacttggcgttcaaagatactcactccaacaactaatctttataatactcagcgtttcagtgccacatagttcaagcatcaaggcacacacacacacacacacacacacacacacacacacactcattacttgcacatctggctgtgtgtaaaaatagggaaaatgtggatagaatgtttgaagttttcattttgtatttgatgtctcataaatgcaggtataaaattttacttgcaagttgacaatttccaactctgtgtctacatatgtttcagtagtcagtatttaatctagtggtcagtagaaaatggtatgttcatgtttgccttttactggtaggctgagaaaaccagtgtctgcggggccatgggtgttggggaaagagggaagagaacccgcgtcccaccagagttccggtgctatgggcaggccgacgcgggaggactgcgcactcttttcacatggcatcgggtgggtgtctggctgtgtgaagccactgacctcacttggcaggtggtggacaagggttagtccaggttcccagcctctggcatcccatacactgatggacaccccagaaaagctgagaacagaataggggccccggggcggcacttggccccggggatgaagggaggagtgggcagggggagagggggtgctagatggttcccacaccggcgagagtccttattcaggtccgtggctggagcacagggtggccttctggtgggaggttagccgtggcttgttagcgtggcttgttaggagaaaacccatcctatcgttcaagcacagcaggccttgatgagcagagatggtctatggttttagagctttactgtagaaaggcagggagaaaggagaggggaggggaggggcagggaggggaggggagaggggggagaggaggggagaggaggggagaggaggggagaggagagaggccatggccacgtggagagagatgggggaagggagagagagaaggaggactagagagtaagaaaggtgagagtttaagagagtgaggaggggccaagcggctcctcttatagtgggctgggctatcaggctgttgccaggtaactgtggggaggagcatacctggctatagtcaggtaactgtgggggtggagtctagccaggatgccagaagcttgggaaattgtctgtgactgatagtcacagaattatggacaggcacctgattctgggaacatggctcgcccttctgtcctttgtagatttctctattgggtcaccggagtgagccccattcaatcaaaataggctgcctatcacagtcccacactgaattcatatacaaagttaaaataaaggactcctcccacaggaatggtgactcatgttagtaatcccagccctcaagattctgagacaggaggactgccatgatgagttctaggccagtctaggcaaagagtgaggccccttcccagaaaatatgaaaacaacaacaaaaaacaaaaacaaacacacaagcaaacaaacaaaaaacaaaccacagactccaataccatccatccatctttcaatgcctaacacaaagaccatctcctcctggagatttccctgcctcttccggctgggcaccctttcccctcctagctgtaccatcagcttccttggctttcctccaatgtctccagcacattcgctctgaggttgtagttagcagtgcatttgtctctctcccctatggcctatgctcccagaaagtccgtatctgttctggttcctcctagacaccgtcagcttttgcaaccgagtctgcacttgcaaattcctgaagatgagtggcttgtctctatgttggagtttgcctgcactgagagaagctgatgaaatcttgcgtttctctttgaagagaactattagttccgtctcagtctagggcattgagtagaggtgcctctcgctttccctgttgcttctcatctcctttcccactagtaccagtgtgacatgttcctcctcacaactagtccttggggtcatcaacagggtgagagccttaggagacaggtcacacagcctttttctccatttgcctttaatgaggggcaggagaaagagggaggaggaagaaatcgagggagggaagggaatagagagaggggggagggaggaaaatacatgctaaaatctaaaatatacttaaaatctgggtctgggttaatggctcagtgagcaaaatgcctgctggacaagcatgaggacctgagttcaaatcctgcgcatacttataaaacctgataactacagcaccagacaagcagatctctggagttcactagccagtcagactagccaatccacgggctccagacttagggagagatcctgtctcagaaaaataatgtggaaaacaaacaaggaagacacttggcataaacctgtggcctccacaagtaagtatgtgcatactcgtgcacacatgtataaccagtcaaacatacacatcattacatacacataggtaataagaaaaagaaaaacattttagataaaacttacctgttttgccattttctgtgtatgggttcaatggcattaagtatatttatatactgtgtaactgtcaccaaaactttctgtctccccaaaggaaactgcccatttgttaatcactagctcctcattttatttttcctccaaacccttataaattgtaattttactttttggctcaatgaatctgactataagtacttcatatacatgaagccacaccatatcagtcttgtatgcctggctgttttcccccgggcttcatatcttcaaggcttatctgtattgtagcatgtgtcagaatttccttcctttcaatggctgaaggatgctcaatgaaaatactatagaatttgtccattcatctgttacttgcaattaaacagtatccatctttttgctattgtgaatagggttgttaggaacatgaatatctaagtcttggcttttgattgttttgggtatatatacagaagtggaattgttggatttcttttacatccatttactgtgcatatggggtcaggggtcagaagacaatttgcttctttcttttcaccatatgggttctgggaattgagctcatgtcattagccttatcagcagataactttacttgctaagccatctcaccagcctgtttttgtttctcaagctagggtcttataacccaggctagcttggaactgtctgtgcattccagatggctttgaattcactctctgcctcaacctcctgagtgctgggaatacagacatgtaccagtttacagaattctcctgtcccattactaaccttagtcttaatcttggtaagcttccaggatcacatgagatctggtacttttatggtggtatggctgcaattcttgtaattccgtatttaaatcaaggaaccaccgaactgttttctccagtgcctgactcatttcacaactcctccgcagatatataaaggttctggtttttctacatcttcaaaacatctcttcccagcgaggagtgtgaagtgctatgtccttgtgctttgggttggaatttgtcaagtgactattgatgttgagcagtacttctcctgcgtggggctgctaagtctttgacctgcctttgaggttatgtatttcgcactgttttctaggcgctcttgtaagtcagatgttcctgtaatttttcaggctataatgcaattgacttcaagaagttctttgttgtttggttaccagcctctagactcatcatagactaaagactgcaaacccacagatgtggtcctgtagagatgtggtcctgcagcgcgtgcaccagtgacatgctctactgatgagctatatatcaaacatttcttctgagaagcagtgttttgctgagtgcttttctgacttatccaggctggcttcgagcttgattcttctacctcagtagctgaggttacagacttccgctaccagatctggctctctctactcattctttctgagctgaacatgccaaagcccctgagattctttgatcctggtttcagtttgtttgactcatgtatcaccttactgtgatagctagcaagccatccggaaaagaacacagtcagggaatggagaagaaaggagagacaacaggtgacagatttctttcaattcatttttctggttaaaaacaagaagatacataaagctgcttttctttccaagcagaacaaattcatccatttccaccaaagagtcccacccctccttagaaacttagcagttctcagtcagtttaattcaaggtggagaagagaaacatacctggcacaaagtgtcaaatgcctgcctttgtgccatccatccaggaactgcttttgtttttagtctctgtgtataaaaagctcgcagctctgtcttggaggttgtggaacttttgaggcatggctcttacctggtagtagtagttaatagaactatacctgcttctaatcctagatttgttgtttcttcttcactaagatgtgaggagctctgccatatgatcccattaccacagagccacccatccacaccttccccactagaatgacttgaagtttctctggaactatgaaccagaataaagctttcttcccttaaattgcttctgtgacatatttcattgcagtgttgaaaaaagtgactgattcaatgggttgtcatctaatatttctctgggaggaacttccaggtcaaggtccagagcgatcatttttccaaatcatctttttgaaaaacctctagctcctatctgcaccccatctgagagatggctatggtaccgggtctatgagctcaggcccagaggccttgatctctgaagttagccccatgcactcctggtgaggtgtctatctcacgattatttttatggaactgtgttttatttttagaatttccttccatttagctcatgtggatttcttttgcatgagtgttctaagactgtattggttatttttctccttgttttactcaaatgactgacaagggaggaaggcttcattaaaggaggaaggctttatttttgctcagagtgtgagggcacagctcagcatagcagggaagacagggcagtaggagcacaagccagcaccttgcatccacagtcaggaagcaaaaacgatgaatgcagacactcatcttgctttcttccctttattcagtctgaggcccccaacccatggagtggttctgcccatgtttgggatgagtcttctcgcctcagttaatccagtctagaagccccctcacagatatgcccagaggtttgtctcctaggtgattcttgatcttgtcaagttgacgatattaaccatcacatatactttcctaaagagtgaaaacttgccaggtggttgtggggtaggcctttaatcagcacttgagaggcagagacaggcagagctctatgaatctcaagccagcctggtctgcagagtgagttccaggacaaccagggctatgtagaaagactcttgtctcaaaacaaaacaaacaagcaaacaaagagtgaaacccccaaaacctaaaagagagtgaaaaatcaaaagaaagtattgatttgaaaactctgtgtgtgtgtgtgtgtgtgtgtgtgtgtgtgtgtgtgagagagagagagagagagagatgtttaaaaaaatcaagaaggtgtccacaagggactagtaattggggtacattctaaactgttgagaggactgtgtgacaggaattgatagcattcagttccacagaccttctccccatttctgaatctttgatattttctgatgagagcaggggaagcctagaataatttctctctcctcttggaataattctatgatagctttctctggaagtttagagacagggtcattagctatgtattgcatcctgattaatttcctctaatgttattcttgccaaaatttaaggcacaattggtagaacctttaccagtctgttttctgtttctctaactgagtgtcttgaagtaggtgattataaaaaggaattttaacagctcatagtttcaggagccaggacatctaaaagcattgtacgagcatcaaggagtggcttcttgcttcatcataacataactactagcacgtatccctccttttcttataaaatcaccaattccattatggaagtcccatcctaatgacctctttgtgtaagttggaccaaatatccaacagacagcttaagggaggaaaagtttatcttggctcacagttataaagagatttcagtccattatggtgaaaatggcagatgacagctctacacatagggacagaccagaaagcaaaaatattggtcagaaccagaaatggatataaccttcagaggcccactctagtgacctacttttgtcaactaggccccatatagaaggttccacaaccttcaaaatagtaccacaagtcagacactaagcatttcaactagtattctgtgagagacattctagattcaaaccacagctttcactgattcccctccagagtacactcctcaaaatgccaccaatttatgaattcagggatttttgtttctgtattagtagctcttctaactgctgtacctaacagtagcaacttaaaggaagaagactttatttaagcctatggtttggagggggtagttcagcatggcaggtgagttgcttggtaactggttcttggctactttgtgggttcttacttccacccttctccatcccttttcttgcatgatttcaacccctaacactacataggagagaaaaatgatagaaggaaaagggggagacgttatcgttagactccttcttgctgattaagggcgttgagttccttggggcaagtttgctcttcactgtcaggatatctaatttcttcttgttgttgtttctttgcacatgactgcctaacaaaaagcaaccaactaacaaccaacaacctaccaccaacaatctctccaggccctagcatttctatatcctctgaagagtctccagaattccaaatatcacataattgcagaaactatctgccaccggcacaaggcaaattatagtcagctgctgtgggcaatctgaagcagccccatatcccacacctgggattaaaacaaaaacatattcacataacatttctgtgctttttaaaggaaccaaaattctcacgacaggttggtggcagcaggagcttgcttctcacatgttagagatgaggcaagaagtgaccatcccctgcaatcactctcaaagacctgccctcagggggccgactcttccatcagtgtctcctgttctaaagagtcaaaagccttccaaaacaatgtcaatggctgttaaccaagtattgaactatctaaaactgtaggggaattttacattcaaaccatagcagtcaagactttggtgggatggaaacattgaagctgtgacagtgctgaagaattacacttctttgggagaatctcttcagtgtaatagtgcactttcattttcagcctggtccctctagaaagagggtcaggccttctctttcgcctccacacttccctggcctacattctcccaaggccctgcttggaaagtgctcatagagtttctgtcttgtaggaatccacacaagactcagccttctgcttgtgaaagtgctccttgctcccctgtatttgggcattccctggtgggctattactattgactccctaccttgacccaagcactcactgtactgagctctttggctaacctagtagggatcatttgacatctgggaacactgaggcttttaggaaattgtcaggcaaggaaggggctgaagccaagaggacacgcctcacgagggtcttctgacatccacaaatgtgtattcttggagagctagtgacaatttcctctatacaggcttttgcctgtgacaacagtgaactaaaggggaaacagattgctttgagtccaatctgtcctagtgggaaccatgccagagcatctctggagagcctgggactgagcccgagttactgtcaggatgtggcctagagcctcattttccttcctgcccccctttatcttcctctcctcctcccctgccttctgctccatgaccccactgcccctttcgtgggagctgcagagcatgctgctcagaaggaagtggctattggtatttcacttgcagaagtatctcagcatgcctgctctgcaaatccactcatggctgcaaaggagagccagcgtcattctggtgtgttgttaggggcttaaattcaagcgaaaggggcaccttcctgtttctctacctgttctggaatcttatttttgtggtccaggctactttggaacttccgagctcaagcaatccccctgcctcagactgccaagtagctagcaccctattcttagaaaacatagtgaataatgagagtgcagatccttccagtttcatagttagtcctcatttctcgctagccatataaaacaggtcctgcccagcccctcctgttcttcccatacctgcttatttgtcaggttcatggggcaaacagagaaggtgaaactggagtcccaagttgtggaggctcacccacaaggctcatcctgtatcggcctcagttttcttctctctcaaatgtggctaatcatacagcctgttttccctatcaaatgtctgtgatggtaagagtgatctgaaaactattttgtaaaaggttcacagtatctgaaagccatttatttccttctttctcaccctgcttctccttcctttctctctccctcccatcccccttcttcatccttccaccttcccttacctctgtctttcctttctttttccttttttttttttttttggacacaggacatccatatatagtccaggctggtcttacacataaatcctcctgcctcagtttcccaagtgctgggattagaggcatgtgccatcatgcccacctcaagtgccatttcttttggtaaagaaacctgacccatcctttaaggctcagttcagcagcacctccttgatgacttggctgcactcctctctcagcacttggaagtcttcatggggcacatagcttggagcccagagggaaaagtgctatgcgtgcatctgcagctcttctagacaatgcactgatgtggaaggcagagaactggctcggctgtcttccctttttatggatcccaaccctacaagtggtcaattcccaacaacagtgtgtggagctggggaggcaaaaataaataaacaaacaaagaaaagccaattttgtggcttggaagctaatcttggcaacagttactcgtgtgtccctctggacgttgtgaggtgagggtaaatgacagactgtgctggtagaatagctggggagggaggtgatgggaatctttcacataaatgtaaattaatatgttttcttgactccatttatttttttctcatttgaattgggctttgccaggatctctaagaagacaggacagttagtcctgccccatctctgtcttgccccaagtaccacacagataagtcagacaacaggttacagagcaaggtgcttgcctccatgtgccccatacagccactgagcaacagaggagagtaccagcgtccgggtaccacctcctgtaacacctcataggagagctttcttaggagctggcgagatggctctgaggttaagagcatagactggggctggagagatgactcagcagttaagagcactgctcttccagaggtcctgcctgagttcaattcccagcaaccacgtggtggctcaggaccatctgtaatggggtctggtgtcctcttctggtgtgtctgaggataacgatgatatactcacatacatgaaataaataaaatctttttttaaaaaaaaagagcatagactgctcttcctgaggacctgagtttgattcccagaacctacatggtgatttaccaccaatgtactctaagtccaggcaatatgatcccctcttgtgacctttgcaggcaccagtcatgtatgtggtacacagacataagcaagcaaaatacccaaactcagaaaataaaataaaatcaaatctggaaataaaataagcaagctgcgtcaagagttggtaggggcatccatgaaacaaaggaggaaagggtgctgatcttgcacaacaaagtgtcttggaggtcatgaggttaggttctttctagggtcctcctctgatattctttttttttttttttttacattattgggataaagttggctctgctaaataacatgtttgaagtagacaggttgttgggttttatttcatgtatggacctaaggacctatgaggcaccactaacgtcatacataacaaccatttccatcacacccaaacctctgtgtcctggctcacttctacctttctctacagcctaagtgtagagaacggggctctattgttggtgcgtcagtctaagattagaacattctcaggagctgtggccttagattttgaggactggggccaacagagccccagttggaagtcagttcttcatgaaagcgtagtcccctgactttgtaatgtggatgacctgaggcggatgatcttctcttcaggcctgagtgtttctatcaatgaaatgagatgactgggcaagatgctaagctttcttgtcaacccggagcacatgccctttctgtgacaaaacttttctaaacagcacttttaaaaatgcataaaagaagtgtaatccggcttccttgtttcctcatacctggagttgctaagtaacagggtgaggatgctggccagctatgaccctaatgtagcattcctggctcagcccttctccctttattctcttttcaagattacagaagcgcctctctctagctagcttgtaccgaatagtggtgtcctcctggctctgtctggagaagcaaggttcacttcttcaggggagaataagggtgaaaagagatggtttcctttgtccacctgaaccaccaaaccatgccacagaatggggacactagcttttcttcaactggagttgggatttggtgactaaagtgcatgcaacctctctgtactgtgtgcggatagacatgtcagtgagcaatccaagaccagcaggagaagacagaaatatataggtgagaacagaatgctgactgacatactagttcttgggctttgagctgaggctggaggaagaactggggtgatcaatataggacttttagagagagtgtgggccttaagggattttctcactccacagaggaagagaggaatcagtcacacaccccctgtcacacacacacacacacacacacacacacacacacacacaaacacagacggttagtgtcccctgcctatttgctgtgccctgcgaaaaggtggtagctgggttgtgagcgggttccaggatttatttcctctgtgctcagcaagtgcccagtaggtgctcagtgaatgtctgttgacagatggagtatactctaatgccatgtcaggcactgagaggcacacagagagaaactggccctagtccctgactgtggtcaaaaaggaagggtaagacaagcgcataaataactttatacaggacagactgtggtaaatgccttgagagaaaaacagtgaagcgccagggaggcagggcactcacatctggcagaagaggcagcagggttccagaaaaaactgcctcctggtgctgccactgagcttgcagacctggaatagggatggggtttggagcatggctcaggaatgtgtgtgtggtgagggcgaggagtgagaacaggctgcattccagaccccaggggcagattggggacctgaaagttccttcagaatgtcctcagcaagcacagagagaataaatcactggccattcagagccttgttagaactggggcttttctgacttctcgttgtgcctcaaccccccaacttagagaatagacttagcaggggtccttgctggttcatgggttggtcagctcaaaccataagtgatagccagtcccagtggcctacgagtgatttcacaaaagccttccttccaagttcactgtgcttctaggaacaataaaactccttgaccccaggaaaaggccatgcaaggaccaatagttggttgctggctttctccatctatcagttatgtgactgagatgagccgttgctgggcagcagtgcgatcaagtggggacaggggccatattattttacatgagattgtttatctgcttattggctgccttaaaactacacagtggggagctgggtggtaacagtcctggttgtgctatacataggcaagagcctgggaatcaaatccatcccttcctctgctcttttcttcttcatttcctagtccgggtctaaaggaggtcagttactgatggatcaaatggtttcctttagcaagctattattccgttcatcagacattttcaaatgtatcgtgtcattgaatcttcaaaagcagtcttctaagcggggattatgaggaaataggctgagagacattaagggccttacccaaaacacacctagaagggcgagcctttagccctggcctcctaactgcaagtggccccagctgcagagagtttaaaatctgagagcatgaaattagttataaatcatcacaatccaggaaccaaacaaaggaaaagctgaagtgcaagagcccccagactagaatgtgctattatagagacaaagttgatcaaatgggaaaagaaatcttagcacatcaagtccaatatggaggcatccagaagtctccagcataatattggtaagagggtggagatgggacgcttcctcacctgggatctttcctgcccacgtgtgctacagtcccagctatagcccatcggggtacacaggggccagttctgctcacagcctcaaggctgatgtggccaagaggggccctaaccctgatcaaattgaatctacaaatatatgttatcagtacaaaagcaagagtcaaggtagatgtcactctgcttgggcacgtgtgcatgttcgtatgctggtgcatctacacatgtgtgcatgtagaggctagaggagaaccttgggtatcattcctcaggctccagccacctcgttttttgagatagcatctctcattggcctggagctcaccaaataggctagctaggctggatgttgagcaaaccccagacatcctcctgtctctctcgccccagcatacagtcactttcctatatactcaaaagttcacacatagtctccaagagaatataatggcattcctctctcccccctcactagggttacaagcccacaccatcaggttcttatgatttcatggtgttcatttatcaacacaacccattttagaacattttgtcatccccatacataaatattatacctgttattcttaacctccaatctttcagtatcctttactccccactccccagacatagacaatgactaatctactctctgtctccatgggtttgcctattgtggacatttcatataaatattctataagatgtcttcttttataaatggcttcactcagcataagctgttttgaaattcagccatattgtaagatgacacattcctttttttgtggaaagatattaaattgtgtgagtattccacattttgtttatccattcatcgattgacaaattttaaaggatttttttctaattttaaaaaaattctatttatgtatgtgcacacatgtgtgctatgtaccaccaccacaagagtgtggaggctatgatataacttgtagtctccctctaccatatgagtcccagggattgaaccctggttgtctgaattggcagtaagcaaggtttgtttgttttgtttttttttaaccaacttgttttttgtttttgtttttgtttttttgtgtttttgttttttggttttttgtttgtttggttttttttttttttttacccacagagtcatctcaccagcactgacaaatggtgagtgtgtgtgtgtgaggaatggagagaggaatgctattatattctcttggagactatgtgtgaacttttgagtatataggaaagtgactgtgtggtaattagtttttgtcaaagttgatgtaagctagagtcatataggaagagagaaccccagctgaaaaatccctccatgagattggcctgtaggcgaagtctgtatggcatcttcttgattagtggtttctgtgggatgatccagccagcccactgtggtcaggtggtcctggggtacataagaaattgagctgagggagccacagaaagcaaaccagtaagcagcactcctccatagtctctgctttagttactgcttccaggttcctgccctgacctctaggtgatgtctgtgatgtgggatgtgaaagtcaaataaacactttactatggtgtttatcagagcaatagaaactaaactaatacaggctgcatcatctctctttatcaacactagctatctaatatggcagttagcagaaccatcttagtatgaagtggtgtctcattgtacttttgagtcatatttccttaatggttcattatgctagatatctttttatgttactaggtcatctgtatatttctttggagaaatatctattcacattcttttccttcctagaatgggatggtatttttattgttgacttgtaaatgttctttatatattctgcatactagaatcagataaataaatgttttatcttattctgtacattgtattttgctgtctttgtagggtctattaatacatagaaggtgtaaatgttcatgaagttgaattcatttaattatttcttctgttataaagcttttactgtcatatctgagaaaccattgttacccaaagttgatgttctctctctcatcatcatcatcatagcttattgaagagactgttcttttcccattgaaggctgctatcattgttgccaaacatcaattgtccataaatgtattggtttatcttagaatgttttatttgattacatttatctatatattggtctttgtaccagtagagtgtgagcctggtcactgttgctttgcagtatggatgttggttggggttctgtgggcacctcccgaggagctcctgattcctgtgtcctagaacgtgaacttggaccagattacttttctagcttctgtgataacataccccacaaaagcagcttccggtaaacgtcatttattttggttcacagttccttatggtggggaggtcccagcatcaggagtgtgagacagctagtcacatcagagccacagtcaggaagcagggaatgatgcatgcttgtgctcagctccatttctcctttttgttaagtacaggaccaaagcccacagaatgatgtcatgcaccgtaggcaactcttcctgcctcagtcaacctagtcaagaaaagtccttcacagtctaacctaggtcatctttcataggtactccaggatgtttttcgcttagatgattttagatcatgtcaaattggaaatcagtattatcacacagacaaaagcctgtgcagggacagtttatcagaaaagagatgtaattccaagggaggaaggaagttggagcagaggaagacttcagaagctcaatggcagcataaaggatgtgggcttttgtgtcctatagcatgaggttagtaggtcatttgcataacaatgggctgtctttttcccccctttttaaatctctacttttacttttatttcatctgtaagtctgtgcactatgtatgcacagtgcctatggaagccaaaggagggtgctggatcttctgagactgtagttagagacaactgtgaattgtcatgtgagcaaacccagcttctctggaagggcaaacatggaaccatctctccagcgcacacgaggctttcttgagtatgctctgtcctgtgtaattgtacatacaccttcatatattgtatgcctcatttgcatctgaaatctccaccagtgcaggggtgtgtgttttagtactataaagaaccacaacttatctttagacaccccaaaatgtctgcacctgcccagatttatggattttgaaagacttaatgttgctgaaatgtcaatattatcaatacaaccccccccaaaaaaacctgcaaagagagatgtggtaaagcatacctgtaatttggaagttgaggtctgaggattgtcagttcaaggccagccggaactacaacaggaggcagacagtggaacgggaaatgaagaggaccttaagtggaggagtgggagtgtgtttgaaccttctattttgccaatcagtttattgcctaagctaatgttgcagtcattgagcaagatcttagggaccttactctctgtcttgttcccctgcctcaatatgaccaaaaatcagatgtatgtgttctccaactttgctgttcttttccaagcctaatttgacttagaaatcccaaagggtgccttagaaatccgtgtaattttaaaattagttcttacatttatgcaaaaaaggaccattgggatttgaattgaattctcattgtgtttgtaggtttgggggttatgtttatttggttggttgtaggcttatttctttatttagattgagtcttctgcagtgcaggctacccagaaacttcctaggtagccaaggatgacttgaacttctgatgtcctgcctcctgctcccctgtgctggcattgtaggcgtgcactctcatgcctggctctgagcggcttccctctagtatgtggtgtatcctttctcgttttttcataattcatgcttttttattgggaactggaaatgtgtagaaaacttgtgtgttccagtaactcttagtactggtctccacacttcatcccagtgtttcctcatgatacttcctcatttagttctgaccacataatttccataatggtcactccctcaaccaaagaccagcaggaggtgatcccaagggtgccctcacgtgccctggattctgactgagctcttacccatggcataaattgctccctaacctgtctaatcaaactgtgggctttgttttttgttgctgtcgttttgtgtttgttttgtttgctgcaccaattccctagataagcgtttgtggtttgttctgaccctgtctcctatttttgtccagaaaactaaatagttttgctccatctccaagacatccaccatccccctatccattgcctttcatctcacctcccctcgttaggcgccgattcctccatggtggtagaaatgaagtcaattctttttgtgagtcattcaagactctctgttctatagcctgttgctctccctgggcaaactctctgagacacggctttgttttaaggtcaaagcccctctttcctctcaatttagagctaagcactcacccaaaagggaacagcactgttttggatctccttggcttgcttttcctcatctagtacctgcgccccagagaccaagccagaggacttttgtacggtcagtggtgggtgctctatcccacgagagggagctgcatggcagaagggatccccgcctctttcaggctcctttacctggaactaagcctgagcaagaggtcactgagaatggggtgagaaatgctccttgctgactcctcctacgaagatagccctcccactgggagctgatggagaggattcctgtgttatcaggaacagtcggggatgggttttctgtcccttcgtgctgtgccgggaaggaggaggaagggagtaagcattctttgaactatcctaggctcaaggttccaatttagtggattctcttcaatgagtgtggttttcctccattctttgtacacttttaggaggatttctagggactcacagtgttataaatgacactactttagagggtggctttaaggttcccaatgcagataccccacatcacagaagaatgtttgtgatggctgatgagccctggttatcactgaagcggagagtttacattagggcccctcctggtgttaatgtgcagcagtctgtgtcgtctcttgtctcacacagaatgcctccactcccctaaacatcctctgtgtctcatccactcgtctttctctccccaataggaccagacaagccctggtatttctactgtctctatagtttttttctgtttctggattgtcttatcaaggcaggatagaaagccagggaaaattaaagagacatggaaaagaaatgaagagcatcaatgacttcaacacaagtggcaaaataaagattacctacagagacagaattctctatggcttacacaagagcactaaaactcaacaagtaagccatgcttgtttggggccaggacatgtgcatccttttaggtgagccaaggtagcactcctcctttgtccttaagcctgagcagtgtgcattgtaaagctgccttacaatttcacttacgaaaagcaaattctttaagaagacaggaaaccaactcatatagttttacttaatttttaaaactttccttaatttttgaacttggttggaaactacatcctctgattaatacaacttcagaagccataaaaacttatgtctgtaagtaacactgttagtcttttctgaggctggagcgacagctcagtgattaagagcactgttgcacttccagtagacctgggtttgactctcagcatccacatggtggatcacaatcatgtagaactgtagttctggtggatctgatgccctcctctggccttcaagggcaccaaacacacacatggtacacagacacatatcacacaaaacagccctacacaataaataaataaataaataaataaataaataaataaataaataaataaataaataaataaatagataaatagataaatagataaatagataaatatataaatagataaatagataaataaataaatattttaaaaaatattggtcttttttggtaaaacattgtaaaacttgcatttacaacattttcatctcttactttgttagacttttaggccagttttaaccaccaccaccaccacgcctgcccaaccttgtaaaatccttgttaacagaaagccaccaatgcatttcaacgtgtcctaaagcagtgaccctcagtttccttcattcatttcttttatactgattcttttaaaattagccaatcaagaaaagctgtgaggtcagagcccagccaaagggggaaagctatgttcaccacctgcgttacaataaaaagatcacttcttgtcttgatgcacttgctccttcaagtgcttccttttgatgaagagtaaggtttgcctcttgagacaattcagttggattggtagtatctttgtgagccccagtgtttttctaagatggctattgttgagacagtcaaggtacctcattctctctgtctctgtctctctcttcctcccctctctgaatgtctcaacttaaatataaagcatgcacaatttccgtttctacttaataaagtcactaaatttgctgtactctaactcatctcaagattcttttctgtgacatagtgaaggacaacactgctttacctgaatagaatctgctaaaagggacaactcctcgggctacggggctgtgttgttttctgcctctgatcatatatacattacatggtctggagccttctcagattagcttttttcacttagcaatttgtgcttatggttctttcatgtccttctgtagtttggtaagtcaattcctttttgtttgtttgtgtttgttttattgtttgagctcaagctggtgactcatctcttttagcactgaattatattccattatcaggtgctagcctagtttatccacttacctactaaagagcatcttggtagcttccaaattttgacagttatgaacaaagctactctaaacatacatatgaaggctgtatgtaaattcaagttttccttcatttgagcaaatatgaaagagtgtgccttccagatcatatggtaagagtatgtttatactgtccataccatgttgtattcctatgaggagagagtgagagtttctgttgctccatagtcttgcttgtgtcaagttctatattttgaccattgcaaagtagatattaatgtttcactattgttttaatttgtaagtctctaatgacataaggttgaattttttttgagacagagtctcatgtagtgcagtctggtctcaaactcactcgctacatggctgagaataacctagaactcctgattcttttgcacccccctccaaagtgatgggaatgaaaactgcctggcttgaagtttcttttttgcataattttatttgccatctgtacatcttctttgtgaagtgtttaggtctttcatcatcgtgatgatcaatatcattgtcatcacgtgtttgtgtgtatctgtgtgtgtgtgtgtgtgtttgtttgtgtgtttgtgtttgtgtgtgtgtgtcccactgtggaatttcaggattgcacccaagtggtgaggctcaagaagcgcttcgcctgctgaaccaacttggcagttgctgttcaggctatttacctatttttaagtcatgttcttcattttcttatagtccatttttgtgagtgtatatttgggattaattgcttttatcagccatgtcttttctaaacattattttccagtttgtggcttgtctttccatcctcttgattaataccctcagcagagcagaatgtttgccttttttccctttctgtggtactataaagttcaaacccagagcctcaagcatcctaggtaggcattctgccatggagctgtacccctagtttggaatatctactaccaatgcaactatcagatcaatgatttctttcattgtgcctttggtgttgtgtctaaaaagccattgcaatgtagattcattcattataacaaatgtacagctctggtgtgatgtgttgatagtggaagagatttagcacctgtgaagacagggcttatttggaattccacaattgctactcttttgttctggatccaaaaattctcagaaacctaaagtttgtatgtttgttttggctttttgtgacagggtctcactcggttgtacaggctggtctggaattcattctctttgtaaactcgatctggctcgagttatgggattacaggtatgagccaccatactacgctaaattctattcctttaagaaaaaattgtaatggtctagatgaagacgggtgtcagcattataaggaaactaacaatcaagggcaaaataatcatccaaaataatcatcgccgtatacaagccatgtatgtggttttacattttgcatttagatctgtgaacatttatgagttagtttttgtgtgcgatttattttcctccttccttcttttctccctccctccccttctttctctttccttctttctttggcacagcgatgaccacttgtttgagcactatttattgaaaagatttctttgctccagcatgttgctttgttgctttctcttagagcagtgacttattcatgtcagcctatttttgtcccactgatctgtttgttcttcacaaacaaccccgtcttgattgctgcagctttatatgtggttcttattggattgtgtcagtcctccagctttgtctctttccttcaatatggagttagttattctgggtcttttgtgtctctctatataaaaccttagaattagttttagtgatatccaggaaataactttgtgggatttcaattggaattgcatagacctgtagatcaacttaggaagaactggcatcttggaaatattgaattttcctgttgtgaacagaacatatctcctccatttattattgatttctatcattatggttttatagtttctccatacagatattgtatagctcatgtcaaaatttcacccaagtttttgatgctttgggaatgctaatgtatggtgatgtgtttttaaaacaatgaacaagttatgattaatatagaagaggttgtacattatatacatagtttaaggtaaagatatactaaaaatatgaaacatttcacaatgttgcctatcaccctggcataagtaccacactaatctactctgtattgtttcagctttgcacggtactgaagaaaacattgtaatgcgtctttagctccaaactccacttcttcattgtagttggcctttctttgtatgtcaaccttgtgtcctgcaaccttgcaataacaattagttgcaagagttctttggtttttctcagattgcctacctccatgatcatgtgatctgtgagcagagacgaagggagagtctctgctcttattgcgttatcttccctataaggagttggagatcagtgatgctagtggacctcctagccttttgattcctgatcttagtgggaaagccctgacagtctcaccacaggggggtctagcaatgaaacccagacttaccttgaactcaaaatcctctaacccatgtctggagtgttgagattacaaatgaacactactataggggttagtttacttctagctttctgaagttcttattgtgactagacattgataattttatcaaaacctttctctgcatctattaaaattattgtggggatttttgttaccttattaagtaattgattatgttaattaattgacttttttattttatttatttatttatttatttatttatttatttattatttttttttttgttgagacagggtcgcatcacatagctctgctgacctggaacttactttgtaagccaaacgtgcctgaaattcctgggtctgcctctcaagtgcattgattgattttttgatgctgaaccagcccttcataccaagcataaatctcactttattgtgaagcataattctttttgtacattgttggacttgactttgtctttgtttgattttagtattaggataatgctagcctcatagaatgcattaagaagcattcccccggcttcaagaaaactggtactttttttccccacaaatatttggtagaatttaccactgaagtgatctgagcttgctgttttctgtttgggaaaggtattaattagtaacacagctcctttaataaatataggtctattcatatcccctagtgctctttgtgtgggttttgtcaggctgtctctaaagggattgactggatttgtctagggtgttgaatgtgagggcatagcgttggtcactgaatccctttattattcttttggtgcatgtgcgatcaggaatgatgccctctcatttgtgacattgataatccatgccttttttctctgcctggcattaaagcttattggatttttatttgtctgttttgtttttgttttctttaaaatatttttcctcattaatccatttatttattcactttacagcctgatcaaagtcccctccttcctttcctcccagtccccctcccactccttccctcattcccccatccccttttctctaaatactgaagattcgataaaacagctttttgttatccgcttctgctgtggtctgagagtagatagcatgtgatttccatttccattaaagtggttaatgtgtgctttatggcccataaaaagttactattagccaacctttgtcaacttgtcctcattgaactttaaataatcagtcaattacaattcatattttcacactctagtactgttttctgcttatgaaacttccatgcctcctttcacacacattttcttttgagtcatggtcttgccacaatgtcctggctggtctggctggtctcagaactccccagatcaagtgatcctcttgtttcagcagcccaagtacttggagctaccgatgtgtgctactgcagcgcatctggaagcttctgctaccataagttgtcattctctatatctaaagtcagtcttcagtttttaaggacagcagtttgcctttggacttctctgttggacatttaaaaaatgggggctggagagatggcttagtggttaagaacattatgtgctttttcagaggtcctgagttcaattcccaacacccacatggtggttcataaccatctataaagggatctgatgccctctgctggcatgcaggtgtacatttcaagcagaacactcatgcataaaataaaataaaataaaatcctaaaaatgtggttttttttttaaatgttattgatgtagtcagcttttcacttggtgctttgaggtttttagtttgttgatttaggttttgggtctcgagttttatgtaggaattttgatggtgggtgtttgtttccttttggttttgagcccaggtctctctaagcagcccaagctgtcctagaattctatatagctcaggctagccttgaactcactatccacctgcctgggcctttctagtactgggattgaaggcatgccaccataccaggcttcatttttctttaaatattttataaaatttatcagtaaggccacctgagcaggactttgccatgtggaagttttaaatttgttcattcaatctttttgtttgttttaatgcattcatattttccttcttgagcccattttagaaattgttctttctaggattttctatttccttttccatatcttctttgtttcagtatagttatgtatattatattagcttccttttattttcataatgtcaattaagtgttgagtcttctctgtttttctactatactcaaagatttgtcctcactcccaaagtaactaatttctgattttgttgttattttgttttattttctctattatttttctatgtgcttatttatttcctcttttatttatttgttttgcttgctttggatttagcttattctttagtttcttgagcatttttggcttgtatttccatatgtcacagctagttttttccctctgctcttttactctcttctttggtgttaattaaatgtcttctagttcaggcataaatccctttagtgatttttcaactacagtatttttatctcacttttgttttgacattttagacttatcatttttgtttgcttgttctgatattaatattttggagtgggtatttttctcaattctctcaataagtcagtttcttaattgacttgagggttataatatacattttagcatgtgtattggttgctctttttgttgccataataaaataccatggcaacaaataaattataaaggaaagggtttattctggttgagaaaaattgagaaaaatacccgccccaaaatattaatatcagaacaagcaaacaaaaatgattatgactacgaaggaggaatctacaatgatggaggagacacggcagcagacagccagagcaggaagctgagaggtcacttctcaacctccaatatggagcagaaagtgcaaacaagaagtgtggctagcctatgaactctcaatctcacctccaattggcatgcttccttcagcactgctatacctcccaaaggtcccataccatccccaaacagtaccaccagctgagggccaagtgttctaatatgtgaacttgtaggagacatttctcactcaaaccaccacattccatccctggtccccataggctcacaaccatctcaggatgcaaagtgcaattacgtccaatttcaaaagtccccacactctctcacagtttcaataatgtttaaaaacataaaatccaaactcacttcttagactcaagacactttcttaactgcgatcccctgaaaaacaagaagcaaagtacatacttccagcatacaatgcacattaccattaaaaattgcggtgggggggggggaggtgaagacatgatgaaaaaatacggggctaaagcaatactgaaacccagcacggaaaaaccaaattccatagctctgtgtccactgcttggatggctctgctcctccaactctgctgcctgccactcccctctctcttgctcttgctttctcgttctcgctctcttgcactctctccccttctgtttctttctctctgtgtctctatttgtctctctcctttctgtgtgtgtctctcattctgtccctgtctctcttctctctctctccctctctctctctctctctctctctctctctctctctctctctctctctcccctctctcctctctctgtctctgtctctctctctcagactggttccaacctctgtatgcagctttcctttgcagatgtctcacatttctgacatccccaacatcttggggtctgcactgcaactcaggcttcactatcatagctgcaacacaatggtttcttgtgctcttctgctctcttggggccatctcacagtaactccaacactgccacacagtgcctggcttcaggggctctctgaaactgtggagggacgtggacacttcccttatacttgtaccctttatgcctccaaagggaatactgctaaattcagctgctagcctgggatggaacctcaccactttgaatcacattagtagcagttttctcatggtgaagcagttagttactagaaacagaaaacctcctaggttttctctttacatgagttggaagcttaattggatgggatattgccctgggagcacccattccattgttctaatgcaaacaggactctccgtaacaattacagcctctcttctagcacatgccctggctgtaacattaagcttcccagtcattcttcttgacaagctgtacattctatatttctttctgccttgcttgttcttttccattgaagatctccacaagcattaccagtaataaccatgctgtgtatttgaccttatgctgtttgaaatttcctcagccaaagaagttagtctattacttttcatgtagcctccagcaagttcttatgacacaggcaaaaggcaacctgattctttgcccagatatcacaggagtagcctgtagtccagttgctaatattatctgaaacctcatgagccccacctctattgtctacatttctctcaataatactgtcttccaggcgtctaccagaatattacattaaactctgcttacagcattcaactgcttttctagtcttaagtgctgaaatcatccacacatctcccaactaacttctctgtgttcatgacttttctgttgatgtaataaaaatactgtgagcgaggcagcttacaggaggaagaaggttggtttactttgacttccagttctagaaggaaaggccttactaacaggggagctatggaagcaggtgagcagagcaggaagctaagagaccacatcttcaaccacaaacataaataaaagagcacagtcagagccaggggaggctaagaactctcaaaggatgccccaatgatacactctctccagcaagactgcacttccaaaaggtcccagaacgtctcaaaacagcaccatcaactgagcaagtgttcaaatatgtgagtctctgggggacatttctttttcaaaccactatgggctgacagaatctactacagttatacactaaagaaaaaacagtaaaggccaggaaccgcatcctgtgtagctgcctttctttctccattcttgggctattattatctgcccatgtacattccaaatctaacaacacctgcttatgattactgttgtacaatacctatttgtgattactgttttatatagtcttacatttttagagaaaatacaagaagaaaagaagagtagaatagatttgtaaagttcctgaaataccattgctggttcctccatttctctctgctcatttgacttaacatcttcagtcatatccacacaccagcacatgcacttttattacaagcagtaatgtttttatcctaactacttcctttatgctgagtcaaaaaatgttttatttatttatttatgatacagggataaaatacagttttatagatgttactcatgaaattactttttaaatcagctaaatgaagaaaataagtgtattattataatccccccacatacactttctccaagaaatgctaaggaggacagtgcctgcatctcccagactgataaccccttgtcctgtgactgggcaccaaaaggacaatggtagtaccagtccttctctcattgtctctctgaatatggactctccatcttaagagcaagctggggtagagtgatgaggtcagtgttcttggcccacagagcctaggacagaacgactgccatgtaagttggatctgaataggggaaaggctgtttctacccaaaaaaaaccagagtatctgttacactgacatggggagatgacgctcctggggtggagttgtcacaattagactgaggtgaggaagagagagctgtgcttttgtggcctcgctcatccagaacggtcacacagaacgtggttgtgggggtggggccatggattggggattgctgtggactatggtgcagatcctacagattcgggatccttgctgacatttagtagagttccttggataaatacttctccattagtgtgaacacttcccagagactttaaataggtgcttttcaatttttcaccagcgaaatgcctgttacactggagggaaacaacaagcttcccacaccatcctggaagtcccaacccttacatttttttttctcccgggggaaaaatatttcttttgttggagactttgccacatattatctctcctagaattcaatcaagtcgagatccgagatttcatgcaggcgcaaatgaaagcacacaaaatgacaagataggtttccaatataaggctcatttcaaaaaaccaagtgaagaaatcatttgaggtgctttgcagagtagctgctctccagaaatcgggcagtaatcagaggggaaacagtagtaattatgtgtaaatcactctaaacccgggaacggcagaaatcatctcatccctgggaagtgcttgagggttatgttgagactgctctgccgttaatgcaaccatagcgttgaaatttcaattgaagttttatgaaggtgggtgggaaaattgtctttaataaatattggcaagaacacaaaatagccctcatctggtttctcaaaacacataggacaggctgccatgtacagcagattttatggcagatggactgagtgagacattgttgtgcctctgaactctgtgaccattgggaagtttgtgtcccttctccctgcctcgctttctccgtctgcagctcctgcctcactggagcatgcagaaacgtggtgcccctggaacaggtgccttctgacctttgtccctttggacttcttctcagccccacaatttgttcaagagaatggccagttatgacaaagggcggtattgccaaagagaagatagccctagcagcctttgcttctgttcctagttattcatcctgtatgtcccagttctgaacagtcagcatcctttgtgcccccaaaaggacaaccattttccctggctttggggctgaaggggtaaatactgactcatctgttccctgggacactcctttcttgccttttcaaaggaagttcaggattgatggccaggggcacactggagactggctacttgcagtctgtgaccactgcaggggtgacctgatctctccctgcctcatcgcaaccttcacgcatgtactctcccttttgtatcaaactatcccactcttcatctctctattctaaacacagcctctcctcccacggcttcccagcacatctgcagtggggcctctcagctttttgtaaaataccatgaatttagatactgcctccttacttccctgcatgctatctgtccctccctttccatctctgtctctctccaagtccctcttcccctccttccactctccctccatcagtaaatcttccttctctaaacagcctggtcaccatgatgacctcacctccttgacctttggccttccttatcataccatttgtctcaaggcttactctgggcctctttccataacagcctactctgttctctcttctcctggccccaagtgctctttatagagacaacaggattccttccatacccatccccccagaatccaggcttgaagcccgataaaaggtagggctcttctctagtcaactgaaatgacagagaagtaggcatagtcagtcctgtggaatgtcccagagtccaaggaaaaacctgctgctggacccacccactgtgttgtcctgttgaaatgctcatttgatgctgctcaaacctctggttgaagagaggaaagaaactcagttattaatgtaaactgtcttactttaaaaaaaaagatttatttacttattatatgtaagtacactgtagctgttttcagacacccccagaagagggcatcagatctcattgtggatggttgtgagccaccatgtggttgctgggacttgaactcaggaccttcagaagaacagtcggcactcttaactgctgagccatctctccagcccctgtcttacttttaaatgttgccaattattctctctctctctctctctctctctctctctctctctctctctctctctctctggtttttttgtttgtttgttttgagacagggtttctctgtatcgccctggctgtcctggaacttactctatagaccaggctggcctcgaactcagaaatctgcctgcctctgcctcccaagtgctgagattaaaggcatgtgccaccatgctcagctttttctttttctcttcgagaacctgggagcagggctggatggaaggctcagcagttaaaagcacttctgctcttacagaggctctaagttcagttcccagcactcacatagtagctcacaactgccagcaactcctgttctgggagatccaatactgtcttctgatttctgtgagcatgctatgctcaaatacagacacaccagaaaaggatcacacatacacatacaattaaactaataaaaatatctgaaagtagtagaaagaacacctcccacagttactcagttcccatttctggaaggttactggttcagggtgacccatttcagtaccccactaaaggtagctcagcatggtggctcacatctgcattcctagcacttggggacccaagtcaggaagattgctgagaattcaagggtagcctgggcgttccagaacaacctgggatatattgagaacttatctcagagagagagagagagagagagagagagagagagagagagagagagatctgtatcatagacaagtttacgtctcactttgaaggtttactgtgtttcttttctattgctgttacaaaacaccatgaccaaggcaaatacagaaggaagggattatttgggcttgtgattccagagggttaggtgtccacaatgattgaaacagcatggcatcgtggaccgacaatggtgattgaagctggaagctaagaactgagaactcacatctccaactataagcaagaaacagagaatgtgaactgggaatatggagacatttgaaaccacacagcacacctttagtgatgtaattcctccaacaagatcacacctcaccatacagtgccaccaactcgggggcgggggggtcaaatatctagatgccagagcctatgggaaacatcgttattcaaaccaccacagtaggtaggtaccaacagagtcctaatcaatgacatttcctggttttatgaatcatgatttcatctaatcccagtacccaaataatgctgtctaatgatgctggagcaagttcattttctctgctgattaactcattaaagggcaataaagaagtgttactggaaatgttgggaagtcttggtgggactaacatatgattccagggaagtcagagtctccttttgaaattgtgttaataaaaaaatttgaaaatgaattcaaatggaagctcaagaacagtttatcagagttttaaaagaaaagccccaggtcagagaaactgtaaatcttgcatttgcctggaggaggagaatggaaaagaaaagggggaaaagtcatggcctttgagataagctgacatagaggtcagccatgtgacagggagagaagagtaaagaagctcaaagcgttagggagcttaaaaggaaaatcccagtgtaggcaagcttcaaatctcacaactgcccttggggggagtgtggagaagtgaattggggggggggagcagtcatttgagaatgcactggcatggggatcaacctgtgacaatgggcagccacatgttagggagaggagctttaaagaaagagtaaggaagcccaaagtaccagggagtttaaagacatacttggtctctggccaacgtccaaaagaaaagacagtagagaaaaaaaatagttacaccttcctgaggcagggtgagaatcctagaaaggaaaggtacaccaccttatggtgaaccaacccatcattctaaaagtggtgccttaggtgtgttcttgacctgactgactgaattagctcttaagggaggaatcaagaacacatctccacctagaggtagattccattcttcactgtaaccagggtgtggatcccagaagtaaaaagaagaagaatgtgaaggggaggggcagagtaaaaggtacaaaagttaactcagaatggcttgatcaaagatgcacatgtaagaactagagcttttaaagttttagaaggtagcctaaatcttcataaccttgagttggcatagacttcttagatatgacaccaaaggcgcaagtgacaaagaaaaaattagatacattgaactttgtcaaaaggaaaaaaaatgtgcttcaaaggccacaatgagaaaagtgagatgctctcctaacaaagaaaagcccacggccggatggcttctttcacttctgaattcttccagacttttaaaagaattaacaccaagtttacttaaatgactcaaaaaaaaatgaaggggaagaaagaatccttccagactcattcattattctgaataaaaacaaagcatcttaagacacatcgaaaacaaaactacagaccactgtcccaatgaacaaagtggaaagcttcttcccaaaatgctaactcaccccagaagagaaacagttaaggggtaagaaaaacgcctctagatggcacaggatcaaaacctagctgagctgtagagtgagttgaaggcaagtctgatccactcaatgaggtcctgtgactaaaataaaaataaaattggtgtatatacacagtggaatattatccagccgtgaaaaagaaagtcatttatttgcaggacaaaggctgaaacgcccgatcttcactttagtgaaataaggcaaacccagaaagatgagagtgacatatttttctctcatatatggaatctagataaagacaaaatgaaaatagagtacgactattaagatataatctagggagtggagaaaagagataaaataggatactgaggggcaaatgtgattaacagtctatgggtatgcagaaatgtcatgatcaaaaccatcttttgcaattagtttactttaatttttaaatcttgcttttaaaattaggtataagccaagagcagtagtgcatatttacttatttatttatttatttatttataatcctagcacttagcaagaaaagggaggcagagtttggggccacactggagtacagagcaaataccacaccagcctggcacttactcatcaacatgatgagatcttgtttcagaagaatgtatatgtttagtttaagtgttggtggcccgtgcccatcatcccagcagttgacaggctacagcagaagaatcataaatggaaggttaacctgagctacaatcttctgtaactccagttccagggtctctgatgccctcttctggcccccacaggtaccaggcacacacagggtacacagacatatatatatgcgagcaaaacacctataaaagaaatgaccagcttaaaatagaaaaattccaaatagtctgtactcaaagtagatccacaaatgagcaacaaacacgaaaaaacccaaaacattcaacatcattttccttgagagaaacttgagtctttttgtttgtttgtttgtctgtttgtttttgtttttcgagacagggtttctctgtgtagccctggctgtcctggctggcctcgaactcagaaatccacctgcctctgcctcccaagtgctgggattaaaggcgtgcgccaccaccgcccgctgagaaacttgagtcttaaccacatgaggtaccacctcacacctaataagatgactatggtctctctctctctctctctctctctctctctctctctctctcacacacacacacacacacacacacacacacacacacacactttcacacacacaagattatattacaggcaggtttattaagaagctgctctttggtaggtgacttcactggccccaaggaccaaggctagggaagtcactatgggaaaagagggggtaggggagggagagagaaggagagaaagggcacaggtgaagagagaagaggagaaaaagacaactgtgattttttgtgtgttgtttttggttttgtggtactggggtttaaacctggggccgtgtgcacattaagcaggagctctatggttgaaccacatccccagcccagcccagcccagcccagcccaggatggaggtaatctagtagatagataataaaaagtgttgatagagatatggagcaattagcactctcagacattgttgacaggaatgtgaaataatgcagtctctgtaagaaacagcccagttttttccccgaaaaaaaattaatcatatgacccaggttaccatataatctagatactctccatgtagatataccagagaaataaatgtatgtgttcacataagaacttttacataaatattcatagtgctcatgcataacagctagaaagtgaaaatcgcacaaatttcctttggtatgtgagtggagaagcaaatccacatgatggaactcagttataaggaatgaagtaagtcagacatggtgacacatagctaaatctcagcacaaaggaggctgaagagagcaatgaatttgagaccagcctgggctatatagtgagctcaaggtcagcctcaaaaccagaatgagaccttgtcttaaactcaacaaagagccccctccccaatgaattaaagatatgtgctgtaacatgaacgaactttagaaacattgtgctaagtggaagaagccagagggagagcctccaggtttgagggagagcctccaggtttttagtgattccatttatgagacgtgctcaggtgaggcaaatccatagagacagaatagactagtggtttctagtgactaaaggagaaaggaaatagagcactaacaaataaatttggggtttccttgcatattaaagttaaattgtgagaggaccacacagttctgaacatactgaagtccactgaattatatactttaattggttgactagatggtatgtgttttcaatcgctacaacacatatatgtgataatcaacttacaaagcaaaaaagatttatttatttatttatttatttatttattcattcattcattcaatcattcatttatttatttccctgcatggttttggtgttgtgtctttgatcaattggcctcactattgagggcctgtggcagtcaaacatggcaggggtgcagggcaaagccaaggagctcatgaatggtcagaagtcaaggaaacaaaggaagagaaaagggtctcacaactccttcaagaacacttcctgcatggccttaagacctccccactatgcctcactcttagcgtttagaccattttctcaatggcaagaagctggtaccaaacctttttcttccgcctttttcaagccaagtttcttcaaggctatacattttagttcttcatttttctagataaacctcttcaactgttgttctttcctttaccatttggagcaatctgttgacttctgcccagctggctgaggaggtaatgccattgcatcatttgtcatcattcttcatccctagtagtgtttgtagtatcctaacacctttatgtccctgtcattggttatcaattgcctttcaacccctgcttgatgagataagatgctggtccccttctctgtacctttctctctccatccaactctcactagggagcatttagtaacacatttggttcttattttattttattctagtgtttacgagataaagtttccagtagtccaggttggcctcaaacctactatatagccaaggatgtccttgaactcctgattctcctgcttccacctcctgagtgccaggatttcaggggtgagctacccctcctgcctagttctaattttcaaaagcacttggtcttaaaagtagacatgaaggatggagctagtttttcctgagcatccactagtgtcaggagctgtgcatacatcttatttaatccttgtggcaatcctgaaaagggaatcacatcattgtgatctgagacgtgagaaaactgtgagcaaaccacaaatctggtagggacccaagctggatttgaaccaaagttgaactacaaagtcccaatccttttcccagaggcccatgattcctccagcttcgctttcatttacaacattttgagttccttttctatgaccaaagtttggactgaaagtcattatctttttttttttttttttgaaccccataacgattttggctcgttcaccagagggcacaggaaagggcaacttaagaggaaactgaaggcaattgcactggcatgggatggaaggagtgggccatttgctgagatggatagtttagctgcatgccttggcaggcctccctctctacctgtggcctagggcttggcctttggaggctagcacagaaatctcaggtggtgtctgaggtgacactgggggccatgtgatagcatcactatgtctctcccagtcatactgcctggatgtgaagcaagttttgaattttgaaggttatatagctgactcagaccattgctcgggcattgcggtcatagacacatgtgggaaattcccaaactaactttcccacagagctgttttggagtgggggacagaaagaggccaggggtggagaatgtattttagttatttatttgattagtatctgttaaattggcagaccacttcaaccagaggctcggagtgggattcccccaggggtcacttccgggcatataagagtctagaggttagaaggcctgggctcagttttccatacggagtggaaaaggccatgatagaataaaactatctagcttctttttattcatcttcatgctactgtcatagaaaagcatgtggatatccacacccatctgcttccctcaaccctggacaaccagggttcttcctctgttgagactctaggcatcccccctgccacccaccttacctgcatcccagtctttccacgtccttgcttcagcccttcttcttggtccctggcttaccacctgcaccgtacctccaaagtcctcccaccctgctgcctgaccccagttcatctcgttaccactgcgagatggatctgcatacagaacagctgtctgaggactttcccaaggttactctgcatcttacatcataaaatccaaatgcctccgttcaaagaactcagccagtcctggcccagttgttggcatcctctggtggatagagagctccctgaagacagacgagctatgtcggtacaggttaggactagggctgcagagatttcttaggacgtaacagggtcaggacttgttagcacgaaagggtgagtgtgacaaggacatcgtggactagattatgcctcagtggtagagtgctttatctaccacacggaaggccatgggttccatcccagtgttacgaataagatcataaaaaataccttgcatggctttgtgtgtaaaagagctgtcatttgacttattttgataaatagctatgcaggggactctttcactggctgaatgagtagccttggataaatcttctgattttctgagcttctaatcttccacaagagtctcaaatttacactcaggacagagtggcccacagaggtgtttgttgatgaacacacgaaatccatttgaaatgcctgtgtccagcacatgcatgctctagttgtgtagtgtgccagcctgtttcccccctcccctgacgcaccccatcattttcatttgctgttcagtgcctgaaagcatttacatttgtgctgctgggattagactgtgtttactcccccttttaactctggcacgctggaattttgtttaacctgctttgaaaggaaacgtgctagtgctttgcttaagcggtttgcaatgccatctagtagccagcagccaggcacgactgaccgtgcttcctgaaacagcccaggaaagaacagtagtatttctgacttgtgtggtcagctgcacagggagatgatattccattgaaagtgattgtttttagatacccaagcacaagtggtgcccgtctacagtgcagaaaggaccaagcacagtgtgccattggcagccagctgggcatacagagggcattggttggaagcacaaagtatggatttagcccaagttgcctggcagggtactctctaggacagggtattgaatgggagtgtgtgctggatatggcccaatctatggagggactccacagagccacacacagagggcacagggagatgagggaagcatttcccccactggttccttggcattaaccagtcccaagggctgcatgagctgcaaatcagcctggccataggccagcagggcacagctcccttagagatgttagacagacacagcagcaactggaaggcagcagctcggctccagcagcaacggagcccaactcttttggggcagcatctgggtaagaagggctgagaactgagtagatgctggtgagtgtgtgggcccgtcaggagccatagtcaggcactgggtggaaagcagaactgctgatagctacagccgcagtgcacacactgtgttagagctgccctaaacttggcatgaatgctggagaaggactgtccttttggggaatcacagtggccagtaccctgcatgtgggtagtcatgggcttcaaaatggtggctaggaaagggatgggagagaggggtggcaaaagggaaaggcccacatgtctgactaagctgtctcatgggtctgaagcaactccagggtgcttcccagggaaggagactgatgcttggcctccctaacccggttctttcctactctgcttgcttatgaattcaaggagacaagtttcccatagtcctctttggcaacattaactagaatggaaaaggtaaactttgcaaagcaacttcacggcacacattgcgaagtcccggggaaatgttttgacatgcttctcgggcacggtttcttttgtgtgactacagcccactcatgtcaaccaggcactgagtgatacacttgggattgaggcccacaaaaaggaatgggcactcagatggtgggggctgtcaggcttcacaggtgctaaaggatgataggtgctggctgggcgaggctcagtcgtggccaagaccaaagattgggaagatgaaggagggtggatatgtggagatggaacacgactggaggatgactggggttgtgcgatgtgtatatgtgtgtatgtttgagacatgtttggggaacctctctgtagctgtggcatgtggatttcttctgaacagcttgaaaccagaacgctctggcactgacggcatggctagggacaaggccagagagcccagtgtcagataggtaggagcagcaggaactggcaaccagacctgtgtctggcagtggcagaccccctgaggtttccttgcctcctccagctaacttgcagtttgctcaacggaagccacagaaacccacacaccaaactgtgccattcttggtgcattcagggcctcctggggctctgagtgcggacagttcatgaagctagatcttagttgcagacatacatatacctggtcctctgtagctaagcctatattatcactgcctggccaggtggcttgctgggatgtagttgcttgctgagataggagctatgtgagggattctgggatctctactgtttcttttcagtactaagagttcagagcacactaagggttcagagaaatcccgggctctgcagtctgcccatctttcccatcacttcctactagggatacctgagaaggtttgatacagaagctagccagcacttggcccttcatccttttggctgctaggcaactggccagacctccatggtgaaggtatccattctatgagggtcctatgtgagtgatttaaggacaagcatcctttaagcagcaagcctttggtccagcaagtgggccctggcctggggatgctaccagatgcatacaggaccacactctccagcccagccctggcaagtagcatttgaataggagccggccaagtctgagacagcttgtggtatgagcagccacaacaccagtctcctcacattacttttgaaaacactgtgcaggggaaagaaggccaaacccgaagcatctgtgagccatattcaacctccgtgctgccagttggtgactgatgggaaaagcagcactcggtcgcacatccctgagaattctttttgcttagtgaactgttttcttctttaaacattttttatttatgtgaatgtaggggagagtatgccctgtgtgtatgggtgcccaaagaggcccaaaaagggcatcagatcctctggagctggagttacaggacattatgagtcatccctcaccccagtgtggacttaggtcctctggaagtcagcaaggactcgtaagcactaagctatcactcctgtccccagttgttttcttggtcttctaaaccctgctccttgagacaaatcagcactttaaaaaaaaaacctttttaaaaaaatattttatttatttattattataagtaagtacactgtagctgtcttcagatgcagcaaaatagggtatcagatctcactacaggtggttgtaagccaccatgtggttgctggaatttgaactcaggacctttggaagagcagtcagtgctcttacccactgaaccatctcaccagccccaaataagcactttttaattcaatccttagtgttgctactgaaatgcagttgaatatttattcattgatttattcattcattcaattaactttataaagagaccatgtctcacatatacctgtagtcctagcactggggaggctgaggcaagagggttgcaagtttgaagccagcctgggttatgtagtgagattgttttgaaagcaaaggaaagcaaaggaaagggtgaataaaagcagtgtgttgtataagttggtcttgaacttctggacccaacgatcatcccacttcggcctcatgtgtggatgggattactgccacacaccatcaggcctggctttcaacaaaccttcattaacttcattggcaagggcagtgctgggttgcatagatgaagaaataaaaaaacaatacttgcctttaagaaatagctagtctattggggagagaagcagagaagagctccctgagaggggcagccctgaggctggaaatagaggaaggagacatcgccaggaccaacaggatgaaagtgaagagaacccagctgaggaacacacagggctttcctggcctgagaaaccttgggcagatgccgagcattctggaaggcaatggcatgctcaggcgttggcgggcagccctgtgatgggtgtgtaaaggaatggagagctgggagcggcaggaagtgaggcgaatcttttggggcctggtgggccatgatgtgcatcctggccattttccctctgaaggcagcagggagccagctgaaaggctacagggcaggcagggacgggtctgtctgaccttggctttggatggtccacactaggggcctgaatgtgtcaggtggatagaagggacagtggaaaggtgctcaccggggaaccagatcctcagtgcttagacttgctcaatctagacctgtagactggggatgggggtagggggtgctgaggtgtgaagatatgctggtgagccttctgtcttttttgtgacaaatgcttgtaataaacaacttataagaaggaaagggttatttgggcagatgatgtaagaggtttcagcccatagttggctggttcccttgctttgaatctgtggaagtagaacatacagatgagggggagaagctacttaccttaaagcagtcaagaagctaagggccccacctactaaaacacatcagtgctatcacctaagagggatgtgggaagctgctactacagccacctgaactcagctcaccatctcatgggggctggctcctgtgagcatctaactaccttcagtccccattgggcatcacaaaggtgacacattttagaagcaaacctggccttgtctcccaccgttgctccaattctccctatcatggttaatgttaaacggagctttccgactcctcaaaaccaaatggcctcaattcttttcccccatcctccacgtttaagtcacgttgtttccaccttcaaaatagatctggaaccaaatgacatgccaccacttctgtggcctgtggcctgtggcctgtgtgtcacctctcaccttgcagcctgtgggatctacaagcatcctgtggaatcttctggtagattcctccctggcgcctctctactcgtctcaacagcacagctagtgtgatcctgacatgggcccttgccttggcacaaatcctctctgataactctctctttcaggttactgtcacccctgcgtgtgtgaccatatgctgacattctgctcctggttagtcattgctccagccacagtggcctccagggcctttgcatgtgctcttccctttacctggcctttcctccggattctggcgcagccccctccctccctccattgagaacttggcatactgcttcctaactaagcttctttggtcctcctgttaagagagcagtgtcccagtcctcccggctccggagctcatcttttgtttcatgtttctccaaacgtcttgcttcttgcatgttcgaatcatttgttttatgtgttgcctctctcgcccctccagaatgcaagccccaagcagcgggtgcttttccctctgctgcctctccctatggtttggattgtgccaggcacatagagactactcagcaaggatctactgaatagaggcgcagaggcttagtatgggtccctgagttgctctgagccacctctagaccacatgatacagaattctcaagagtagattgtttaagagcagcagagattcaagtggattataggagttagcaggcctagccagaggaaccttggaccagccccttcccctctctgatcttcagtgtgctcatttataaaatgattacaaacactgggatggaagatggtgagatggttcacaagggaaaggcagttcccaaaagttgtcttccaagattttcatgagcatcaagacatatgtgtgtgcactcaaacccaaatccaatatggttgccaactaactagcttgctctgtggaccctgtctctgccttctgagctagaattatagatgtatatatgtacacacacacacacacacacacacacacacacacacatacacacacacccctaattgggctatggcatggctcagtggcagggtacctgcaatagcatgcatggagccatgagtttcatgcctggaactacaaacacattaagtaaataatatttaacagattaatactttatattgtgatgcaatctggagtcaggcctggtggcatgggcctgttatcctgcctgtttaggggactgcggtgggagcatggaaggcctgcctagagtaggattcagagtgagttcaagggcagcttgggcaacttagaaagcccctttctcaaaataaaaactaaagaaaaagactaaaattgtagttcagttataaagcagttgcctagcacacagccctacattcaatttccaataccgcataaacaaacaaacaaacaaacaatcacacagtgttttgagttgctcagaggtgaaataagcaactgatccactgcccttgccactcaggtcccaagacagaaggcagagatttctaggcctgtgactccccatttctttcttaaactcttctgaaacgcagtcttatcttcaacctacatctataaataatactccattacagctgttcaaataataatggggaagggggctgccaggctgctgcattcagttgagcctacagtggtccatgaagtgggcttggttctggccatatgggtcaggacagggcagtggtctgagagacaccagtggtgagatgacagtccagcccacttctcaaagccaacatgcctaccatggctagactcatgagggcccacttccactcctaggctcagctttcttatctaatctagccagagcttccagtttaccaagtacctgtcacttaagatgtaatcctcactgtaactgcagatcagtatccttgggacaggcacaggggtggtccccacacaacctcttccttcttctatagaaattaccagatacttgctcacaaatgtctaggctggagctaggagagagagagagagagagagagagagagagagagagagaatgcttcattctttctttggctctgtgtaggctgcaggtggagcctagggaagggaaagcaggccaggccagatggaaaccatcactatcccaccggctgagcagaagggaggtgccttccctgcctagctccaccaggaatgctgaggttcctaaggccaattgcggggaggggacaggttactgtaggtgatgaactattttcctttctcactctgagagcacttggtgagttgctctttgttacagtagaaacagaaaaccagaaaagcccagcaggggttggccaaacttttcctttgttctgctgaataggatgactagccaaggggctgggtggggccagcacagggcaacaagtctgaaggtaaaagactaggatagaattctagcagaaacaacgacaataactaaacacaaaaaagcactgaatgcacccagtgaggaagacgcctatccccttacaggtctaaatctgcagccgtgaaaactttatttttagcatccatccatccatccatccatccatccatccatccatttatagcctatggctatatcacaaacagcccacaggccaagtcctgagcttctgggaactgggtgggggggagaacaaaacaggcaaggcttctccttttttcttttttttagaaccaagtctcctatagtccaggctagccttaaatgtactgtgtagtgtaggcagtaaatgttataaagaaaagaaagcagtgtagtgtggaaggctagggcatgtcagcagtctgtcgacagggatctaggtgtgaaggttgagaaagggggctggtgagcatgcggtatgtatacagaaaggtgatggggttaagcaatggttagctggttttcagcttccctggaggttgtcgagtcctgtcagggagatgtctggtgataggttctctgcacagcacgctatcctcagtgttcatgagccctgctccttcacatggcgagactccatctcatctctcatggcaacacaggcaccatcacaacccgggttgaacacctttgttcactgcatgtttgggcctctggtgctcagtatagactcggcacttagggaatgcttactgaaggaaggaataaatgagtggctgttgtttcctctgctttctccactgactgggtcatccccagccctggacagatgctcagcttatctttcattccatgggaaaagcctccctcagcctcctcgaacctacctgtaaactcttgactatctctgtgaagccttcttgacttccccaggcagggttgttccctccatcctccgaacattctagcacactctatctcccctcctgttactagccctgatcactctatggtgtttgttttgctgtcacctctcctaacctgtgatttgtcttagtggcaaggaggactgttttcatcacctgtgtatctctagcactaacccttagatggtgcccaataaaaatgtattgaaataaggctgggaatatagctcaatagagaccgtacctaatatgtacagagccctcaattcaatccccagcaccaaaaagtggaatcgatgtgggaaaaaaataacgatgaagttttttgtcagcctttgtgtgtgtgtgtgtgtgagtagtttgctggaactggcttgtagtggttagtgacagccaattgttaaatatttaggaatgtgtgagccaaatagtaaacattccatctttaaaactgcaattacaccagaaaacagacgacaaactgaaactgaggggcagtcaacaaaataactgaccaaaaatattcaaggagggatcctggagtgtatcctagaagagaaaaaagactgtatagggaaacctggtcaaatcccagttatttcgtatggtgctgcaccaaggttaattcaccagttttgacaaatgcttgataattatttgagatgccagctgaagggggagcttggtgaagggtgcacagggtggaaaccatacagcaaagagactcgtaagtctaaaattattctgaaattttaaaataaactgttaaacaaagatagtaaattttataaatctgtgattaggtaaatcatgtcgaaagcaaaggtgatcaatacagcttctcacttcctaattctcttgaagctttccaccgagtctatgcccttgcacttcttgctctcccctgtgtatgcatggcacactgcaccatagctcctcccactttgtgccacatttatgtcactttggaagctcgaaatgggcccaaatgtatctacatcatggaaatctgaaagtgccacaaatcagggctggggttcttgttctggacaattatactgtagacttaagaaagtgatgggagcttagcatacatgaggtcctgagttccatacccaaagggatcaggaaaggaagaggaaggaagaaggaaggaagaggagaagaaagaagaggagaaaggaagggaggaggaagagaagaaggaagaaaggaaggagaaaatgttaataacatacatgaaccttgaatctgtggtatgtctattgctggtaacttcatgtgtggtacacaaataactgaggaatgatgctctcagtatgcatgatgatttaacaaaaaagttcacccaatgacaaatccatgagggtttactgcttctttagtggctcactttctttttacttatgaatataaatgaactgtctacctaggaagtgcactggcctttctaccacagccagagtctggctttgaatagaaggcataagcaagatcaatgaaagcactatgtgagatttaatcagccgtgtgaaatttgcaacaaagaatacctgtcttatcactgtttataaactgtgtgttctgttgtcttagataagtagatgtacagtgctcacttacctgcatgcacacgtttttgagagaccattgatgaacatcttttagagcatcactgatcccagtgactcactttgttcttaattgcattaaagagaagaatatctgcacctcctctgggccacgccacaccaaccctttaatatggagaccttgacgttgctctttgcctcaactgtgtgaaagcattgtggtctctattttactaatggggctattgagacccaaagaggttaagtgaggaggccagaaataaaacactgcttatgcctacatccaaagctacttattagttcttgttgctgctgtaacaaagtaccataaatgtagcagtttaaggcaatacaaatgtattatcttagccctgcatgcctttaatcccagcacttgggaggcagaggcaggcagatttctgagttcgaggtcagcctggtctacagagtgagttccaggacagccagggctacacagaaaaaccctgtcttggaaaaagaaagaaagaaagaaagaaagaaagaaagaaagaaagaaagaaagaaagaaagaaagaaagaaagaaagaaagaaagaaagaggaaaaacagatgtcttatcttatggatctggatggaggttgaaagtccaaagagatctgaactcatacttgtgtaatgagtggtttactcactgaaacatctccccagacctatttcatctttttgattagcatatgtttattatacatgatagctttattattgcattttcatatatacacacatataaagttctttttatcatagtcatgccccgctattatctcctgttctccttccattcttgcttatcctattcctcctccctgacccagtccctcttctgtgttcaggtttgtatttgcttggttttgatgacccaatgagtttcgttaggattgtccacaagtttacaggtaccagtggcaactgctgtaagctcaagggccagacagctgttccatgttctatgacagatttcccagcactcccgctgacccccccatccttcagctcttatattctttctgcactctcttccaagatgttccctgagccttggaggaggggttacaaatgacctatttatggctaagccatcacttatcctcatcaccctgaccaggccttgtgcatcttcttcctaggttttcatatcatcctattcttgaaagtgtcctttcccactcttgccaatggcacagtcagtttatctgtgcttagtattcctctgcatgctctttcaggctcaagctgtctaagcaacagttgcctacctttctcactctctacacagggagcttcctgcttccggccatgagaaatctcgcctcctgagactgtgatcagaagtctctcatgccccagaacatgacaaacagatacatctcatcacagcttggttttgccattggtcttgccaaaaagctgttcccttctctatgccaactccatacccagcctttgaggtgccatctgaattgttctttggtatgggcgcattgaaattttttaaaatttactttttttcacagttctttgtatatgtgcaagtgtgcacatacacgcacgtgctacagggcacatgtggaagtcagagagggtgtgggggttggctttctccttttccatcagtagcacttatttttgacaaacatcatttatcattatggagaagctacagactggtgaccactgggctaatagccacaaattgtgtcccagaacagttaggaatctttccatgtggtctggatttctggctcctttggaaaaacagaaaaatctggtattactagatgtgcatttccacaggacagtaggtaactagattgggatggtggcttcccctctaactagaacaatgtcctgtccagcccttcacagtccccactagtccttattagattcccccaccttttttcactattctgtcgggttggctcataaaggcatttgaattaccttatctgaactatttcattcatgcccaagttcctacatataccacgacctcttatgtacatgtgaaactctgtgaatttcttctgtttctctcatgctggtactgacaaagtgttccatcaatactgagatggaacaatttgccttgaggtgatccttttttcattttatgtgtatggatgtcttgccagcatgtatgtctgtgtagcatgtatgtgtgtgcctcgaggtaagtttagaatgtatgtgaatttactttcgtagcacgggaaggcagtataaaagtagcatttgttgacagacgctcatatccctgactcagaggaacactgtgtggatggcaacactgctcccatgtcacagaggaaaactgaagctcagagagccacacggtaggatgagccttagtttcggtagtcagtttctgtaatcagggccaaagactttgtcgtataaagcagcttctggagacggagaggagctgccccagactctcttagaaagagagcacagactctgagaggtttttctgcttagacagagatcaggcatgtgtcatgcacctactctgtgccccgtgccctctcgggaaccccaagcctcctggtaggtagcccactgaaaaggtgaaacagatgaggccggattgctgttgggatttggggcccatttgatgagtcgcatttgattctgtcacaattgacagaagcaccttgcctgtgtgtgctcagagcttgctactcccatgtgccgtcactggcgtgcggtgtggggtgggaaaacacagagaaattatgcgtgcctaattgtgcagcagcaagcaggaaggaatgtgcgcacgccaggggctcccactggggcagcagtctgctgtcatgtgtttctgaacagttgcaggaaaacttgtctggacccttggatgcagaggggtgggtctggcagacgtgggttgtaactttggtggcagaaaggatttataggaagcagatatttagagtctagaaacttttctctggaacctttgtctgcttcccccccccccacacacacaccctctagtcacctccagttcttagccctggctaagaaaggagctatgtaggaagacctcaggcatggggccaaagtgttcttcaacacctgacatgtccacagacccattttagggtcaccaaaatgtgcctgctcatgttggtgcatgtactaaacctctggaccacaagctccaggccagccatgaaacagggaagataggtcagaatggggtgaggatgctagtgtatcaggtaagagattgtcttttacactctatgggatgcccagactccatggtccaagcacttcctctggtcctagaagcacaccctcagtagtccactcaatctctttgaagtcacatggcttacctctttctgtgtgagaaggcagaaggaaatgtttgcctatgtatcaagagatgaacgtttaagctccatagtgatgcatctaaataaaaaaaaaactattgtgctcagtgtgtatgcgtgtgtgtgtgtgtgtgtgtgtgtgtgtgtgtgttactacagatgaaagctagacttcacacaccttaaacaaatgctgtatctgaggtatatcctgtccctgttcattactgagggtgctattgagggtgctagtctaagatatttaaattcactatttcattcttaaaagaaaaagatcaagaacttgagttaagagaggaagactaagtcatcaaaagtcacccagggaaccagtgatggggccctcttgagctccatgcagagccagcataccacctgctagttccacttgatacacaggaggaaaatggaatttaggaggttcctagcatcagaggaagggctggattgtcctattctgtctctgctatctagcttgctgtgtgactttaggcacattactcagcctctctcagctgtctcctgtttgcaaaaagaggtagagttggaaatgtcagcgttccaaacctctgaaagcctataccgtgaaaagcagtattagtaggcagtagagaggagggaacttcgaatgcccagatgcaaaggatgggaagttgacctgggtgtgccttggctttacgagatggaagcaggcctgggaagacttgtcaaagtggatacagctcacaccaccccctcagcagccattctgcaagtagccacttgaaccaggtgatcactgatgaccaggttcagcaggcacacctacacagtgggctgctgctgccacctaggggacagtggtgacccggagcttggactgtacagagctgtgattcagtcacttgctgcacattccctgtctcctgctggtttccggagtggagagagacagcctggccctgttcagtggtggggaggggaatgaggcagagcgtcaagtgccgcctctgtttggggagttataaataaatccatctggaagtgtttggggctgtgagagctgagggctggccctgcagttcagaccatgtggtgcatatttccatccacaccagctcccccacccccagtccccagagactgtctgagccgggcaggaacgtctcaggccccacctcaactaccagcccccacccaggactcctctattctggtgcaatccacaagatcatggctgagcactactttgaatttagttcagtgggcccttgatgcctgacgaatgaatgatttttgtagctcagcattaggcaggacctgtgttggaagtgaagcatgctaggtttttaggatgacctcagcaggcagctaaagctggcctgggtgtaaaggcgctgcccgagtgtgcttgtccccttgtctcgagcacccagcagcatgctgctcagtcacaatgaagccatggaatgatttattaatgtctcaagcacctagtgcgcacccttctctgctggacaaggaaggtagaaaatgacagcctcggagaacttgaactcagagttcgagttgccccttatctatggagtgccagctccaagacacccactgagtgtattgttcttcctttcagaaagccctatgacaaggcccaattgataaactagtcacaggaggagattaacaacaactaataagcagactcatagccacaaacgtctagaaaagttattttttaaaaattcacaattgtttatttctcgaagttttccattgatatttttaaaactacaatgtccagtgagtagaagaaacttcagacagcaagaccatgtgtgcagtgtgcagcatgcagtgtgcagggggtgggcagcatgggggcagctgcacactgttagcagttgaggctacacagttctttgcagtgcgaggctctcctttgcagtgtggactttcctgacccaaagtggcagttgtactctggagcggctgggacaaccagacatacctctacacatttccaggtatttccaggggacagaagggacaggccctggctgcaggacatttggaaggaacttgacagtagggagctgaaaggaagctgctccaatgtgaaatgctaagccagccctctgcactgacaagcacagaactgggaaacgctgggttcaccccaacggtatgaaatgatccttaattgctggatcagatcccagaagcccacaagaccacagtcctaccaaactggattggagccaagaagcaagccacaagcatagcagttagggatctgctggtggcatgattgggaatgtccacaggctactgcaatccagccccagggacagagggtgggtaggtattgggtaggtgttgttggatgagaatacactatggtagaagttgcactggaggcctgagctcccattaaaatggctacaggttaaggtattggtgttaccgggaaccccccacaagcacccagatgaccactcagatacagttcatagacaactgaaagtctttattccagccaactggaactacactcaggtgttcgggacccaagcgtagcctcgagtgtttagggtaagggtgtaaagacaaaagccacatcataatacctcaacagctgcaggggaaggtctgcaggcaggcagtttaactgaggctaagttgttagctgggcatctggaccttggatacctggaatagagttagataatttccgcaggactctccatcaaggacatcagattctagttaaaactaaaatggcctcagcaaaatacaagatggaggaatctctgcatcatcttgccctgtcgcattgagaagggtgaagagtgacagcaggatataggcccatcatatagcacacaagagctgtgctgcctcttctctgcctcatgctcccattcttggtgcgagtatccccatccagggcttcatcttgtattgggaccatattagcagtgtcccaattattctatttctgtttctctgtcctttgaaatcatcagtttagttgtacaggggctagaacccaagactctccatagttggccacgtcatgcactcagctaaaagtatcttctggctttcaccccatcctaccatttgccagtgccacctataccctgcaccagtgccacttagcaatctgacctccatgacctctatcccttgtcattctggtcacttggttccagttaactttttccaggctccctgctttccttgatcccagaccttgctgtgtagccaatgccaagtgagcgtacactgccctttgctcctcatggccttacaattattcaatgccctttgaacttttctcaccgcagtgtgaattcttgggattcaaggcttggctgaaatgtttttgtctttaggaaagccttccccagtccctgagacaaacagtcaccctccccactctgtggtcagtccctgcactggttggtaagttgcctaagggcatcagccaggcaccattcagttttgccctcttcctcaacccccagtggggacaaagagtgacccagagataagattctccccaattgggccattctttatagctgtttccctgtggctactatatttggatgagggtttttgaaagagccaataaaggaatggctgagatgcagggccaaagccagggacagggaagtaagggtagaaaaaggaagggtagaaaggatagaagaagaaaggggatggcagaggccctttagcaggctcccaaagggcactctggtagcagagtggggtaaggaaggcagttcctgtggtgggtcagccaagtatacagttattaatgagcattagtgcccttcagtggcaagcatttcatgaaaggatgccttgctgggaccaaatgacagtcaaccgtgacactcttagtaaagagcagacgaagcatcgaggtaagagctgccaaactccttagagagatctcaagggcttcaaaggccactggaaccccagaacttcttttccggaagcctccctcttgcctaggaaaggtagacacaggaagagaagagacaaatgttgagcagcctctgccagacacatgtgacatacagagctcaatgacccttactatggctctgtgaggtacagaatgactccatttttgagattggaaaactgaggtcccggctgggttcagaatattgcccaaggacacccacttgagagagttggactcaggattctagtgtaggttacccttcccctgatgagtgggccaagatccagaggctggcagcaatttgatctccgtcttttctgactttggctatggggctcatttctttggattgatttatagaagtgtaaacaaaacaccggcactttttcctagctttggaatgggtccttggagtcatgcgctgtcctccactttctagctgggcacctttgctgaggggttcctgaaattgaagcagagattttaacctgagaatctgcagtgtgcgcagaaacactcagggtgctctttgtcatgatatacatccaaatgtgggcgccggcagcctggcccaggctttccggccatgccctctcagcaacctcaccagtatatgatatggctgatgcttgcctggcctcccagccccccctctccctgctttttaatttctttcagatgtctcctccacactgtccccactgtggtcctttgctttcacttagtgggtgatggatgccttctgtctgttgacagctgtgaatgacaggaagttggacagggcaaattgggacagcttttcttggaattctcacattgatgtacttaggctagctcttgtaggtagagcggctggtgccaggggcccagtgaagggagcaaaatagcacaaagccctagtagaggcttggctctgaggtgggacaggttagctaggaagcccaggatggctgttttctggacttgctctagagtcaggaatagagtagaaccttctgtgtttcccagagttgtgtgtcctgcttgagggacagtatgttaggaggtccctgctatgcagaggccttctgaaatcttgctgaaaacagaactcacattggtatgcacaaagacacgtagaggaacaagacactcatcctgcattggggcttgtgctctggccatcttattagagcaggacgcctcagaaaaaccttcagaacctattcagacgaggggtaagagaagatgggtggaactgggcacagcatgtgatacacacgtgggaaaacgctgtaatggaatctaccattctggacagtgagttgtacaaataaaaataaataaaatatatgcagattctgagctgcttgtgcttactcaggcctgcaaaaccagcagttagcagaacccaagcagaaagtttgtgagtttgaggccagcctgggctacatagaaagattctgactcagcatgaatgggtctgacttagatcccctgcatacatgttatcgttgtatagcttggtcttcatgtatgacttctaacagcaggaagaggggctgtctcagactctgttgcttttcatactacttgccccccactgggctgccgcatttagccttaataggagaagatgcacctaatcttattgcaacttgatatgccaaggctggttgacatccatgagaggcctcccctttcctgaagagaagtggaagagaaactgcagttggtatgtaaaattagttaattaattaattaattaattaattaattttttaaaaatcctggctcaaaagtaaacaaacaaacaaacaaaacccaagtctaaacaacaaagagtacagccacttcttttcacactctgtggtcctctgcatataggttgtggttgtgtgcctgcaaaagtggggtgcagccagcatagaaaccctgcatagaaagagcccagaaaaacaataccctcagctcactttctctttcttcccttgtccatacaggtgcctgccactgggtgaacgggactcgcatcctgagggcaagggagcttgctgatgtagccagcacaggtcagctaccagggccaaactgtcgggggtagggggagacgatgtgcaatgtgcagaggggcaagtagacaatggccaggcaagctgcccgtcttggtggctggcttctccacttacaacctccaccatttctggacatatttctcaattgcatttctcattccctgtcaccgttgccccttttctatgccgctattaataacggcacttaaccccatccatttacattcctcatttagcccatttccctactctcgcagtagagtgggagctccagcagggcaaagactttgttttgaacactgctattgttgccatctggtacatagtaggtgctcaacaaacagtgaataaatgattgaagggatgcactggcttgggctacccaaggtgagtctgttcttaacttttttgtggtagactgtagacatccaacttttactcatgcctactggtattgatttcttccaaaaaggaagaatggctgtcatgtcttcagatcttcaggtggggaagcctttgtcgctcccgggattgtggttacatgacgctttgtcaaccttagcctgctgtgtgttatctaagtgttagcaactgtggggcactggcccttcctcaaaaaacaccctctgcactagtgtacctgctttgaaatgaggaggattggagccacttccttcaggctcaagggcagggtgtctgggagccatgtcccctgccatcatgctgatgaagcctgtcaaattcagatgagaaatgcagatgtcaattcctagaacactgcagttgtgtcaaggatgttttaatgacacaaatactacaactatattcttagcaatgttggtgctgttgcagcgctggatggaacccagtaccttgtgtgtggtaggcaatcactctgccaccgagccgcatccctagcccatgaatacactgttattgtgaacaaaatcagtttggctgctgtaaaaatcctctccgtgtcaaccgtgctccccagaagtagccactgttctccacatggagtgctccccttcttagggatcttcatctccgtacatagcttggttttacatggaaacttaaaaccatttagtgcaccgaacacagtagttgtctgcagcttgcttttctcacttaataatgtcttggaaacctctgtgtgaggggcgtctacctcaccgttctcttgattaaacttcatattttcatcattgcagaatgacttgccatttcaaaaagaatacaggtgctctgcccccagcttttctctatgctcagaaatccagaacagcacacaagcaggatgctgacactggcccaagaacaagcatttccccctgccaagccatgcttacccaatgcctacttaacccttagcaatcatgctttaaaaagatttacacttgtgtgtctgtgcacgctaagtgcctgaaaagccgtggtgtggaagtcagaggacaacttgctaattctcttctttccacgatgaggggctgaggacggagctcagattatcagacttagtggcaagcactgagccatttcacagccccaccatttctttgtcttatttcattgaccagacttattgtacactatattatagtatgtaaggatattttcatgcaaatatatgctgtacgttgaacacattgtcccataccccttcccctgcctgtctgcaccaccttcatattagtactctttgtgacagtttcgcttctacttccatgtcctatacatgattttatgtatcgatataaaatctaggaatcacaagtgagagcaaagatatggcatttgtcggtccaagactgacttaatttgcttaacatgggcatctccccttgcatttattttcctgcatatagtttaacaactttgttccatttcttgaattaggtcatttc

SEQ ID NO: 593 - DNA, 100251 bp, mus musculus; identical to SEQ ID NO: 592

SEQ ID NO: 594 - DNA, 186365 bp, mus musculus; identical to SEQ ID NO: 123

SEQ ID NO: 595 - DNA, 59914 bp, mus musculus
agcgggaggcgcgcgctgctggacgtcccggccattcaggcggtgagcgccaaagccacccagcgctgctgaggcgcgcgtcgcgggggagccgcttgaggcgggctcctcaggagcacgggcgtgcgagtgagcggccggcgggcgggcgggcggtgtggggagcggagggaggagaactccgcgcgccagggggccccctcaagctccggccggggaggcggcggcgagtggcagaggcggcggcggcggcggcggcggcggcagcgcgtcctccgcctgcccctcggggctcatttacatgctgtcacggccccggcgcggactcctgagctcgcggctagctcacacgctcgcccttgggccaccggccgcggccgccggcgccgccaccgctcgagccgcggaaccccgcgagccgggagaagcggggctgccgccgccgaagggcgcgcgcgctgcggctctctctcgctctctcgctccctggccgcccgcccgcccttcctgccgcctcgcacgcaggtccggccggagccacgcgcgcacttgggaaagttgggagtgcgttcggggtggggggggggcgtgggggggggacgcacggggatcctccgggggaggggacggggaagaggggggccgccgcggctgccggagcagggggaggaggaggaggaggaagtgagcccgcaggagccgctgggagctgtttgtccagctgtttctattcgcaccccgagcgctccaaccagaagggggcccgagccgacccgcggcgggcacggctttttttttttctttttctttttttttttcttttcttttttcttttcttttttttttttttttaaggcgctaatttctccaactttgcccgcagcttgtttttccgggcaccctggagtcccaaaaggctagctccgcaggtgcgcacctgccggccgcccccgacctccctgagcaggccgccgccgccgctgcctccaagccggagaagatggcccagcccaagaccgagtgccgctcacctgttggcctcgactgctgcaactgctgcctcgacctggccaaccgctgcgagctccagaaggagaagagcggggagagcccgggcagccccttcgtgagcaactttcggcagctgcaggagaagctcgtcttcgagaacctcaacactgacaagctgaacaacataatgcgccaggattccatggagcccgtggtgcgcgacccctgctacctgatcaatgagggcatctgcaaccgcaacatagaccagaccatgctctccattctacttttcttccacaggtgggtggctggccagaaggacctcgaaagtggccctacgggatcttttcctctgacagggtgtggggtggggtgtgggggggagacacaccagcaaattcccaggggacatgggggtgggggggctcctaggctgtcatgaataggagacctcttagctagctagagcctaccagagctcacagcattctagcatctgtaagtgtgttttttgaatggagcctggaaaggcttgcaaaccccggggcccacaaaatgggatgactccatatgggttgaaagtaactgtacgtgcaccctacattttctgtagtccttcagacagttctgccatgggcttctcttggaatttgagttccacccaactcagtgggactgaaactagaaggactggaagtaacttcaagttactcagtggcactggcaattgactagtcagtcgttcacaaatcaggcttcagatgggggttgatcaggggagagggatggggaaaaaggtcagaagcctgtgagactcaaggtagggaggagcccatctactctagattatggccctccattctgatgcaaagcaaccccagaaaacttagtttaggattatcactttgagcacgtcaagacctcagaatggcaggagagtggatgaatccatttccatgtagcctctgtgttggagtgtgtttcagattttctggaaactgaaggtaagaatgggaaagggggagaaaataaacacagtggaaatgctcagggcaactgttacaacatccccaacaatgagatactctggtgttagtgacttagaactcagataatttaggggcaagaacttcaggaaaccctatgggttttatgttctttgagactgtgtgtgtgtgtgtgtgtgtgtgtgtgtgtgtgtgtgtgtgtatacacaagctcgaacatgtatatgcatgcatacgagcatgtgtctgcatgtgtgtgtgtgcatgttggggtggattttttttttcttgcttaatgacaccagttatgtaagagcgacatccctgctgtgggagacctgggtggtagtgcaagttatgcttctatctttttgtatgagcctgagcaagttacgggacctcagtgctccctgtacagtgcctgtacagtgcattctatctctcagattctaggtcttgggcaggtagtgtgcccaatgtgatgggaaatgctgagcactcattcattacgtgcatggcagtgaaactcaaataggacattgtaaaaggctatccagacatgcaggaggcactcttcataactatcaagagtgtctcccagacaaatctactttcctcactccagccccgttgatttcctggtggggacaagcaaggcttaatgttatatcgagatgtatctctgaggcatagtcaataccattgaagcatttttcacgtacctcatgatagacatcaaattatttcatggcctaaaataaagccaagctatagatagaacaggtttcaagagaattttcctttttggtaaaatattactacaagtgtattcagcccacagacactgaaatcgtgaaaagcacaatccttaatgggtgtggaatgatctgcttgctggcacagctcagttggaaagtggcaaaggtgggggagaggggagaaacctggagagaacctttgtatttgcttctaactgggaaagcagggactcctctcagacttttggtggagcgagaggatgatttcggtttctaggccttaggaggatctaacctaagtgagtgaagtgggaggctgagttttgcagaagagttcgcattgtgtcacacctctggagtatcctgattgtttggggttcttgaaagaccttttgtcatctacttcagttttggatacctggttcttgacaaagcctagaaacattacttaataggaatattaaaggcactgtataagggaagagaacaaactagggggtatgcacctcccaatgactcctgtgaccagaacaactcagtgtgctatgctactatctcagaacaagctagaaggctaccaggcttcactgacagaagggagtgacataataataattacagcaggacacaccactctttccttagttggtattggagatccaaaattcagtttaagctttgcacatgttctttgcaaactgcaaggctacaatgacatgttctttgcaaactagaagactgttattgctggctataggccttctccaatctctaggttgaacagcctgctatatgaacatttcctttgttgctttgtttgattccatgggtttctacctatgtaatccagccataatttttattcctattccaattcacaaaaagacattgcaggtctctgattgagtgtgtttcccattttaagttttcaaggccacatctattggagaagccaatcttccagcccttgtcttgtagcctgctttttcttctgctatttcaaggcctctagcattcttgggaagaagacatgtcctgttcttgatttatatttgttaatctgttttgatctgtccctatctcccagcttaggccttgattttcttggaagacagcatgtaagaaatctgagggtagacttgggtttaatttgcttgggttctttttggcctctacttatgcagccagtattcggcacaggtggttgttctggtgattacaaataaccacttcattgttggtatacgcggaggtaaagatgtcacaacttaacatttttttaaatgttttaaagtttttgttgaggggtgtgtgcacatgcacacattcacacaattgtgcagatactcatggaagccagaagagaatatcagaacccgttgagttacaggtggttgtgagcttcccgatgtgggtgctaggaaccaaaccctgatcctctgcaagagcaccaagaactcttaactactgaaccatctcttcaaccccacatctttaatcatagaaaatccttactagtgtttaaatgtggaattttctttttcagtttttttgggggggcgggggggagtttggagacagggtttctctgtatagccctggctgtcatggaactcacttttgtaggccaggctagcctcgaactcagaaatccacctgcctctgcctcctgagtgctgggattaaaggtatacgccaccaccgcccggctctttttcagttttaatcacatgtggtaactaatagtatggtagaagttcagatggagtgtttgtacatatagaaatcagcaagaatgaatatgcagacttttgctatatacctctagactattggggaaaaaatgtatttttcaacagcaaaccttcaaccttttgtaatataaccaataaccatagaggatttggctaacaattcttgttcatttatagtgtataccgagaatagcatctgtttagtctcatttggtatttatagcgacacaacaaaactggtgttacaccgatatttgtttttgtttgagacagggtttctctgtgtaacagctcccgctgttctggaactcacttcgtagaccaggctggcttcaaactaaaaatgttccacctgcctctgtcttttgggtgctgggattaaagccaccaggtcctgcttgcttttcatttttaaaagaagggagggctagagagatggttcagtggttaaaagaggtcttgagttcaattctcagcaaccacatggtggctcacaaccatctgtaatgaaatctgatgccctcttctggtgtgtctgaagacagtgacagtgtactcacatacataaaataatctttttttttttaaaaaggaaattattcttgggaattttaagtaacttgccctatgtctcgcaataaagagcaatatcaaaactccaactgagatcatacattctggagtctattggatgtctctgatgaaagaattatttcaaaaaactaaaaacaaacaaatatataaataaataaaaaacaaaactaacactaaagaggtgcttaatctttaatcccagcactcaggaggcagaggcaggtggatctcttgagttgcaggccagcctggtctagaatgagttccaggacagccacactgcacagaaaaaccctgtctggaaaaacaaacatacatacatacatacaaatgaagcaaataaaactgattccagaacctttgcaaatggtaaaaatgtccaattattccatgggacacaggactctgataatcaaactgggatagtttcagggaaactgggatggttggtcacactattagacttaaattcatttatttgactatgcttctgaatactagaaagtttaggaggaaagtagagtacgctgggaaattagctgaattttttcattttaatgcagtgttttaaaaaatgaacttcttaaaataaaagtttgtgtgagcttaattacctgaattttaaggtctagaaaactaacatggtaactggcaatattctgtttttatgattgctgtttttatgattgctgtttttataacctcagttttacttctaagattttttttcctttgagataaagtttcatactacagaccaagatggcttggacctcagactaatcttggctgtcctggaactcagtatagcccaagtttgtctttaactcaaggtaatccttccaactctgcccttcaagtgctgggataacagttatgagccaccacacctgactaaatcaacctttgggcccagagcatatcttctcagtgtcatctcaaatactctgagtcttaattctcttaagttccaaaatttttttctaggattctacctgtaagctgacttgcctccaaaaggttctcacacaaaatttcagaaaataatatgaaatatttctatagcttgataagctgttatacactagcatgaaggaggagttagatttagagatcaggctgggttttttttttaaagaaaattttcataatatttaaaattcaactctgtccttgtactgtctgaaactcccctcttaaaacatcactggcatctagactgcactgtgagaaaccctgaaccctgtgattgcaaccctttgtcaattaatttaccatttgatttcaaggacagaattctttgtcatagagaggttttgagtttctatgtggttaagcctgtcattctttgcctttgtgatttttgtttttggtatcatgcttcgaaagttcttccttagcccaaagtaaattaactatttcccaagtgtctagtagtctgacaaagaataggcactcttggattaagtgacaacctccattaaaaaatacaaatgcatttgaaaacttaacattcagggtttggatacctcatgagaaccctactataccaaaaaaaaaaaatccttgtcattttgccaaggaacagatgtgaattgcatgtgctggcaggctagtatattgaggccagtccatatgctgatgagtaagcttagtgccctgctaaccccaaccattacctgagtaggtctgtgatatatatatatggtatgggtgtgcatacacatgtattttatgtgtatagtggttcaatatttgttaaattttaccatttttagccattgttctcactaagtggttacatcccattctcttgaatctccagcttttgataacctggtactttctttctctatagatttgcctattcttgctatttcatataagtggaattgtgcaatatatgatcctttgcgttcatcttctttcactcacgttttcaagatttatctatgttgtaacgtgttgtaacagtacttcacttctttttatgactgaaaaatattccattttattgctgtagcgcattttgtttatgcattcatctatcaagagacatggattgcttctactttgtgtggccattgtgaggaatgctgctgtgagtactatacaagcttgtgctccagtaactgtctgcaattatttgggggtatatacctgggaatggcattcttcacctatttttcatcaaaaaatttgaccatttagagccattatttgtcatttatttccttgtgtggaattgtttctcatctctggtgacacagtaatatagttcatagaaagtagaattcaataagaatgtaacacagaaaagccaagtttacagaatcaaagtggagaaacagtgctggattcacgaaagaccaggttaggtgaggtgctgcaatgtggggcactaagcaacaagagagcacaagcagtgtacgtggaaggtttagctcttaaagaggttcagaatggggcattgattttattttcttgtcagtttagtctggagaggacccatgtgagcccataccttagaagataactctttccagggtgaccttattttccctccctgtctgaagaggtagttaacacccttgcttatatttttacttccagataaactggcaagctctcaattccaggtagtgttggcttctttccagactcactcctgaaggccaagacgtctaaataaatggagatggatatgtctggccaaggtttccagggtctctgggccacctaaatgatggagcacagcaaaatactagcccccgactgtgaattgcttcagagggatgaggtcgtctatgtttgtatgtggtggtagccattggactgtgtttgctcattgtgaatctgttcctacctgaactttctcctcttatgtaaggcatccctcaagataactgcaaagctgtaatctgccatggctggctgagtttacataacaaattggttggtgtcatgcaatagtcttttgagcccttgagaaaccagtgtgctgaaagaggccaaagcttgggctcatttggaggggcacgttgtgtgctcagtgtactcaagggagagcattccatgaccacaagggtcagaaagatactctcccatcccaatgcctgcaataatggggcaagggttagggcttcgttttctgccagagctttggaatttctccatggaatcacataggttagtgggagccccacaaagaactgaaggctagaacccaactttaccagcttccttccagtgagggctcagactgcaaaaatggcttctggaagttactgctatccatgctgaattaaggagttggaatagggataaactagaagaagaaagaaagcttttgcaaatgttatgctagaaaagggatgattttatcagcaggcaaggtaagttcacttgtaccttctggctagaaatcatccccaaagtagctattgaacttttagaaatgccgtaagaggtgtaaagttccaaccaacacaaaagacgaaatgagaagtttcccagcgtgcaaacactagtccaagagaaaacaaggtaatgttcagtaatgaccaaagcatgttaattgcctccctttcttgggaataacattttttagatagatcaagcctgaaatcggtcgcctgcctttaacaaagtattgtagtgaccttcctaaaaggaagaacttgctcataaaaatagctgtgagtattcaatatactttttttgtcttcacttcagaaaggatgacgagcagctgcttgcaatgtaggagtctggtggagattccacttttctaagctgtataggcccgaaattggctctaactatccttgaggaaaagggactgagaagtgagagggaatgtggatccagtggctgcattgtagcttagccccttagcacctctcctacattgctgtttaacctcactttccaaactgggctgagcctatgccagcctcagggccctgactcatatctcatgcagtgacttatgtaacagtgccaggttactgaggcatcaagcttctgcttgctcagtggtgggcttcccccagggccaggcattcagaagccgttttcaggtttaaatggagctcatactttccaaggaaaagcttgctattccctatgtgaggcaaacatttggctcagagttatgtgcagacttcaaggtgtgagtcgagttagtcccacacttagaagcaaatgtaaacagacaggcaagctggagtggatttggtttgactgaagtcattttggaggggtactgctactttttctgaatagtgcagtactaacagaatgctgtgaaggggcttcagaacaggtctcagaaaagcctttttccatcttattgacaggccaggaactttcctggataccctagtctgatagaaggtgtaccccaagctagaggaaccatttaaagaaaagccctcgcgtgccagtttcccgtccattcctcacaaagtctcaaagtccccaggtttccctgatcgcacagtgggtttcaggtttgttggtttgtttgtgttttgttttgtttggaagttttctttttgcctatttagaaattcacattaccagcttggcatctctgccttagtaaagttaggtttgctagattctgacattcttcttttaaaaataagtctatatacaacacatatatccccaccaatgtgatattccattggctcaaagtgtgtgactaagtcagtaactcctcctcttttcctcccttgtgtttgccccaccctgttccactgtgttgccaccaagtaagtggctcacagtctcaggttagctaaggagactgctctatagtccaagtaaaagcgagggaagcagggaaacgagttttcttttttttttttttctttttttttttttttttagtggcttggaaatcagtagcagctgtgtccagagatagtactcatgagtacttggacaagcccaaaaccattatctcaggactcaagagagctaggcactccaagttctgaagacacatcacagccaaaatctaggaaaattataaacccttaccacgattttaaactcgtccctcttccctcagcctttttggctcttagctggaaggggaaagcataagaactgctgagttttaagaccacgtaatctccctgctctcgtgcacagagaaatgaataatggtagtatctcatttagccatgtatggagtgaccaaacacttatattaatcagtccatcatttattgaccaatgtcctgctataactgtgctctgagtatggatttattgaattcctaatttctctgcaaggcaccataaaggacacagggagatcagaagctaaggccagggtctgaggaggaattgaagctgtggccatggggagtaaagaagctgccaccaaggacttgaggcaaggaagtattgcaggctttgagcctctaaaagctgagtggtggctatgttccttgagagaaaggtcttaagcttagtagagcgtgggttgtgccaaagcaaactaggaagggagagtctcttcatggcggcagcttccagcagagccttaacgaacgggttggctttggcaggtgtttcgtggctggctggctggatgtaagactctctggttgggagaagagagaagaaacttgccagccccacagggatcctggtaggaaggggctggcctgggtgggaaaacttttgtcttcctgggctgaaacccagagttagcaagcttgaggaacaagagagaaaggcttgctttggcattctccctcactgttcctttttgcctcaaaacaagcttaaccccgataaccctctcctcgggagcttgaattatccttatgtagatgaaggcatctagagaatgggagtaggatgatacttctgtcttatggtcactggaaccaagacggttgacttaaatcatccagtacagggtaagtcccagaaagagaacctggggtgcagcttcatatctggatctcagcttccatttctacaaggaccctttagaagcagggtgctattgtgagtgtgtgcgtgtgtgtaaaatttgcctacgtctttctgggcaaaagaggctggcggcccagtacagtgtcattttaggcttgtttacatctcagcaaactcttttacagatgctttctaaatcaagaccgttgaacgggttaagaaaagtgggaaacttcaagttggcaggaagggggagggaactaaagtagccaaaggaccgaccagcttcaggtcagctgagaaagtaagctgttgctcaaggtcagcatttcacctttcttttctagtgttctctatctaccccagtagagtcttggacatctgtgtccatcatcctttcttacaagtgctctgaagaagtcacacttaagttcatgagatgattcagtcaacaagaaatgctcattgcatatctttcatactctaggctcactgagctagacactgaggatacaatgggaaatacataaaagccatccatgatcttatctgagagagttaggcagaaacaagatggtgtgatggtaatgaatatataaatttcaaactaccaagagggaagagtataacaaagacttcgaagaaagtggtaactgtgttaaagaaatgaatctctagtattgaaatactcattaccagacacaggccaaaggaagacgtgcagacaaaagactttctgggaacccttcaagtcatgccatgcaaatagttttcacacccctagaaatatatctaggccatgagtgaccagcaggtccaaagcagtaggaataacaatattctgacaaggataatagataagtttgaagcctatgaggtaactaccttttaatgtcatcctttgctaaaaatagtccatgacagtatggaaatgtgtaaaggctagccctggggaccaggaataaagtgggtatagcctgcggggaggaaactggcttttgtaaattatttactaaacagaacaacggcaaaaaaaaaaatccacaccaaaaaaaaaaaacaaaacaaaatcaaaataaacgaacgaacaactgaggagaggtctttttttctccctcttttgagagaagagccttcttatgaactatgaatgattcttactgttcaggtttcactcctttctagagcccaaggtaatgtcagatatttgtctaggctgaaagaaataataacctggatgtagaagagaagcagggactacagtactgaagagagcacagaaattcatcagagggtcacaagtagttttcctttgagagaagtgatctcatcacagtgaaaaggcagatgacagctaaaaggtcagtgggattcaagggaaatctgattgtgaagagtcgggattgagatatagtacttgcagagccaacaagaggtaaacctggcttggaggcacctgttggcaaagctaaggaactaagatcattgatacatggatttaagggcaggatagtggaggataatcaagagatggaagtttgttttcaaatacaagaaaagtcacaactcagatatgttggctagctgtttcccagccagactagggacagaataagaggaaagaggcctatactatagcatgaacaactgagattcgatagaaaagagaacttcctgactatatgcatctaaagaagttagacaaaatgaccaaaaggtattatttataaagtatgggacagatggagtgctatcagtggatagggtgggtttaataaaggccatggcagaaggggacagacaggggaagcaaagaagttagaaacaagaacttatatagaaaaggaaagcacatgatacagaatgccaatgtggcagtttcataattaaaaggataatgtttggctgaagtgatagtttggccattaaaagcttgtactgcttttgcagagagaatcggattaagttctcagcacccatgttgggcagcttgcaatggcctgtatcttcagtttcaggataatctgacaactatggggtccataggccccttgattctcacacaaatctgtaattaaaaatagtaaaactaaatctttgtaaaaacaattatatttccactagaggcaagtcattacagctagtatatgttcctgtgtgactgagtggtatatgggaatgaactaaggaaccattaggaccccttccagcatcttccaaccttgtctcctagctaaaataataacaatggatcactcctattctctaaacttaatgatttgggagctcattatattctgaagacagtagaataagattgcctatacccaggtgcttgtggaaagaaggagacagaataagccatgcgagattacctgccacaggaaacttaaaacttattagtacagatagtatcaaataataactacacctatgaatatattgttgtgcttgatcacaaaaaaaggcaggaagctggagaacacagcctaagaagtcttcactgggactagagaaatctcccttcttaagacctacgtagtaattgccagtgacccactgtgaatgtgtcttggccaaattcggtagcaagaagattaaaaagaaaatctagtcaccattaatgtcctcaaaggtggattttgaatcttctacagctcactgaagccttgtaaaatagcagcaaccctctccatggaactggtctcgctgccgagatcacatagtcttgatttagcagatcaagagtcttgatttgtcacaatggccttgaaattctgtgttttgaagagttcattgcctatcagatgagcaatatgaaggtcaattaagtgattaaaatactaacatgttgaaaaggctagtcatgatggcacatgcctacaatcccagcccttgggaggtagaggcctgaagatcaggcgttcaaggtcatgctcatttatttatgtaatatatctgggaccagcttggattacatgagacactggaagctggcaccccttccaaatagccttgtctctaaaattgctatgtcctcaaagcttttttaagattaccttgttttggctgcatggtgggtccagtgctaaagggcaggtagcttagtcctagaaatctaaggtcttagagagattgggccacattttgctgttcttttatctctttcttgaaaaactaattggttctggaccttctgaaaaactaatggactactacttgttcaaaagtaaactactaagtgctatgtcttcaggcattgtgtgttcatgagacataagggcttcccatacaatggaaagtcatctaacatactgtgagctttacagttcttctagaagaccttagtgccattgtttagaaattggtggctgtatgactaggaaatttaagggagaagacagtcccagtattccttcattatcattaggcacatcatatggtaatagaacatccttgcctccctttctccctaaatccttctctccctagctccttccatctgctgtcagtcacaatccctctcctgcccagaactacaactgaaatccaatctgtcaagctttctctatccctcccttttgcctctatgagggtgctcacccacccacccaccctttcccaccccactcctccagcatccccctatgctggggtatcaaacctccacaggaccaatgacctcccctcccagtttttatcagaaatcaaagcatacataagcacaggggtgccttcctgacattactgccaatttaggaaggtgttcatagcactatgaggctcctggggatagataatgtctttgagacctgaactttccaagattggctgatattatcttctgtaccttagacagaatatagaggcttagaactgcagagactttctcaatcatctagtatgacccctcctactataaaggagaaatgtgaagtctcaagtagggtgggtacccacctcaaactgaatagccaattagtgagcagcaggataaagaaattatgtctcctgattctctgatccaatgatcttccaacttttcatctctagatggctgtgcacagaccatcccagtaggtacacaacatctccatgccaggagaccagtttaaggtccaccaaatgccaaaaacgtgtttttaaaatttgattttatttaatggaattgaccagtggtttgggtattagggagccccagccctagaatcctacttctattcaggctgaggctgcctgccacagccacagtcgtgcaaaggggacagaaaagcttgctgttcaggttggaaaagaaatcagttgctgaaacattggtctttttgaaagttccaaccacaggagctggctggcagagcctctgtctgggttccccaggaggatctggccctcctctttagtctgggagttagtttaggaaactggcccaacttccacagaagatcctgagggcagcacttgccttaggagctccagtcttccctcagagctcaagagcccccaaagccactcaggactcagggcagggaacatctcgctgcttccacagcagagccagcttaggctgaccctaaggctccttgaacactttttgtttggagtctattaaagtgtttctagttgccctcaccctattcaggaagctacggggagagagtaagaggagatagaacaagagacaggaggaaaaaaactctagccaggcaaccaaatctttgctgtgcaactgggaaatgaaggaggaaatgctggaagaacaccagctcatggaggagccccagctcagggaggacccagagcccggggaggcacaatttctggaagagttacagctcgaggtagtagagagtgggtcagagttggatccagaagatctggtttccagtccagactttgccaccaatctgatgcttgagcttgagtaagtaactcctgccattctatggactgctttccctcattgtacagttggggagggagagagaagatagtctgtatgctctcttccaattcagatgtttgggaagaataaactttctttgtgtagggttgggttgtagaaaaagttgaatcagttcctatacactctgatgccagaaagataagtttaaggagcacaagggattcacatcggtaagagagagaaaacaggtaatgaatgtgggagttatgacccccaaaatacaggcttaacagaatattagctttgatatttttaactcaaagaattagccttgaagaaagcttataagtagagggaaatagggtgtttgaggtctccttgatgtatagttgctagtaaatccctcaataaaatgtctcccagtggcaccattcatcctaaaatgcatatactgaacccggattgtgtttcttgtgctttttttcctatgtagctttgaaggaatcctcagttgaacaggagggaagtaatattggatatttgttcacatccagaactggcaaaccacaactgtcactagactcatatcatgtctctagactatatatctaaaagatatatagatgatagagagacagacaaagagacagtaatagatagatagagatacccctctccacaatgtgtggctgagcttgggctgccaaaaccttatctgctttatgtgtggtaggtagtgtttgggatatggcactgtgttcagattccttcaatactggtcatcctggcctgggttttaaggtaagtgtctatagggcataaaagtagacatgtcactatgatgaactcctcatcatgacaggcatgatattttgaagtttctagtatatcaagttatttacactttcttctactgtccttatacccaccaacatctccactgctggggaaattgtaatgaaggcagtgagtagaacgggagcctccctcaacttgcccagctacctaaccacatccctagaaccattaatcacgtattctttgagccctgactttcacctttacacttgcctataattttgcctcgccttggctgaactatttcttcaataatttcttgattgatatctggccactagattaatcttaatagatttctaagattagaaaggatattatttccacaaaacaatgttttttaaataactgcaaaataaaaaaaatcctttctggcaacttggggactgtaggaaaaagaaaaagaatgggaggagaaatttactaaggggaagagaaattaatttgagtgagagaaagggggaaggaaattgggaacaaataaaaagaagagaggtagattatgctaccactttccctaagaggagattatacttctaagtcaagtcacaaataagagtctacatgtgtctttaatgcttatagggctctggtcctcacttgaactggttttcattgccaaaggagttgcatgctctctacatgatggaggtactacatgagtgttacgtttagggagctcggaaaggctgaggaaccaggtggccagagctcccagcctcccatagagcagatcttctcctctaaagaccttgaaagtttttaagttagattagggagggggtagaaaaggcttggttattgtttaacagccacaaagaggcatgtaaactactaaaggaccttaactctccaatcaaacaagaatcttacaaataaatcatctttaagaggtgaagacactgcctggacttgggcaactggcactagcacagcacaagccaattctcttgttgatcagacttgcttggttggtatacagcctatctgttcaaatcaaatcagaatccgtccttcttgcatgcagaacagtttggccttgcagtactgttcctactgtaggccctctttgtttctttaccaccctggtagcaggctaggggccagaggtgtttctggcctcagtattcccaactaggggcatcttgtgcttcatggggcctctatatgtaccacatatggcacatgggtgggcagattagccactgatgtgggcttgaggcactccagcctatatagcccctgggaccaaggtggaggaaatccactccacagaatgtattggttaagtgacatctagtgtggcattctggacaggggaaatagctcgagggaaggaacacttgaccaggaataagggccctgtgttctgttgcaaactccagctttggctggggctgtcacctgaaaggagaaaaataataactggctctgagaggaaagggggagggagccaggcttaggatggtatcctgtccatttgaggcagtctaaaaccccgccggctttatacttggagaaagaaataaagcagggcttgttggctatgggaaccatctgtgtgtacgatacagaaagcactgtttctccaagtgtggtaaacacacactggtagtgtgcaagatgactttaggtggtgtaaagacttttctatttttatagctgtttattgatttaacatctattgcaggtaaatggctggtacatacactctgattttacaaatagtacttctatttttttaaaaggttaatgtgcttaaagttagttttgagaaaatgtattggcagtaaacaagtcaagaatattgtactactacacactgtgtctttaacagaagtgtggcaagaaaccccggggcaaaacaggagccatacagtaaggcctgaggtcttctttttcataagcacctggctcaaaatcaccctgacaaccttattccaagcataagatcaacctgctatttttatatctttggtgtcctgctctgccccatgacactcagcactccagattagcagtgggcctttcactcatggtgagcactgtctcgaccacacttcagtaaacattggctaacaagtattggagagctggtgggactgtccccactcgcctctgttgatttcctctcagcattacccattggcttatagataggtatcttcaggaaacaagacaaaagattagtatttctttgaatgtgcaaaactgcagaaaggcaggaactgtcactgagcaaatttgcatggatttgcactgatgtttggattctgtccaatgtgtgtaaaatcaaattgaatgggagacttctcacttctgctgggattctgcaatgggctctgtatacataagtttagtttatttcctcctttcaatcacctgagacagaaaatatgatgcttacagaacctgatgcttaatcctagtttctcccagggccctgcctggcagattataagggttagcagaagcaatgaagattgtgggcttggtatatatttccttacgtgagtaggttatattcaggagaattgtgtgtctcttctgtgtatctggtctcctgaactagctcaagtagagttgagtaatcttcagatacatccaagcaaggaaatactacattctagtggttaactaccccttctctgagaattttatcattagttctagaacttttcagttctcttatataccactttttgcttaagtcatacttatattctttgttagcttttttcataaatttgtgaaatacattttctatattttttaattaaatcttggataatttcatataatatattttgatcatattcatcccaactcttcccagatctaccctaccttctcacccttttccatatttgtgtcctttagaaaaaaaaagacaaaaataacctgtccactcctaatttgtgctgacacccatatattcctgggatggggccatctaatggagtgtaatcaacctactaggagccacaaatttaaagaagactatcctaatcctagaagacatcaatggttgctagctactcaattagaggtaaaaaagtcagaacctcctcccactctatgctagaattttgagtgacttcatcttgtactagtcttgtacaggtaagcacagctgctatgacttcaggaacgcagtggtcctgtcatgttcagatgacactgtttaagtctagtcatccctgacatctggctctttcagtctttctgcacccatcttccacaacatgaaagataaatttagatggcagtttgatatgtccacttcaacaaatagtagtaatgggttcacccctggagcctacaaaccctgggttcttggccagatttatagtattgaaatctattttttaataaaacctttgaaccagcttatatttctccaccctttatatagtttccaacttttccaatagagattttattctattttttaaaaaggcttgaaattattgcatgaacacctttgcttttagatagtcaacccaatcccacttttgatcaatgagttacacttaaaggatgccagatttggaaacgaccaaaagtaactggcctgtggaaggcccagtcacctgccccaagcccttcagctagctgttcttctagaaactggagctatgtaggattttattatttaacataattactatggaatatagaaggaaagcaacctcaaagattctacttatcttcatattcatatcacctaggatcatgttctttcctttaaaattactagattatatagtagcaatttattgtagcctctgcctttagctatccattcatatccaattttgtatatggttagcaacacatctatactatccctgcttttattcattttgtgatttatccgtagtaatcccaaaatctcaggctgtctactcccatattctgtagctcgtttctgagaacctaggagtgctttgacgccaatccaaacagagtataaattaagaatgatcttataaaaggtaaattacgtactcacacttaaattccattgaattccccatggcaggatcactaaggcaggatatgtgacaaaggattaatagggaagaaaaaagttgcactatgggttccatacattttagtagctgtgcctttctacttatttgagctgatatgaaaatgagttcgcatccttgaagtgtataaaactagaagaaactggatatagagagaaactaagctaagaccaagtatttgccacaaagtagagagtccaccaagaaacacttgaaagttgattttctagcacacagaaataatttgtctttggaatgtgttatgtggctgtttacccccatggctttgtctagaaagatctaaggaacctacctactgggacttagtttgctttggggagataaggccaagcagttctcaggaaattaatagcccccttcaccatcctcatcatagcctatttgctgtatccctatgcctggcctgatcatttgacctgcatgagtctgcagaaggtggtgtaatccatctgaggaaaatcacgtcagagacaggaaggggcacagcagcctctttggccaaggatttatgtatctgtcatgggagggaagtgtgaactgagaaatgactcccagaagtgcaagagttggctgggacagtattgctacctttagcagtcagtggtacattcattgggaatcagtggtatttcagaaggccagcatattgactctttctcccttccttccttgagtccattctccctgttccctgttcttttccctctggctcagcacatactgaagaaagcaactgaagtggtttagtgtaccctgccactggccaagcagtgagtgaagaaaggataacaaggccttggactgcttttttgtgtggcaattagaggccatggggactgacacaagatgtttgggtcaaccacagcaggcttgcagctggtgccatgtcaccatggctggcactaatggcaactaatggggtcctgacagtcctcacaacctacagaaaccagccagtcgctcagtttgactctatatagtcttaattcttgctgtctttgtgaattgctttctgcattttcgttagccatgcatatcattgctttgggctctctgctgagcctgggactaagtctttgctttacatagtttcccctgctgtgagtctgccagactggctcccttggcaacctcattaggcattagtggtgtccatgggaatctaagctgggcagcaggactcatctttagggctcttatctccctgatggcttgtaacatctccaacgcaaaggggtcccttcggaagtgtatccagctgtcttgggaaaggtctactctgctcacaattcagcccagcacttactaagacagactagagaaattccaggcctctagaagcagctatttgtttaacttatccttatttttctttcctaatggctgttgtcatctcctcctctcaagaagcttgaggtaagtcttgacaagcctcgaatctcagtaaagaaagtaggtgccacttagactctagacttattttcctttctctccagcatgtttcctatactgcatgggaaaaataaaggaatacagtttgagggcaaattctttggtgtgaaaggagattttacctctttgattgttgttaaatagaaaccattttcacctgggatggaagaagcaggcccatctctcaaaaaggagcaaatggtgtaggatttggttttagtaccatcctttctccccatttttaacaaatgatccctcaaacaatcaccagctgcttggtgttctcaataatagggttataacttatgttatagaacttttctgatctcctggctacttaaccacccatggatttctacatcttgctatctgccaatgttcatgtgatatactgatgcccggtaagttgtaagcagcaagcatgctctcctactcaggtcacagttccgttaaacctggcctttcaaagggagtaagccaagtaagagatgcaggcttagcagggggcaagtaaacagcttggggcggggggggggggggtcattgtccaacctatatcctttcaaatggcattgtacaggcagctaccctttttccatttgtatgtaaggccattccatggtcttacatagctatagtggttggcagaaggaactaggaacatcttgagctaagtaaagtccccgtttaagcctgcaaaattctgccgaggcttccaggaggagtcacccttcccacaagccacccaggcacttataaagagatgcagacaagaaattgcaactcttccttccagggtacctgctttacttgactttttaaatatctgagaatgcaataggcagttcttgctgtagcaaacccacctttacttgagggaggagcactgaccacttacagaggaagggttatatcctcagaaggatctggtacaaaatgatttttggctcagttgctcttctttcctttttgagttctgtttccttttagtcccctcaggagagcctctctccacctccttctcgatgtctgtgctcacacagcttacacaggggaagtaacccctagccaaataattctctcatccaacacattttccaagatgatcccagtggtccttctagaagatcagagacaaagactgtctgggtcaacctcttcccctccgcccaagcacaccggaattccaaatgttctcgtttccttcaagctcaaatggtttttgctgctgatcctttgctctgggttacccatttcctgctcaaccctggcacagcaaatgtgtctctgtagcagctacctcagggtaatttgagaagcagctttaggccaccacatgtggaaaaagaatcagaggaagacacatgtggaataagaatctcctagagaaagatgttgggcctttgcaaacaactttaataatgtagaaatgccagcatcagatgtttctagaatgccagcataatttaaggtgattttaaacacttattatatacttccctaagtctagtgtctttactaaaatctttgacactctttcatctgccttggataatcagctactgcccattttctggctgtgtgaacatcttgggcacacatacccctatccttttgggagcctctaacttgttcctgcaatatctgatcagtttctgccgagtcagtcagatatgccctgttgctgagcctgtttgggtggggaggatgggaaaatagaacaagcactctaggaggaaagttctcagtttctactctccagctctttaatgtgttctatctcctgtttctgggcctctatcctgatcaggccaattcccttgcctataacactaggtttgcattgttaatcactatactcactttaccattttggtgcttccaccactactctttggctcagcccctagggatagtcgtaaacatctgcctgcctggcaactgagcccacctaaagatgtcctcttggtcttgtccttctcactatggcagtgttgctcatttgtggtagggccaaaaattggaagctgcttcttcaacagacttatcctagaggggcaactggtttctcttcaaagctaaacaagaaagcagatgtgtaacttactcacctaggccatggctttttaaaaaatacattttgggctctatattgtaaatagcttttttgcatggatttccaaagctgtaatttcattctagaatgattgaaaaattatgattgaagtttagaaaaagctgccaactaaagaaaagatgttgcactcagctttgcctttctctagcattcttttgcccatctttcccttgacccatcctccaatttctccagtactcagcctatatccctggatgcctggaagaaccctgtgttaatcagtggttccatttctacagtgtcagttggcaagagtattccctttggagcctgaggcatagaaatccactggaagggatctcaaggacaagttggtctagccagtgaggccacatacccctgctcctaactccaacccaagtaatcatgctttttgtctattttataaatagggttttacatatgaggctgcatttgaaagaagaggttcactgggtttttaatcaccactctagaccagacttcatgtcaaagttaacctatgccttggcttccctctggttctgaactctgctagcagacaatgaaaaggatgtagtactaatcaaataatgaaccctaagatgctgttagtggctcaggcttgctagaaatgccagttccttcactcagttaaagtggtgaggacaagttgacactctgcttctcatctcatataactaactgcctccccacccatcattaataataatctctcacatttgcatagtacttgacaatttccaaagcactttcacagactatcttatttgatcctctgaaaggcctatgagtgctgccagggtaggggctattatttatattttgtagactagaagacttgagaccatttaatcattggcctcactgaagagctatagggaactagtcaaggtgagatgaaggcttagataaagggaacaaaattgggaacaagagttaagaaaagaatggcaaagaagggtgataagcaggcagaacatatgaaaactctacagtatcccagatctaccaacccagtttaggaattttcaaacaatatagagctttgaatgcccacctaatgaggcagaggtatcctcttcttcatggtgatggttcctggggctagtgaactcaccttgtcttaattctgttccaaaaagcctgatcttgtcacatgattttcctaaaactccagaagcagtagtcaagtcctagaactggaagggcctctcatttttccaggagaggaaacagaatcccagagacagaaaaaaggtttcccaaagtcacaataaagtgaaatggatctagtgaaacatgggggaggggtgtgtgtgtgtgtgagagagagagagagagagggagagagagagagagagagagagagagagagagagagagagagagagagcgcacgtgcatgtgtgtgggtgggtggggtatttttgtgtgtgtaggaatctgaaggactgtggacagtgttgggaatatttgaggcctggaccttgtacacatatgcattaactggggttaaagccatttatagggactggggtaggacagggtgtgagaaagaaagggttcagggtttctctaccaaggggattcacccatataaactgctccaggtaattaagatcccagaagaattggcagctgcttgctgaacaaattaggctctgcctttatgggcatgttctgtgctggagatcagagggccctccctgatgtttggttcattagtcattgttccctgtcagagcaagcactcagaaaattggatgtctggcaacagtctgtattcagaaattcaatagcaggagcagcaacagcaacagccgagtgtctgggacagtgctccatgcacagtaggtgcttgaaaaatgcttgttagctaactaatgaactgagtaaagaaagtctttagttttctgtgctattcagagggaaacagtgtcaataacagatctgattgcctttcagctaaggcacagttgaactttttaatagacaggctggtggaacttggggtgggggcacttgctaaaggcttgattgcctatgctgacaacataccacggatcacagtgcccaccacttagatgttgcactacattgtttgggttgcataaactcactgatccctaaactagcttatgatttccttctatttgaacccaaatttttttcctagttctaggcttctttggccagaacatactatgtttggcaaggaacaaaataaagcctgagtgcatgtatgcagagagagaagtgagcaatattcaagtgacatacagggccattgagattgaaaatcagttcttcatcactgactcgccataggccaggcctgccaggttagtttagtcaggcagtttaatactgttcttaaatgtcagggaaagatttttggttttgtttagtttagttttgttttatactaaatattcctagttcaaaatacccaggattccttgcaaaggtcagctagcatagcaggaccaagagaattttagaagcttttggcagtcactaaaggtcaccactggtgtcttgtctataggccaagggagtgaactgtgagggatttcaaatgtcctgatggacttttccaccatgctaataaactatcaggaaaatacttcaattcatctagctatctagtcactgttttatatcttattcattaaagaaaaacactaagaatttaattaacacagactcttttaagacttagttgggaaggagggtgtgggggtgtgcacatgcatgcctgtgtttgtaactgtgtgtgtgtcaggactgtgggagtaacttttggtagtaatatagatgtatataaagaatctataccgtatggataaaaggtatagaaaaatagatagtgggtatatttgtataggagaatacatttgatagctagaaggtagggctgacgtttccatgtacatgacttttgtagctctacctgagcttcttgaatatgggactcagagttagggtgacaataatatatatgaagaagatatgtgtgtcttcttatgttggtgtatgcataagcactcacacacatgtgtgcacacttatgcatgtgtgtttatctggtatagctatgtatgtctaaattctcaagtcttcggcttcgagaactgtcttctgttacacacacccaggcctccttaagttccctgtctcttcttcttccttcttagggagatatttactatcatgaagtctttccctcccacatttctgtttttagcctctcccaggctactctgcagtcttctaatgaagtaggggtgagtctactagtgagaaagacagcattcaatgattgagaaacaacttccaagccaatgaaatgtctgcctaaagattgttcttggatcaatggaaatcctgtgggtcacccttggatcaactaacattgtcaagaaatgtaatatagatattcaatactttagttttagtgaattaattaaaacattgtttttagttctgttgagaaggaaaatcatttattatctttggtctggccctatgccttcaagagaattctcattccatgaaaataaaagctgaagtaggcaattcacacatacttgtgaaatctaagcacattatctcaccagtggctataactgtaataaactagagtgacctgggtttaaataaacaaatatttggagctggcaattgaagtacaaacataaccctaattactggtttggttaatagagagtaattcagtctttagagatcatttttaaaaatctgtctttggttataacatgggtctttagactacttttagagtcttcctgttagaaactaaaaatgtctatccatttaatctattttgctctcctgtttatgaaacaggggaaaagcaaaacagttctcctttgtagagtgttttcccaaaggtattcctaaatactcacctttcatatctataagtatggccatcagaaccagtttcatacataaagtcaaaaaaggagtatatcttattaagcattgttatagcaaattcctaatggtttcctatctgtaactcactatgcagccaatgtagtcacatggttagatcagattcaaagtaactacaatttctagaaagcaacctaaaatgttgctgtccaagagatagatgcaacagagtagagaatgctaggaagtagaatgtccaccagttcctgggctaaatggatgcttggtatgaggtactccatccttgttccaattgtttatttgttatttcatgaagatgagatggggaggggctagttaagtcaactgaaatgctggattggggtgtcaagaatagctctttctttgctgcaagggatacatccagctgcagatttctgtcatcattgggcacacttgcagatgaattcagaaattatactggcctctccagttgtggctgagttgaacaattaccattgagaccatcctctaacccacaccactgttctgggagccacaagaatagggggaggggagaaaactacagaaggcttgctccccacccttcacaagctttagattagcctagttagatgaaatacgcagacatcaatctctcaggaacaataacaaggatatattgtccatagatacaaaatagtgcaaaccaacacttctgtaacaggttaaattaagtaacagttactactatctacagtcttgatgggattattatgtatgtaagaacaaagaggactttgttctgttgcatgtgtaccactgaacctacttactatagggtatgttccacagtatgtgtttaagtgttcagaatagtaggcatggtgctttccatgctgagttctttattttaatggcacttatagcagatatccagatgctcttacctcagaacatgatatgtactatttttccactctcaaagttaagggatggcagcttacaagagtggaaagttggtcataccacagaggacaggtcagggagtgacctctgcttcagcccctgctcaaagcttgagcacagacttgtttcattatcatgttggcctaggcacactgaagttagcattgtggacctttatatctgcctgtaatctgaccctagaacttgctcaaagcttagaaaattctccacagctcatcttcccaaagctaggaggtactcccacctatctacttcctcttctgtggtctattgcaggctgcacagaggcttcaactagagtatatgtacggtaagaatgcacaaattgggatctgatttccccctcctctcaaatgatcagaaaacacacctgggtttgctccacattgtacctacccaaccagtggaaaaaaattaggtctggccttctacctctttccagagcttgagccatccatagaaaaaatagtccagaaaggatgaaagaacaaagtccctaatcccattccggtttgatttttgagtccagatacactgtttatctggcaagcatgccaattgacaaaaagataacgcttaaaatattctagccccacaataccattctagccagccttagttcacattaagttgcactatctacttaatctctatacatggatctaatgcttctgggtcctgatatccctacttgttctttatatctttttccagcttttctgataaataaaaatctcatttctacgtgagactcagtctccccatatggaagatgcaaacattggactccaatatgcttatggtggccttctaactctgtcctgtttgtttaaatgccttctttcttttaattaggtaaacatttcatggggaggtgtttgagaacttctagtttggaagctggaacaaagttcccaggctaggtttgttttgtgtcatgtttgcttcttcctaactgttttttcccactgctaagtttgaaggatcactctggcttgggctgcaggtaggcgaggtatggcagcaggtccaccaggtcagtgattccgggccactccgggagcatggactggcagaaaaatagtatcacctctattgagatcaggtgcccagagccccttatctcagaagcattaccactgacctgtgaggtgacctgagatctctgacagtcaggctgatggcattgtggggtcagctgcctgtggaaccaggagctgttttcagagttcctgagaatcgaagatttctgtagaagatatgaagatcccatgttgatcccaggctaggatcagattcatatcaaaaatctggaaaatttgcatggaagccctgaggaagccagactgtggacctggggataagtgctgccagtagactatgagtgggagtgagcaggggccaggcagcagtatatactctgtttctctgacggacctcgaagccagcccttgcaggctgccttttcatatttgggaactgtggagaggaaggaagagaggcctccataaagccacaaaactggggttagagtgagggagaattctgtttgtgatcatttcatgacaccagaactccactatttcataaaacttttgagggaagcatttgtaaattggacataaactagtcaaggagaacagtgatgtagtgacacacagaaaggattgtcatgtacaacaaataagcatagcctcccaaacaaatacagtcttatttacaaccaccttcttcttatacatacacatgcacacacttaaatacacatgccaacaagtatatacagagatgtcactgcacactcatcccacaccctgaacatggttccatcacactaattttctgtgaagatgtcagtgacctaggccacatcaaccacaagtagagcttcactttggacagttgttagaaaggaacaagttccttaggataatagggacattttctaatacttacaaaaaaaagtcaggaagaaagaaaagaaaacaaagaaaggctgaagtcctcccacaggcaggctcatgctctgggtgtgctttcgcaggccagaaactacagaactgggagtactgccaagtgctttatcaaaggaaacagcctgcccaacagctggagatggtcttctgccagctgtgtgtgcctcttggtctccttcttttcactcttctcctatcttcatctatccatctcctgcagccttgcactttgcattggtaaatgccatatacagatatccttggaacagagaaatcttcatgctataagtaactaagcagctcacaaccccagctagtctagaagaggctgtcttgagagggaatgtattgcccagaagctggtttctaggaatagagcaacaggtgtgcactatgggagctctttgctacacctggagtcctgaggagacacaatccagtagttcctccttagcctccctgtcaacccacagtgggtggtaggtgcctagggagattgtgtgtgctggcagcaataggatattttccagcaacctcagcaacattaccatccatattcattaattagttagttacttggattcacttctctgagctttaggcttcccaatgagagaagaaacaacaacgctgggcagagggaaagcttagaggaaaggtgttctgagggtggcaggactactgccagacacttaagaaaagaaggatcaaggcagacctcctgagacctcacttcttttttgggtctacatccacttgagatttcttgtttggcagctgaaatggccaggaccaaaagatatacattgagatgtatatgtggaaacaacctcatgataatgaaatcctctggggctgctaaattcaaagacattactgatctctgagtgctgaaggcattgccacaactctaaaggaagccatagaggattcatactattctctgctcatacaacctgtacctcttgccttagttgaccctaaaaatgacttgagaaaaacctgcacatgccccaagagcaggaatcctgttcatctctctatcaccaagtggtgggcatatactgactgcttaagtaatcaatgacctaaacaccagagatactcactttaaggatttaaatcagtgggaatcagtaaacttggtatgtatttattgttcaaagtcaccacgttggacttctttgtccttcagccaaatttcactgagtactaatgagcaaaaaatgtgaatggtcttggagctggcatctcagaggtattgttctgcccatcatccctgtcccacttaacattatggttctaccctggccaagatctcgaatcttccttcccagtcttccctttcaccttccctgaagcttctacaaaggagagcactcttcctcttaatcacaagtggctctgaagcataatgagcatacactttgtttggaaccagacctgaatccttagtcagtcacttcctaaacctgatacaacttttagttattcactctctgagcatcagcttctctctgtgtgaattgaaatggtacagataatattaaccataagactttgggaggtctaattgtgattacatatgtattatacataaagtgctttggacattattcagtacaaagcagatactcaatgatcactagctgatgatttttattactattcctctgtatttgtgtggtagtggagggagttggtcccacacagatggggtgatagagctgactttatgaaaaaccagacaccctgactagaacactttgaagacctttcaagtaattgcatttgtcaaaccctggcaactacaatcttgaatggaacaaggagcaataaagtagagcctaactctcagttcagtgcctgcccgatcatgtctgtcccaagtaatttctcctttgcgacatagactacactggctcctaagttaggggccaaatgttttctggaaagttcaccataacatctctaacctgacttgcttacttccctcatttcgggtctcatctgtttcaagtttccttcctgccctatgtgctaataatacacattccttgccacatatttcccagtgtgtgctcaagtttaagtacatcttaaagtaccaggaatatgactcaaaaggagtactacttctatcactgtctgtttatgagagaatgtgagtgtgtgcctacagccttggaatgccagttcctctacatagtaaactttgtgaccacaaaagtttcttgttcctaacccaactacagattgtttaacctgccattagcagggaacctctggaaataaggaggcctacatggaattgattttgtctttacaaatggaggtttgagggacttgattcctctagatccctcaaagagtacttctaatggttggcaccaccagcattcagctgtgaggagcaaatggcaagagggaagagatttcaggtctgccttggctaccactgatttcttatttcctctccttttctagtttgagagcatttgttgctgtctgaaggactgggcagtgccaacaccacaataaacagcttgtccagtacacacaagctctttggaccctgaaatgtcagctggccaactggcgcacagctagaccctgctgcgtgctgtttgcatccggccccaacaatgccactcagcacttgtagagccatgtgtcatagcaacaaggctgggagtaggttacccacagggacctggccatagctctgagaagccaagctcagagaccatacttagggcctcagataaaaatgactgccttaaagatccagatctgctcatcttagaccagctgtatggctggtccttctccatcctgtctcagacttggctctttggatagcagacagacagactccctatgccccatatggctgggctgctgactggtgttgaacagaaatgtctcacccagtgaaagcttgtggagtgtgggatatgtgcctccagggtggtgcagactgagcataaagggcaagagaggaaagaaagcggcaatggggtctggtggcaacagtgctaggccaggatccaggaagcctgggctgtgctcccagcctctgccaccaactcccttggtgtccttgagcaagatcacccagagggcagggttgggagaataggcacagggccaaagccttgcctaggagatgagctgcaaaaccttgttcatacagctgagaagtggaggttaggtgtttaatcaggaagttttatccagctacctcattgccattaagtaacctggatgcattttgacagttaacacaaccaagcttgaaggtccagaagacatatcagaaaagatgggtaaattctttaattttctttggaagtcaacaggcagagatctgtgctgtcagaatggcagagagtacagttgttccttatccatgcaactcgttgatactgtcttaacttctgcacctcacaaccacacaggacatcttctctgggacagtaaacttgtacctggttctgggagtttatatacaaggaacatctcctacctcatttcaggtacctctgtcccaaaactcaggtacccacagcatggcacatattcagtcccaggacctatttgacatctcatctctttgagtttcctttcaagcaggagatctgctatttatcaagtcctgtgggtattccatggaaatgagctcatggggtgctctagtattaaactgcacaaaatacagttgatagaattataccagtatctgctgacactcagtagatattcaacatgtattgtcaagtgaatgcagtctagaataaatttgtaatactcttgtatagaaaggttgtatctactactacacattccaggaagacagacttctttccatggcagaaccagttcagggggggtgaggacatgaaaaaaaaaaaccctgccagaaaatagtatggagtgacccaccttctatgtatatatagagaaagtgggtataactatggtgtggtggggaggatgtctgggcaaaggactcactgcagtctgagagcctgtgacactttgaatcataggaaggccactatggtagtgtctgattggcttttgggatctcttagggaattgaagttccagtatgacaaagctatgtcaaagctgagattttagcatcttgtctggtgctttgggcaactcattattatttccaagtagatgccagttgtcaggaagtaccttggagttgggaaacagttcctgggggaatcagaaaggtttaggtcagggtcctcaccaattactgataataaacaacatagtcctggtcttcattgttacaggaatttagagctgtgttttggtatttgaagcttcttacaacagatttaaatgctgtctgtacctccacaaagtgatgggtaagagtgacccagagggctggtgagatggctcagtggataagagcacccgactgctctttcgaaggtcaggagttcaaatcccagcaaccacatggtggctcacaaccatccgtaacgagatctgactccctcttctggagtgtctgaagacagctacaatgtacttacatataataaataaataaatcttaaaaaaaaaaagagtgacccagaaggaggggaaaaacaaagaaaggtctcctggtcttttgacgttataagtgctattgattttacaagaattttccattgtgaggacagtgaactgatctcattttgcagccagcttgagttcttgacaccactgtctaggccataagctgaaaatcacaaaggatgtgaatttatttctgcacagttgatagtcactactctctacaaggcaatactgtgcctcctgtggtgggatatagtttgtatgtgtttccaggcattccccactccttcctgtttccccagagatgccatgtgatcctaggcccacatgttctaaactctgtcagtgaaaagagatttttcaagaataaaggagcagaaaaatgatgttgaggcagcagaaagatgtctgaaagagcatagagcttcaattagtaacttgtacttgtccctactatgccacagaattaacctgagtttagatagtcagtttctcttccttgtctgtttttttaacctgttaatgaataggtaaagagatttctttcaactctaaaatcctataggcttgtgaaaagaaaacacagcatcaggaatggaaaaagtttaaagtagaaagtgattctgattgaaaaattctaggacagtactgaaaagagaaaactggggaagagaagtgtcatggtggagtgggagtggccttgagtggaaactccatgacctagattctgttctcaattatatcactaatgagctatatgacaatagacaggtcacctcctggttttatatgttgtatctcatgcccgtggttccttattgatgatgggtggccagctaaaatctgacacataggtaaggaagaacagaaaaagaacaatggctctggaatcaggcagacctgatttatttttcctattgagctgtgtgactttgagcaagtcattttctctacccaaattaaatttttctcatccataaatgaaggaaattaaatctagttgaccttgaaggctcctttaatctctctgaatatgtaagaaaacaaaacataataaaaaagaagccataagatgccaagtaagccaaaagggaccattgtgcattcaaggaagcaaccagccactgtggatcatttagagcaggagagaaaaaaaggcattctcaaaaacttggggaaagatgttgctacatgtttagtgagagaagacttggttggaaatcatgctgatgagtagccaacacctggcagcagactcacaaaaaaaaaaaaaaagaccaaaccttaaatggaagtaggggaggaacactttgaggttagcagggtgagggagtacatgcagaacctggtcatgggtccttcaaaacatatttggcacttatagattttattctattgatcaattgattgatttttgaggcaggctctcatgtagcccatactggccttgaatttatctatgtagttgaaggtgaccctaaacttcttttttaatcctcctgcttccacatcccatttatatagtgccagatgttaaagctagggcttcacgcgtgctatgcaagcattctccaagtgagccatatcatcagcccactattagcttttatacctaaagagacaaagtctgtgtgtctatggatgaaacttaccaagaaccctgtaacaatttcatggcagaaccaggagcaaaagttgttggagtatttgtgtgtcattcttattccatcaactgggtgttcataaacaaaccccaaggtgaaatgttagcctatcagaaatagcagtaaagaaaaacaaattccaggtaactggtctcttaagctcctaagaggccaatatacaaaggctggaacttgatggtttgtttccttgtttggttggttgggtagttgaaaacttgagcctggcacaggcaataagggctatataagggggaaggatatgagtccacagttaactagatcttaggctagttacaacctctttaggctagttacaacctctttaggtttctgcttatttatcatctgtaatgtttctcattggataattacaaataaatgaattaatgtgtgaaaaacacttagcacaatgcctaatacattacaaattttcaacagtagtagctataatcattaccattttcatcatcctttctatgattacttctactaccactactgtcagtaaatgacagtttattgtctaccttgccaacatcccactcacttctcatgttttctttggaattctgtcctgccataggtgccctgttttctcaggaccacctttttttttctttggtttatttcgagacagggtttttctatgtagccccgaatgtcctgaagctcactctgtagaccaggctggccttgaactcagaaatccacctgcctctgcctcccaagtgctggaattaaacacacatgtgccaccactgccctgcctagctattttctttatttacagttcaaatgttatcccctttcctagtttcccctccgaaaatcccctatcccctcttcccctgctccccaacccacccgctcctgcttcctgaccctggaattcccctatactggggcatataaccttcacaggaccaaaggcctcttctcccattgatgtccaacaaggccatcctctgctacatatgcagctggagccatgagttccaccatgttttctttgattggtggtttagtcctagggagctctgagggtactggttggttcatattgttgttcctcctatggggctacaaactacttcagctccttgggtcctttctctagctccttcattgggaaccctgtgctccgtccaatggatggctgtgagcatccacttttgtatttgtcaaactctggcagagtctctcaggagacagctatatgcggctactgtcagtaagctcttgttgaaatacacaatagtgtctgggtttggtggttgtttatggaatggatccccaggtggggcagactctggatggtcattccttcagtctctgctccaaactttgtctccgtaactccttccatgggtattttgttctaagaaggaccgaagtattcacactttggtcttccttcttcttgagtttcatgtgttttgcaaattgtatcttgggtattctgagcttctggcctaatatccacttatcagtgagtgtacatcatatatgttcttttgtgattgggttccctcactcgggatgatttaactccaccttaactccattatgacaccagcattctcaggcagcttctctagagtgcttgcccatataaaccccaaaagacggtcgaaggttggagacaggtggcacgggacaaccaaatgagttcatgcattgacatcctgtcctcagttttctggcaagacctagtaaggtcaccttttgcttcaaatttcctcctttggggagaggagggttgaaatgcagcccagagggaatacagatagaagcaagagctttgtccccacaagggaggaagggaatgggggcaactctccaatgttctccagtccaagaggcatttcagaccaagggagtacttttgatatgagcgggtttatcgtgtctctgttgtgctgtggtgagactcattcccctacttagccctatggcaaaacccaagagcacttagtgctaggtgagagattctgattgcttcagatgagaaagatttgtggatgtgatcatgcagaggtagatgattatggtgaggaaactcaaaagtgttctccatacttcctcagcctctcaaattcctggaggaaaggtgacgtcaccagagaaactcactgccattagaccagcgagaactgaaatcaccttgtagcatgcaggtcctgtaaattgcccctttctctgccttgagagctgaagaggaaaataggtgagaagagcagacaggcaggagcataaagatggaggatacggttgtctatggttggcaaaccaaagttatctctgtcaaaacgagtcccccaacccatgtaaacaaacatgatgtgtttcctgagcacatgccggatgttcctcataaaagtctttgtaggtaattttccagtctagtccagtcattactccctagagtcccttctttaatgctttgagttttaggtcaatgctgggatagtagagaggtagagagtattacatggtaaaagaagacctgaagggacaggataatagaaagaggtatgagagtcaggcaagagctgctcttaaatagggtagaggtacacaggagatcaagtgggctaagggctggcctgggagaagggatgaaaacaggcctaagatgtgtgggtaggtttttggtgttttgttagtttgtttgtttaagctactgtcatggatcataggcagaaggaggcagcatatctgatactaatccaaggccttgccctctgggtgacttgttccttagctggtgtgtgcatgtgtaaaatgttggctaatgagtggcctcctttgcagtgttgtttcaagaattctgggaaggaccttctcaatcaaatccatctctctccctctcctttccttgattataccttaatttcagtcccagatgctccttcagtttggatttaaactgtagccctttagaaatgaaagaggatagtgaatgcaaaatagggagggcaagtgagactgtcacagtacctcagaatctgggggtgctcctaggagtgggcctgagccatggttcagtggagtagggcggggcggggggtatattatgagggaaggaactcagtggtggctggccagcctccacccatttgcataaggagtggaggagttgtgcctgagtaaatttgggcaatactgggagcgacttagtctgtccagaagcaaggatggtctcagacagccctaaaaggtaactgcaccaaccagctaagcccttggaaagaagtttggggaagacgtttatgtagccttggtgtggggaaggggaaggaaaaaaaaccttggcagtggcttgagaaggaagcagattggcctaagaagctggaattatggaggggcagagtcagggagctattcagggagctggcctggagccagcggccagtcccaagagagtgagcagaggcttgagagctctgggacccaatccaacttctgaccttgagtcaccatgcaactcggcacttttcctacctcagaccagacacccatcagatctctattatcttggctttccattttacagaaaactatgtagaagctactctcctggcttctcctcttgactgacccctgactttcttcagcccttataccacctcttccacctagtccagcatcccacaaacttctgggcctctagaagttcattcttgttcctttggctccaagaaactatcatgagccaaatggtacaaacaaaaacctagtcctgtaagcaagggactgactatctcaccttgttttgggccctttgacttaaaagtatgtctgaaaatcattgcatctgtgatcatggcagaaaattagagctggtgtcaaataacaaagtcacttctgctacttactcaatcattctttttgttgagcatatgatatgccagatgctgctttgggtactgagaatatgcctaagtttatggatttcaagtctacataggtgtgtcatttatgaaagaagtactcgaactgtaaaaatttgcagccctggccctcttatcttacagttaaagggaacttgaacccaaaatggttatagaacttttcaaagttgttttagtagtcagagacaaccaggcccaactcatatttcctcactactattccaccaccatttgtactgtgtactggacagaatatatgaagaggacagtagtatttatccctgtacatatatactcaggcttaccttttgtgagagtatagcatgattttcttggcagtacttaaaaatccattcataaccaaccttcaccattaccacccctcacctaaaatcatatcattgacttacctctttggattaaagcacctgcagtctgaccagggaaaacacaaacaaatttctttaatttgctctttaggactagcctaaatgctcggtacatttgatttatggatggtagacctggagtttttcgtaaagacagcactgctgtggaaaggccaatgcagaaacaatcctgaaactctcaggctgtgcaaggacaaggacacaggttgcctggggataaaagcaagaggaaggtacctgaaaaggaagcagaaaagttctaatagagctcctacttgagtttagcctggagtgcggagcagccctgcaaagacactttgatgggtgacagtttgtttcaaagtacatgtttacctttgttctttccttatactacactatactcactcttttgtcctttctctaatctgccctactgggtagtttgcacctgttttccattaccaaggggctagtcactgcattgaaatgaagaattattccatcctagcaccctagaagggctcacttgtcctgggtggttgatgctttgggattcctccctgatcttgataaggacccctttccaatttccatgcaactgagatgaaagaagtttcccaagaagtgacattgggtgtgagttacagtaactgccaagaatacaactgtgcctaaacgctgcttaaaacaagatacaggggactggaggtatagtaagttagtcatacagtgcttcacagcaaatgagcaatcaccaaaactcacagtgcacagttagaaacaagccaatgctttggaatagaagtccaaagattcttatctggcctatgccacttactagctctacaattccaggatagtcatttaacggtttaacatctctaattctcatccatacagttggcctcagatcatatggtagccagctactaaggactgtttacaagactcaaaatgctgggggataaaataaaaccaaagaggaaatcaggatgtgagagctgttgcctttatgctttggccaggtgaggctttagggtctctttaggccttacagatctcttttttattcctgctgttttcttatatccattttgctttaaacaaggcctacctgcagggcatccctttgctagtgattcagggtgaaaaacattcccctcacctattttaagctgttctacattttctacccctgaggtagatgtgtttatgcagaagaggacagtcccagtcaaaacaagatgaaaatacactgttggctgggagccccaggctaactggtttcaggtcctctcccagctgtcagcacctcacaacagggccctaggagtgggcggatacccaaactactccatggctccttcagcgggtccatctgagtcttgtgtcttctgagttaccccaaggtgggatcaaaagactgtaaagtttattgctttcacaactgccccttgcatgtagtttttgatgcctagtcttgaatactttggctcactttgactgttgatgtgctaccaggtaagcagtattctttccagttcagaccaagttaggattatcaccttccttccttgtgacaaaactaaagagttttctctctgaaaggcttttcattttagcagaatgcatgaaggtttcagaaccaaggtgacgttgccagagaatttcctttatcttagtgaatgttaggatatttttatctagatgggttttgtctctccctcccattccatcattcaagttataccactgtcactcaggcctgctagctctaaatccctctttgatatcggtgccaattgagatttggcatccctgctcctggacttttatcaccctctactgctccctgtggatgacctgttccaaactgactcagcccctttagctaaagatggaaactgaccagagaaacaaaagtacatactcgggcaaactgtcccttttatttaagtggttgggacttgcttacaagttaacagtggccacttactcaattaaactatattttggtttgccaagaatgctgtattttcaaatgtctttcatgtattaactgtagaattactctcaagagtattccaaagtttaaatgttaatgaaaagccactacattaatttgcctatatttcttcctcactgaagctattagcaaagttgtaactttgcatttatatacagttagaatagtcattcaaaagtaaagctgtggaacttcacgttaaattttacattttcagtactgagtgttttatgtagttacacatgaacaaaaatagtttttaaatccatgacagcagccgggcagtggtagcacacaccttaaatcctagcacttgggaagcaaaggcaggcagaattctgagttcgaggccagcctggtctacatagcaagtttcaggacagccagggctacacagagaaaccctgtcttgaaaaacaaaacaaaacaaaacaaaaacaaaatccatgacaggattagcactaggaaaacaattagctttgcatccacattcatagcttatgtctattacctacattcagttcttcctcatcccccttgtttttagcctttcttgtttttgttatacactgctcccacgtgtttatataaatacatatattgttggctaggttccacatatgaaagagaatgtgcagggaagggggttcctttctgaaattgtaagaccttggttgattatacattctaatttacatattgatgccattttcatattaattcctcaaaccactcccctgcacaaaagctgtgcaaataacttttgaaaccatgagaccaaacatattaactgaacagaaagtttgaaacagcactgaaagacttgcacaattacagaacaatttttctagataatgtttttaaaatcatggagtatatcacattcacgtgttcccttttctttctccaacaaattaagatatttgaacacacacacacacctacaacatctttgttctgttaaaaataagcagaattatctctgttaccagatcttaagatgtccataaaatagtcctatgaggcataaaagttatatgagaggaggaatatagttctatttttatgggttatatttctattttatctagaacataggatgtttagaagccatctatgtagtcttccagctagccagtagccaatgtggaaaaaaaaatactctgatctcctgacaggattttcttcctgcttgacaaagtttatacaaaacgggtattagaatatctctcaaaaaatacattaggggaatatttctctactcttctgtcattaccacctgtctaagggaccagtatctgtatgtatgtcaaatccattattatagctgcctatagaggaatcattggtaacatgacagatacttctgggttatctcctaactgtatttagaccctggtttctcaggaactccagggagtatctttaaaaatcccttcttagtcaaagaggtaataacacatatacttggctattcctcagtttccatatttactttagttctcttgcaactctgtcaacaaaccccacagtattattagttccaacaaatatcaggatgccagccagaactgttgactgggattcattaggttgctgttagagcactatcacaggataaagggactagtgttcatcttattttgaaagtgtatgagctttgacgagaaacttttccaggtcaggcccaccagctctgatgtctgtaggtgttaaagactttttgtgcccacaaaatctccacccacaatgacccaggcacttctgtatttgcttattggcacaaagacaacaataagttgatctaacaaaaaaaatctatgtagcactttacattttccatttccgtgctttatccatacagccttctcgtggcctttaaaagaactctgtacttgataagatgacttcttctttccatgcatgttgtcaggaagagctgagagctagttataatagtagtacttttcattgacatctgacaaaatccataaaacaactacaaatccatagtgtttggttttttgattctggacctatggctagtcagaacaatatggtggcaggagcatgtggcagaggctactcatctagtagtggacaagaaactataaaagaaatggatgaggaatggatatattcttcagagggcagactaacattgacctcctcctttccagttaggccccaacttctcctgaaacagtgctagaccagttgggtactaaacattcaatacatgagtcttttggagtaatttcatagtcaaaccataataactggtgttttaggctggcactaagattttcaaggtttttgacccaaagtatctctcttttgacccaaagtatcacccataacatttttttaagaagcaacagaagagaaaaggttaaaaagatcattctgttgctggcaagccaccaggaaatccaggccttggggaaaagcatagcttttgcttatttctaagcctcaaaatacagcagtgaaaaataaaaataaaaatgaaatatagtgcccaaataaaggtcacagatcagatgcatatcacagagagcagtgaattcccctcgtgctactccttgagaggaaagagttagtgaacagtaggggcagcctcctggccagggacgggctcataaatcgtagcatagggtgatagcggtgatacaagtaggtaagtttcagcctttgatcagggtagggatgggcatgtcttgcagcagagaactcaactagtatttttttagtcacccctagcaagttgctgatggggaatgagtcatatcccttcagcaacataggaaacacatttgattgggtagacagcaaacatggaccttcagttagagctacttctgtaaatggagttaaagttgattcattgaccagactgtgatgttccaaaaagtcacacctctcctattatctggcctgagttctctcttctccattgtgatgccccatttccaacctccttggcttcgtggactgagaactcccaaaaacagctatgaggtgctttagaatctattcctcataacaaagaggcaaaaattctccagcatttagatataaatcaaagtacttcaggaagactggcaatggtggcgcacacctgtaatcctagccctcaaaaggctgaatgaagcagagtgatctctgcacattcaaggtcaacattgcctacaaagcaagttccagtcaaggctgtatagcaagaagctgcctcacaacccccgacccccttaaaaataaaagacataaaacaaaaaaaataggtttggacttactcctctaataatagctttcgtgtggtctgatgaagtttctgagtggggaacctagaaacttaggcagctggccatgatttgagcactgactagatttaaagtgccctgtcttgctatattgcctcatactgtggccttattaccttactgagagtcatagggaagctggcaaccaaggaaaaagagagatgaagcccctctttggctgtttatttctaggaatcagattgtgtgaaaggctggagaaggtggtatttgcataagtaggtatatgtgtgctttgtgcttctctttctttctgataagatatgtgcattctttgtccacatcccttaaaagcagttctttagtgtaggaattgcattcaaatcacatttttaaaaaaagtaaccttccccttctcctgagaagtctgactagttagagctagagccagagcagctcaatgcagtggcccatcactttttcctccgtggctactgtgaagatgcatttattttctgtgagtctaaattgtgatctttcttagattgtccaccaactgcaaaaaaatacttcaataattttacttcatactgattctaaattttacttcatactgattcatactgagtctaaattgtgatctttcttagattgtccaccaactgcaaaaaaaatacttcaataattttacttcatactgaagcacttctgttagtggctgcatgcagcatgtctttagggttgctttccattgataaggaacttttctaattcctcaaagtataactccaaaagatataactaagacccagaatcatgacaataatggctgtctttagacaccacagttgcaggtctggaaaacaactgagttttttcctctgcccttcaaatcatccttagaggtaaccagtcacagaaggcacttttgccaggactggacctaattagaactatcctcagtaataagaacttgtagagtcattccttaggcatctcatatgatttattgtgcacaaatggcacctgtctttatttctcctatatttgaaagactccattatatgtatgattgaaaactttgaaaactagtcctgggagtgctaaggatatcctgttcccagtgtgcagtgctcatagctggttcctctagtgaccatctgaatgccactccaagtttcttctaagatcctgtcacctgtgacttcttcacaacacatacctagctcttaatgtcagaatagaggccataaattttgacactgactcaaactctagaatttgttgtcttgtcatttcctgtcatcttactacctctttgaggacataaggaagctggaaacagcaaaggaagaacagagaaagataaggagggggagactgtggaaggaatgatcttcttttcctgtgggaaagattgaggaaaatgtgtgtgtgtgtgtgtgtgtgtgtgtgtgtgtgtgtgtgtgtgtgtgtgtgtgtgtgtgagagagagagagagagagagagagagagagagagagaatgagagtgagagtgtattctatttttcctctttctccctgagaaagtgtatgtattccttgtagcatttcttaaaacaattgagagaccttccttaaccgctcccaacacttctttgagtattctccagcaacagtttctatggttaggggtgaaggtggggctgcccaaggaataatttgatctatttctttgctttctgtttttttttctctgctttctgttttaagagaagtgcacccttactttccaaacattctctgtatcccccaccactgcctttcactccatctgggctgctttttcaccatccaggaagcccaagggtagagaaggatagatcagatcctttgaaatctgcatagcctctctccacacattgtagagtcccacaaaagaggcccaaggatccacctcaagtgaatgttgttgaatagctgctgtgatataaaggggactctactgaacacaatgtgagacctattgtggcttcaggagccaaaagccctgaaggggctggcattattaaccatccttagatttctgaaagaacttgtatcacttcaaaggtcatctgttcaattgtgggacacatagtggagccaggtgttctactttagagtctctgccctcttaacaactccttgcttgctagctctgcctccctgacaaagtccttattagtaagcctcttgtctgttggctctgccaccctaatagagtcctcttgggttttgtctcctaagcatttttagtagcctcaagtccttgatataccaatcaaagtaaccttggcaactgctagaaaaaatgatttggaattttgactctcaggatggctttacagagctatgtgggtaagaaaaaggccctgccagtgtctccttggcctgtataagctggagcaactaacaaacatgcctatctgacatattatactcttgttttctccagttcttgtaagattacagtggaccaagatcttcagagagcaattacttgcctttgtgaacaagtctcttagcctgagggtaggggtgcaaaaacaacctcattacctacttcataaatcatatagaatgagagtaagaccaagagctgacctagggagaaaggccaagcatatggcagggagaggtgaaccctgttagccttgagttacaaattctttttcgcactgtcaaccacagtgtcagaaaaaaatagttcttacagaaactccatattctgtggctgctgtattatgggctccaggtaagcaatggccaaagagaggacatgaagcgattaacgaaaactcagcccttgctatggaatgaacttaggcccagagatgggagtgatatggtctcatgaactacaagctactctcctgtgccaagctcttgttcttgtttggtttgcttggcttttttttccctttaaataaacctttcactaagatctaactgtagggagaacttctgaccttgtcacaaactaagacattctagaaggaagcataatgtatgtgttgaattacctactttgcttttacctaggttaattttacaaacttctttttcaggaagtttatagatcaattactggtaagggcaaaaatgagaaggcttggaacaattgtggaggttgattgtgccagccacaatgcatcaaggaaaaggagacaggcataaacacttatacaaggttcatgagatttaagatccacagaggttaaactgcattcctgaataaatcatcaatatttctagtcctaatgacactcttaatacaagacatctcaaaaattagccatcaaagttggggtaatgagggtggttttgacgagcagtttttacttctgtgaatgagggccaggggagagcagaatgccttttttaaatggagttcagttctgcctgccatccctagtgtcactcaaagattgtttgtgaagctcactcgggaccctgtccaggagggagctgaaaggcacaattcattgctcttgccatcatccagtgccagggtgtgccccaaatcatttgctagagctgcttctccaagagagtatctttttattagggttctccttgccgtctcctacaccattgccttcagcatttgcatctacatccttcccactttcctgcccaacaaagttagggctctaagccctggccatgcaaggcaattcacatgatctacagagaacaaggcactcgctctgtcaacgtcttgtcttcttgcttccctccttctggactttggggattttccatggagtcaaaataactatgtaagtggcagttgccttcctgtctatagtctcccacattggagtggaaccagaggggaagagagaagataagaaacaaggacagattacaccatgacatttcagcctccttattcccccagcctcttcagaaaaggggacaagtaagtagtaagaactagatagagcctcagataggagggttgtggttgaggagtaaatggggagaggtggttttgacccatcccattaacactgtactaatgctcagacgctcaatatcctttttgtatttccctttctagctcctaacccagtgtttgttttgtggctggtcccacacctctcgcatcatgtccttttccgcttctcctgacataggaccctgtgttttgctggcaatattgctgaatccttgggtggaacattccctgtagaaaatacggaagactttcctataaatagtttccttctggctatgtggtacacaatgcttcaagtgtgacaaaaagggaagtaagatagatgttccccctcactgcctcctccaacctaccacacccacccaaagcctgctctccaccctttttcagcatgcttcgatccagtgtgagacttctgatgctgggatttttcccagttacccatctactatctagttggaaccccaagtagcaggagctcttgtcctgatgactttggcttttaaagtagaacagaccaatgggaacgtgattgcattctcccaactcaaacaacacattacctttcagggctcctgaaatgaggagagttgattccatcgtcattacatactctcctttaggaggtcacccctgagggaggcagggccagttatgtctgcttccttgcaaaatactgtgattagagctaaaaggaaaagccagtgaagggcctagctcatcaagtgctgctggtgtgctcactccaggtctaggctgtattcataagttgtgggatataaaaggcttagaaatatttctcaatattgatgctgctgggctgttgaagccttacgttactagtttctttatggagtccacttgcacaggacacaagaatatatatgatcagcactttactaggaagtattagaccagataatggatattaatgtactgtgcaatcttctaccccactccaaggtttcgtgcaactattttgagcagaagcattttctagtgtgttcagagttaacccgaaagttaaccctttaggttcttcccccctccttcaaccttccctgtgcttgttatcagaaagtctttgtgtggagacatttgagtcagttgtttcccttcatcctacactgaggttctgtctttctttggaacctgagctacagcctgcttttcatatgacaaaactatgggcatatacaagaagagagacttgtctaagtatgggttgaatctacaggatagtagatcattcagaagaaaaaaaaaacttcctggtataagcttgctccttccttccttccctccctccctcccttccttccttctcctttgacaaaggtttactgtgtagctctgactttgtacatcaggctggccttgcactcacagaaacattcctgcctctgctcctgcctcttgagattaaaagcatgtgccacaatgcccagcaaagcttctttttttaccacattttaaaggctgggtacagaaagaataagaaaaaatgggtagatttaattgaggatgccagtaagtgggggcccaaacttagaggtttgattaaattgtaattgttattacaagactacacactttatttagaatagcctgtgctctggaactatatatattcgttcttttctaaagttctttgggacagtttgaatattttttaatattttcaccatccctaaatgtcaaaaaaggtgactatgcctaaaacttaaagttggccttagaacctcttgtataccaccaatgtttgctagcatcctagaggcattttctcttcaccctgtcttcctccttacctgtatttgacacctccaattcatccctctaactttgtgacttctcctttttcagtaaaccctctttttgattcacaattatccaatagctggtatagtagaaaataaacttagtttctaggtcagtatatttgggctgaaatgtaattcactatcttggacaggggagccaaaccctcaatttcttcatttgtaaatggtagtgacagtgcctgtaatgcagggtttgtggtacatccatcacaatgtcaacccatagttagtatgtcattgatggaaactattacagtcagtgagttgcaaactcagcttggttttttttaattgaagtataattaattagtgagcaattaattaattattattcaatgcaacctcgtgggcaacccctatttcctcctttctctttttttcctcaaagtacctgaatttctctgtcactgtttccaaatgagggaatctgcaccaaaatgattgttttacttttgtcctgtacaccatttttctggtgttattttgcctctgcctacctgtcttatccctctcccgctgccttcccaccatctcccttggaattttgaggtgagtagcagtagtttaagaataatttaacaaaacaataaaaaaattaactcagagattctctcagaccaagaaagctctaggtggcagagggcagataatagagcagggaactctaagaacagctaatcagctaatttaaaagtggttggtttggttggtttggtaggatttttttttccagacctgtttttctgcctagccctggctggctgtcctgaaactgtgtagaccaggctggcctcaaactccaagatcactttttttcctctttcagataacactcccgacgacctataaatactatctctactttgttctgcttgctggatacctcttagttgcaaataccaggttcaaagagcctgaagtttaaaatgtccagaggttggcattatttccagactaaaatggtctgaaatgggcttatgcaaaaggtttgcttggagagtttattgttcagctctctgcaactgtagtgagaattgaatatgttaccattaaaatctgctagttgagccttatttcatagttgaaaacagtgactgttaagttataatgcactaaaagccaggaagaggtcaaggcctgaagattgggcttggctggggccttggccaggatgtcagtaccaggtacctgtttaagagaaataacctgaagcaaataattacctcctttgctgataagaggtcccagtacttttccaataacgtgattgcactagaatatttcattggaccataacttgtggagcactgatttatgggtacttaccttaacatcatgcaaactattgtatatgttggtggaacctaatgttcctctagttctggtttggttggtgtaaacagtattggttattgcatcacttattcctttttctgcccatgctgtttcttacatttgccgttcagattttgtccaccaggtggcctttcttaggaaggagcaggaggaaagaaccttttaagtcttagatgccgccttctttttcattccttccttcctttcttttttatgccaaaagaatgaaactatattttaatgcaaatgtgtaatttttattagacaacagtaaccttgtttctttacagcatcgctactcttaaatggtatatggatttattttggcaaaaatattttgccataatatattttggcaaaatttccccttgggatggaggttctctttggattccctgatcattcattatttcatattttataggaataatgaaacaagttgaaaggaaactagaaagtctgaacatgtagatggagctgttatcagcacgttgagattcctgggaggcacgtccccttggtgttaatacttcagggttctcagtttgggaactcctggggaaatcctaaatcttgctttcttctggctcctgtttacacggttacattatcgcaggaaaggattttcctgaggcagttgatatgtcactttgcattgtagttttcttttcagcttgttgtttattttaaaaagtaacaaaattttgcttttaaaaaatagtgaaatcatgttgctatagcctataatcccagtatttagaaggcttgtgattagaggccagcctgagctatgtagacagaccctgtctagaaagacattaagggaggaaagagggaaaagagagaaggaagggctggagaggtagctcagcggcaagagcactggctgttctccagaggactgggtcgattgttgcgaggttggctcacaaccttctgtaactccagagaatccaacaaggcactcatgtggtacagtcattcataccagcaaaagacccatacacaagagataaaaataaatagggacaagagctctcaggtaatggtgttgaatgtattttcttggcagagtaggatagagagaacaaagagaaaatgactggtatctgttgtcactccattgtcaactgtcagctttcaatatcctctgtcatccacccactgctcctattatgtgtccatcctatatctcatgcagaccacccattattcccataactatacttttcaaggaagaaataaactgagtgggttctaaaatttggaccaggctcggtaagcatccggctaggtgaggtgacagctgcgtttctcagtgcgtgaatatgcagatggaaagcctgtttccaaggaaagagattgactgaggggttagttggctggagaaagtgaagaatggtgggagtaggcattcagagtgactggagagcactgcagagccagttagagcatgccgactggcacccgaagaacttttaaatgcagtaccgccctctgctgaatgctttctacctcctgttagagcatttcttctttctctagaaatcggctccggtttgggttttgccagcctccaaagtcctctttggaaatgccaattggcacaagaaagtgctgaactgtttacagtccctgactaaggttcagggaggggatgtggtttaactgggccacaaagcccagtacaggactcatttgcatggcccctgacgccatgtgacgcagctggctcctcctatataaagaagcaggagccgaaattatctctgagtctgggttggactggctgctgtggagtttgtgacatactaggtgacacccttggagtcacttctcttcaactccagcttagaagtgcctgcctggctcagggtctgcactgcagcctactccttgcttcagggcctgactgcaacgccaaagcctatcctatagcggcgcgccagcagccactcaaaccagccacagctccccggcaaccgaaccatgaacaccgaaatgtatcagacccccatggaggtggcggtctatcagctgcacaatttctccatctccttcttttcttctctgcttggaggggatgtggtttccgttaaactggataacaggtaaccactgactctaactcgagcgctgaagtgagccagggagcctgcaggggctggactctgaagtggacctcagagctagctagctagccttgcgctggtccctgttccccgcggtgtagcatcctgggaaggggcgggggtaggggacgcaggaaggggggtcacctccgcgctgggatccgccggcggagcgtccctgcggctgctgcgtggtgaaaaacagcagctgcagccgggaaggcagagggccggcgagctaggcaaggctggggcaaggagaaggccgaatacttctaaattgagaaggaattcctagctaggtccggagttcggtaggtttgcctgggaccttaggggcctgcaatagggacttcccttgggcatgtgctccattgtttgcaaatcgcccaaaagcaggccgctcaggccagggagccccataaaccgcgaggctccaatcctttggaactcagggcagggcggagccctcacaaggcttgtgggggttggggaaagtgcagcttcctgcaggggctggagagggacctaaagactaaagtgtctgtctggacttcaggccagggaggtaggagagaggaagaccctaggcagatggaggacttcggccacagctgtcttgtacacttagagtgactaataggtggctatgctttttgtctttgcagtgcctccggagccagtgtggtggccctagacaacaagattgagcaggccatggtgagtagcatcactgcgtccttgctgtcctctgccttagctgcagcttatgtaactcggaacaggtctaagggcataggtgcaagggttttgccaggacccatcctcattggagaccttagagtacaattagcaggatactccgtcttcactcctccatcccagggctttacagcagcctctggcttcctcctgaatggtgcaaggggagagctatgactcttgaatttgtctgcctcctgcagttggcagagaccagagctcattggatgcagttgcactgcagtgcctctgcagaacctggactagggtcaggagttgggaggaaacagaaagtaaagcaccccacccttttgctggcccagttctgactaggtaaaggttatattccaccaagcagctaaaatgctggagaagcttgagacttctttcagtgagaggctcttagagtgtgctataaagcttaatgtcacaattccctatccctcagtagattcaaagagtatattgcaagctctgtcgtccctccccagaccaaggttcctgtgtcctgtctgagtgtgtaagacaactgtgactcggtgtactgtgttacgtgcagaggaggaaatgccaaaatagatgaaataacaatttcatattcttggagaatatttgtaaaggtgcactatcggcttaccgcagatttgtgccagcaccaggacaaacttaagagagttcttactctagtcagacttgaaagtcattaataattttgagggaacctgcctggaacaaagctggactcccaaccctggtatggcacaaatcctgtaagtctcccggacaagagtcttaagcgctttggagaagagagcgtaaaggatagagcttcaggcacaatatagtgtaggaaggctacatgatggtggcatgaagaccagttcagtggagtggtggcagggtggcagcgccgcggacgggctgtgatgactaacatagctctgtcccacggcaggacctcgtgaagaaccacctgatgtacgctgtgagagaggaggtggaggtcctaaaggagcagattcgtgagctgcttgagaagaactcccagctggagcgcgagaacaccctcctgaagacgctggcaagccccgagcaactggaaaagttccagtcccggctgagccctgaagagccagcacctgaagccccagaaaccccggaaaccccggaagcccctggtggttctgcggtgtaagtggctctgtccttagggtgggcagagccacatcttgttctacctagttctttccagtttgtttttggctccccaagcgtcatctcatgtggagaactttacacctaacatagctggtgccaagagatgtcccaaggacatgcccatctgggtccactccagtgacagacccctgacaaagagcaggtctctggagactaagttgcatggggcctagtaacaccaagccagtgagcctgtcgtgtcaccgggccctgggggctcccagggcctgggcaacttagttacagctgaccaaggagaaagtagttttgagatgtgatgccagtgtgctccagaaagtgtaaggggtctgtttttcatttccatggacatcttccacagcttcacctgacaatgactgttcctatgaagaagccacttgtgttctaagcagaagcaacctctctcttcttctctgtcttttccaggcaggggcagagatgggagagattgagccaaatgagccttctgttggttaatactgtataatgcatggctttgtgcacagcccagtgtggggttacagctttgggatgactgcttataaagttctgtttggttagtattggcatcgtttttctatatagccataatgcgtatatatacccatagggctagatctatatcttagggtagtgatgtatacatatacacatacacctacatgttgaagggcctaaccagctttgggagtactgactggtctcttatctcttaaagctaagtttttgactgtgctaatttaccaaattgatccagtttgtcctttagattaaataagactcgatatgagggagggaggggagaccagcctcacaatgcggccacagatgccttgctgctgcagtcctccctgatctgtccactgaagacatgaagtcctcttttgaatgccaaacccaccattcattggtgctgactacatagaatggggttgagagaagatcagtttggacttcacatttttgttttaagttttaggttgtttttttttggttttgtttgtttgtttgtttgtttgtttttgttttttgtttttcttttttttaagttcttgtgggaaactttggggttaatcaaaggatgtagtcctgtggtagaccagaggagtaactagttttgatccctttggggtgtggaaaatgtacccaggaagcttgtgtaaggaggttctgtgacagtgaacactttccactttctgacacctcatcctgctgtacgactccaggatttggatttggatttttcaaatgtagcttgaaatttcaataaactttgctcctttttctaaaaataaa

SEQ ID NO: 596 - DNA, 59914 bp, mus musculus; identical to SEQ ID NO: 595

SEQ ID NO: 597 - DNA, 11110 bp, mus musculus
tatcagtccaaggacattactctggaggtgaagaggcttggactcgcgaagcgagcagtgaggttcgagcctgcttactgcaggctgcctgccctctggccacgttccgcctctgcttcttggtgcagttgctcctgaaagccgggacccgaggagcctctggccccgtggttccgcgctcttgagtagaggaggggtgtccgggacaggattgacaaaccccgccctccacttattattttgcttatttttctttgtgcgctcctgttagtttgttaagcagatttagtcctagagtcttttctcctcccttctcctccctcctcctctcccatcgccctccccccaatcctttttcttcccctcctccctcccgtccctctgcaggagactctcgcagcctaggaaagttgcagctccgggtagcgcctagggggtctccaggcagtgttcaaccgccgccatccctttccgactacggcccttcagggatctccttcgcctgcacccttgctcacttcggccggatcttctgtgtccagaacaccctacctatgacgatgctcctggacggaggcccgcagttccctgggttgggagtgggcagcttcggtgctccgcgccaccacgagatgcccaaccgcgagcctgcaggcatgggattgaatcccttcggggactcaacccacgctgcggccgccgccgctgccgccgctgccttcaagctgagcccagccaccgctcacgatctgtcttcgggccagagctcagcgttcacaccgcagggttcaggttatgccaatgccctgggccaccatcaccaccaccatcaccaccatcacgccagccaggtgcccacctacggcggcgctgcctccgccgctttcaactccacgcgcgactttctgttccgtcagcgcggttctgggctcagcgaggcagcctccgggggcgggcagcacgggcttttcgctggctcggcgagcagtcttcacgctccagctggtattcctgagcctcctagctacttgctctttcctgggcttcatgagcagggcgctgggcacccgtcgcccacagggcacgtggacaacaaccaggtccatctggggctgcgcggggagctatttggccgtgcagacccataccgccccgtggctagcccgcgcacggacccctacgcggccagtgcgcagttccctaactatagccccatgaacatgaacatgggcgtgaacgtggcggcccaccacgggccgggcgccttcttccgttacatgcggcagcccatcaagcaggagctgtcctgtaagtggatcgaggaggctcagctgagccggcccaagaagagctgcgaccggaccttcagcaccatgcatgagttggttacgcatgttaccatggagcatgtggggggcccggagcagaacaaccacgtctgctattgggaggaatgtccccgcgaaggcaagtccttcaaggcgaagtacaaactggtcaaccatatccgagtgcacactggcgagaaacccttcccgtgtcccttcccgggctgcgggaagatttttgcccgctctgagaacctcaagatccacaagaggacccatacaggtaagggggagcagacaggtgggcgcgggtctccccaggggcaccctgccaccaagcagactgaacagccagagagggagaggggtggaggccaagccgaggggcggcgccccgccgagacctttcagtaccaagcgctgtcacagcctctccacccctcaccccccaggaacctgcggcgcttttgccgagttctaagttcctgagcagactgctgtggtctcaggaactaattgggaccttctcgcgcccaggaaccaactggcgccacctctttttgtgttcttttctgggttactaagaagagactccgaatgtgttgggagtatattgcttacaagcgacttagctctctgaacacattcggggaaggcaaccatagaaatgctaatgaaaactaactttggttacttccgttcttttttacacttgattggcatatctcctaattaaatgactgatacttttgtcaaactatttttatttggagttccaggttgtttagttctttggaggaaagataaagtagagaaggcactggtttctgtggcttgctcagcatctcttgtaaaagtgtgtgtagtccccggatttatgtagtgttctctttttccgaaaattagtaagactaccaggcttagcaaaaccgctacatttgaaagaggcaaatgaaaagacacaaagaaggggacggataggactgtcccattcccggcccattgtcctacccagcttggttacactgctgaggtggtggtgttatgtgcccgcacattgggagccctggttctttggagtggaagcacaacttagggtaaacttctgacgaccccccccccagctttctgctcctgagagaacaaagggatggatgttcgggttctgggccggccctactctacccctgcctaagatcaccactccccaactcagtcagctcaatcaaagctatggtttttttttccccctccggggaaaacagatgctatgtccttccactgtccgcgcttcccctctgcagaaagaccaccggacttttcaatctcccgctcaccactctgagaagtttctgggtttaactatattctctccctccccctattttgcatttttgccttttgcaggtgagaaacctttcaaatgtgaattcgaaggctgtgacagacggtttgccaacagcagcgaccgcaagaagcacatgcatgtgcacacctcggacaagccctatatctgtaaagtgtgcgacaagtcctacacacacccgagctccctgcgcaaacacatgaaggtaattacctctttattagcggtcggcggtttgtaaacattcggcctgataccgggccgcagaacggaagcgcccgcgctgccaaccctctatccttcacgttaaatccgatttgctccagcactgacaccttgaaccccttttgaggatgggggtggaggggggtcgagaaggagagagctgagttgggagggggaagagagtagagggaacaatcagttgtttactgggaagctctaacggagctcgccagggcttgagctttctgtggccacctcatcctatctcaacccaggatgggaatccggagtgggcgctccgaacccggggtagtgtcattcgtttgctcctccgcttcagataaaacaatagggccaaggagcgcagtctgattccaacacatttgtgtgggaattcagagcacccaacccccaagccacctctgtgtcactcatctctatacctgctttcccaggccgaattctgaaagtgaaatctggagtgactattttatagggctggcagaataactacttgcccaatccatccacggagaaagcatttttgttttgaagtagcacgactaaaatggaattctttattccttttccagcctggtttttggtgggaatgctaggggtatctatctcgatatcagtaatatggaaaaacaatttttttaaatcctatttctcgtttaagtggccagcgggaggtcttgctctcttatagtattcaaatctgatcttgttttgttgttatttgggggttttatttatttattattgctttcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcccaattttaacgaatggtacgtctgaggacaaccaaaatgcatttaaaaaagaaaactgagacaaatcagatggaaatggagttttaaagcaagaggccatatatatagggctacatcttggtaactgcaattgttcaggaaggtttggggcaagatccaaaagtagctatgcccttttctcaggattagaaaatatgttttggcatttgaaggaattttttacaaaatcttttcactgcttttcctgcccccctcctcttgctctctgtacaccccgttctggaactccttcaaatcattttaattaacactgtcctgtttcttgaggaagttatcgatggcttggtggtggtgatgttaaactgatgaaaagtcttcttcgccttagtggtgattgtttcttaaaccatgccaaagtcctgttatgtcttgaacttttcttcaaagcattacacttgtgaatgtatcttcgtctaatggggtcgaaacttgttgttcagtattttttcaggctgaggatatgatgttactctacacagattgtaacgtttagtatacagttgccttttgtaataacttttctttttgtaaatacatatccgttgatgccatatttatcgtttgtaatttaattattgctgcaagtgccgggaactgaacaatatttatggataaatgttttctaacaaattctgtacagcttttgattataactgcttttagcattaaacaattattgttttgagaaaaggaacacaatttacaatttttgaaccatactgactttttgttttgttttgtaacagcctcctacaaataggagatgtgagtaaattgaattttgtttgttggtatttataactcactcagatcccttttttaattgttaaattatttttctattgcagtctagattccttacaatgtcagtttccatctggggaggaccctcctgtctttatctctagctcagatggttgtttaactgggagtttaaatgtgtttgtcctggattttcggcatgcaaatcaaataatactgatcaattcacttagtggccatgacatctcaatcttgtacttcaaagactgagaggctgggtttaatcattcctgccctatatatatatatacatatatatataaacagaaggtaacctaattagctttatgtcccttagttctttattactttacataaaaatgaaaattatggcaggatgcatgtctgttgagagatcactcatatacctatatgtttgtatctatgacgtacctaatctgcctatcaaatctatttagcttcaaaggatagcacacctctgaaatggcaatgagcaaggccagttgaacagtgcttctcatggttaaagtgcttcttaaaaaaattaaaaaaaaacaaaaaacaaaaaaaaacaaaaaaacaacagtctttaaattttggatggcaaaggctgatttgtatatagttcaattcatgattatcacaattactcataacgtttatatagcggtgtaataactgcagcagttcctaaatgatactgtggaaagaaaaacatttgcaaaatactttatttttaaagttcattacttgtaggcaaagatgttaagagcattgtttccattaaaatcagtaacaatgaaaaacggttgtttgttttgtgataaaatgttaacaatccatttaatcttcagtgaagcaactcatttggacaaacagttctttttacaatgggtctgtggaaaagaaactgatcagtattttggggggttgaagtgggtagagtttggagagttttttagggtgctgttggttattgagagcccaatctctgcatgaataacagaaaagtggagataaggaattgtaaagtgtttagaaatgtaatgaataggtttaagcacctctttcgctttaaggggcaatgctctcagtttttggtggcagtcaatttgatattatataatcattttcaattctagaattttgttgattgttctttctgaagaaataaagtcttggcacatcctatttatgttataactttttttgtatttggtgcccaatatttttcccatgttcaaataaatcaatctaaaattgaaatgcttagagaatttctggtgctttaaaacaaactttgattcccaagatccattcaaattatccattttgttatctggttttgttttgttttgtttttgtcaacaactaagtattgacagttttttctttggaggcaatattttgttagtgaaaaatggtgtctcttgcacttgcgctttgctggtgtccacctgaaggccatgaatagaaattgggatgatcatacatgtgctgagcaggtaaacctggtcagttcatcacaccccactcagacatcccaatcttgaccttgacaatgagggtttggactacatccatatttcaggctttcctcttagaaaccagagacaattttaaatgctcagcaatttttcagagggcttttctgactaaatttgtgtgattgtgaaatgtaaatggccagcctctcttctacatattcaatgagcttccacaatttactgtttctccatgagtcccctccctgctgaccccagtcctaacctagctttaagtagagataggttgagtaacactggctaaaacccttgcttaattaaataacacgaaatatttcattagtggcttgaaaatattctaccatagatttttacagaaaagcacttcagtgtcctatgagaggaaactgacaaataacaatgataacctaataactactaaaaaatgtgcttctcatgattccctcctgatttgtatacagcaaatgtcttgaaattatgtttatgcatttctttttcacaaagaaaacttggtttctttgaatcctttgatttttttttttcttgcccataatctagcatagggaatgcatatttatattcttgaatgcaaacgaagcaacctaagacagtaaccacacaccccaagtcacaaatgctaaagctccaagtccaagcttggtccttagtaatatactccttgaaaatgagtaggttagcataatatctcaagatgaggggaaagggggtgggggtggggtgtttccaagcatggctggtgagctctggcctccatcaactttggaaggctcaaagatcagcatctagggtaagactgtctagtaggttccagacatggtgtgctccgaatttctgcttgacttcttgttgcctattttacccctggcttccataccccgctttcctaagaaatctgcccaaaccagcggtccttgtaagtccagtgccttgtaagtttttgaaaggctctgccacaatgtgaatggagggtaccactgtaactagtatctaagcttgttttctgtcactggccctgaagctccaaggctccagttgggctctagcatgggggaaggcgaggagagtcactctagggatttcagaagtccttggggagcccctgtccacacaccaaattcttctaaatctccgcttgaggtttgggcagggaggaggggacctcatttcctagggtcaattctctcgcggtttctgcccgctgaccctttgacctccaccaacagggcccttggcggccataagctagcggatcgccttgggctccgaggacgcttcgcgccccatcgcctctcggcctcattaggccggcggggctgtaaagcagaaatcagcttcggcctaatcccgacctggggtcaattcgagcccaaacaatagcgatctcctaagactacagcatagcgctgccagcaaactttgtgttcaattccttttccactggcggtgggggttggggggaggtgaggacgctggtccgcgaaggaagaacacttgcgacatccgcatcactcggcaaacgccctcttgctaggctctccaaagagcatctgcagtgccgggaatggaggcggcgaggctcctgcattccctgagtatgaggctgatccaaaaggggcctcctcggcactgcgaacacactttgaagtgggtttttagcgcgcacgtgtgagagctcggccggggccttagctgggacccgcagggaggaaagaggaggctccggtccgggcttcaaccccgcccctgctccccgtggcttcggccttttcaagccgaggccggggactttaggactccccccacccccacgcccgcggtcgcggcgcgcaggcgcaaagccttgcagccgtcgagcaggattttgcggccagggggttgcgggggaggttgaaagcagcctagcggggagggcggcctcggctaaggtggggggggggggcaggaaaggagagggatgtggaaaggagggttggtttgggggcggctctggagtcgggaacatggcggccggatgcgaacccccgcagagcgctgcacaacgcagactacggggctgccgtgctgtgttgtccttgagatttccctggttattcctcagcgctggcgcctcgcgggacaatgtaggtcgtggcagttggacgcagtttaaaaacaaacagacaaaaaacggaagcgaagaagttctttttgggcaatctggtgggaaatggatgtgctctttcggggttttgggggctctcaaaatatttgggagaacaaaaacccaacagaagaagctccgggcacacacaaacccttctcatgtggtgtgtgtgtgcgatttcgcgttaaccgtgcccttgttggaattccacagcaccttcgagtccttaaaaaacgaacaacagtggacaatgtgttctcttctcaggacaatggtcaatccagtttggagggaaacagaggcttgtcgacccagttgtacctttgagagattatattctatcctttccccgggccttgttttctgcacaactcatttaacgaacgcaccccccgccccaaacacacacaaaatcagcacctttaactcttttgtgtgtgtacacagctggtactcttaggttaaaggggcccgaaatattcaaaactttaattcagtttttggcttaactgcctcatgccagagtgtgaaactctgtggtctcgagctcctgtttcctgcacaggaaaataaaaatgccacggattcatctttatacgggtcgcagtgaggaaaatgacatcttaaaaggtggactgtgttgacttccctcttctctaagcaaataaggtgcacgaactcttctaggtgctcctaaagaccagcgtctgagcgaaagaacaacctgcttggggttgtccactatcaagcattccagcttctggagatgtggggcagttcctgatggccaccttgggaagggccccaggtgggtgggcaggtcattagcaagtctggcactgatctgggggaaatctgcaaaacagtgcctttatctgcagagaacaatcggtggggttgtctttccttcttttcaatgcacaaagacagaggctttggagcaagaatttggactatgcatttaagttgtggtgttttgcattgaaaacctctgggcaattaaaattagcatgctccatagtattttctgtgcttttatgtgtgatttctgcatgtcaaaggagctggagactcttcagcagtttgaaaacttttttgaaattgccaccaagttaattttcccccctctttcctgtgggtgaagtttccttcccaggcttggccaccctatatgaccaaggtggaatgatctactgacatctttgggagaacaaatgaaataaattgagtttgcttgataattgcttttctgtctgaactctgcctgaatttgttagctttttttcccctcctgattaaatcttgatatcaagtttggaaaaaaaaaaaaaaggaaaattctttcaattggaaaagtgttcgccatgggttagtcagttaggggtttgagcttggattctcttcagttgactttaaaatcaagctaagaatccttgggattcctgagctgtctttggggtcacttcatatataaattggttggcatttctttctttttttttttaataggaattatgtgaatggaatttctggaaaatggggcaacttatctttgtgactccaaaaggcagtgcttttctcactggggtttttgtttctctcctaactaatggttgaactgtacagcttgaaaagcttaagtttgcaggaagcatttgaagagagaactgttcacaccacttggactaatggtaacttaacacaggcgcaaaaggtctttgaaaattagaggaacttttgtttcaaaacacatgttacaactaaagcagctagggaactcagcaattttgtgtctttctcatgtgataccacttcaacctgcttgctaatccgctgactagagaagcagaaactttatagcagctctaaaacacctttcaacaaatggcaagtttataatatttgctctctagtaggctatgtgcattgtctaaattgcgttttgaaaatgcaatctatgtagagaccatttggagctaagccgctagaaataagacattgcttcttgttttactataaactagcagtttaaaacaacatatccacgtaatattttatgaatttttttttctgtaagaaaatttgacctatctgcagttcactttttgttttcttgccagtgttgtcctgcttggtatctgggacagtctctaattcctgatgaagaacttgatactgacgttggtatgcagcaaccagtcctccataacacttcctatcctaaatgcagggttaatgccgaacctactgtgcaagaaatgatttactgatgaggttcaaagaaaaccacatcaatttggatgtctgttaccttgaagtgatcattttaagagtagtagtgtcttccttagatctaaaaaaaaaaaaaaggactatttttctcttttggtgtattgcattctgtgttgagcaatcatttctgaaatgaaaaaagcaaaaaggcttccccaccaatttaggatttataaatgggaagatgctggtgacgagggaccctgttcagaagccagtaggcacaattctcatgcactgttgcaaatctctttctaatatctgatctgatgcttaaaactaaaaagtggagtatttgctttgttactttcaccatgtttgtattcaaaaagcaatatctaggctcctgaaaattgttgtttgacttaataaaaccgtttaaattat

SEQ ID NO: 598 - DNA, 11110 bp, mus musculus; identical to SEQ ID NO: 597

SEQ ID NO: 599 - DNA, 11110 bp, mus musculus; identical to SEQ ID NO: 597

SEQ ID NO: 600 - DNA, 102945 bp, mus musculus
tggcgggggcggcggaaggtgagcctaggaaggtggcccagcgccccttctgcccggcccctccccgtgctcccgtagggtgtcagcctcggctctgcttgcccccactccaccctcctttcgaagggattgccttttttttccctctgctgcggcggaaatgacagtgtggtgctgcggtggtgtcatggtgctgcctctggaccgagaggcgaaaactctttaagtttagcccgggagacctagacgcgggaacgtcgcggtctccgtgctgtcccccgtggggcgcgcgggctggcggatcccggctgttgcgcggcggcggcggcggccgcagcggcgaaggcgggcggcggcctagagtggtggtggcggcggcggcggcggcagcagcgacagcggcccgggagcttgcacgggagcccgagccagcttgctgcggaggccggcgagcgcccggcgctccccggcgcgcgtaggagatggctggcacccgggaacaatatgggtaaaacgcgtcccctcgccgaggcccggggggatggtggtggtggtggggtggctagtgtcgccgcccgcgccgggcttggccctggctggctcctgctgctcttcaggtgccgccggggctggaactggccgaggacacttgggcttgggggggggggcggcaagaggggggagacggggtcctggcggcaatggcagggccccggttgtctgtcacactgttgtgacccgagctcctgccgctgccctcctgggaaggagtttgcactcctagatcccaggctggggaccggcccgaggcctcccgcttggccaggccgagcagggagaaagcagtggagcggctcagctctcgtggcgcctaggcgcaagtctgggaaagggcgcagccgccttcccacgctcccgaaatccacggcgtcctcggcccgggcggcgccccgaggtcggcggttggctcagtggtgctggcgcagcagcctgagattctgtggacaccctgcgagcgggaaccccgggagaaacttaattctccctccccttttcctccctgctggggaaacgatcttcaggtctctgtctgggtggttctttatttctggcctagctgtgaaagcagccccgtggggggggggggggtggagagggaaaaacttgagtgtgtccataggacacactgcgactgaagcagggacaggggagccttttccattccgggctcataaaaattactggaacattactggttatgagctggcttgggttgtttcgcacttcacgtgcagcatagtatttatttatttaggaggcatttcgatttagaggaggaaattaggatccagggattgttggactcttcactttccccactcttccacactccttaggtactgtctctattcaagcccccacatctcccaccagagttcctgcactctcagcttttctctgtcaacctgtgcaatgcggcttcttgcttttcaatcactttgattttttttgaagattttggagggtggggctgctgaatggcattagttgtgtgtctgtctctaaggaggagtatttatgaagcaagacattggaaactgtaatagtacacaactattgtgtggggattaattaatctgattctcgaattggaccacaagagttgactttaatcccattccatttcctctctgaaatcgaatcagatctctgacactattccaatagaagatggagttgctaaatggagagtttacattcttgctcacttctgcttggggagcttttgctgtaccctagattcctatcccagcatccccacctttttttaacctcctcctctctgctcatcactgccccaagggagaatcaatctttgctatttttatatattcctgctcaatcaattagcttaacacagactcataatatgaattagatttctcgtgattgttccttacaaaactcgtttcatgtggttgaaacacaagcctggaagccaagaagatcagagagttcattccagatgtgacgttgcattggctttaaggcctttagacatttgtatgacctctctttcacagttgcttcacttgcataaaaggcataatattgtgtactgggtattgtgagtattggcttggtcctttgaagataaaaggattctataaacctcagcattatactcttcaatgaaagcacttcatttatcctttattgggttactggattgactgggtataaatgggaacactaatttacaggaaccctaatttgccattattagttcccttgagattcaaattatcattgtaatttagatcttaagtcaatttgtttcatgaatgtatatgcaactgaatggaaacatatatacaattaggcatagaaagtaatggtgatgattttaagtcgagtcataaatcatattgattacactttaccctaacaatgtgagtcagactcatttgaatattcaacctcacccatttttttagtctacatggggggagttagttaatgaccaataaaagtaatatagatacatttaggtctggctatataagcaaaattagcacctagcagcagtgagtcaatatttttcaaagcacctttaatgtacagaagcctctgctgtctgtgttgagtgaggacctgcccttgacccagtattttgggctcatatttgccctatgctaaactctacttacagttccatggctccatggctaggatgcagtcagggtgggtgatgtgtggagtagggagagagggttatggcacatgaagagctgtctctcctatttactttcatgactactgggattcctgcttagcatgttgtaccttgcaagaccacttctgagaggcacttgctgcaaatgagtggcttggttgcttcacaaacatatcatctgaacagcgcaaattgacttagataaaattggtttggttaatccctcctctaaaaacagggcaacttgctccaacctgcaggtcttaaaatagtgccagtggagtgtcataattgcatccaagcagtgtcctgagtggtgagcctttccattctctcctcccataaaacctgctgacaccacaattaggaaggaaactacagaagaatgcattttgaatcattggcttgatgaagagtgaagaatattgtctctggttgtcaggttttccttagaagtagactttctcttccttaacatggatgtagagcccctaaagacaaagacagggatgcggcacacagttaagtctcagatggcagtttttagcgataactacttgactgtcattcggtctttatacagcttgctaaatttctagatgttagcaatgggactcagctgctagaggaggcccgagggtgtctgagggtgctccaagtccatttagtattgactttttgtcctgtcttctgtgcaaaagaaagctgtgtctctgacacgcctccttaagcagagggtcctgactcgacacactctatcattaaagtatgaggtatgacatgtttatgatggatagaataagacactcacttaaatttttacagttatttatttgtgtgaatgtgcgtgcatatgagcatgcatgtgtgccatagaatacaagcagagattagaggaaaacttgtggaaatctacacttttcttccactgcatcagtgttttggatcaaactccagccaccagtcttggttgtcagcaagtttactcgctgagcagtttcactagccctaaatatagtcacttttttgaaaattggatacaaagtatgatattgtactgtgtgtatttctggatcctcaacaaatacagtgttcatcactgagcggtaacagaggaggctagaaaagtgcttctctgtgtgttgagtcacagcatcaagtgagaagttcagatgactggtggcaagaaaagacaatcccactctattgtctgccctgggcagactgttagtgccctttcccacttctcaccttcaagggccaagaatcctgtcgccatccattttcatagattaaaactgcagaaagttttctgtgcactgtagaaggctgtgctctgtggctttttctgtctgctacctttttcatcttttttttttttttcatgaccataaaatcacataacatttttgatagtcagacttccagaaagcctataaacatggcagaggcatttggggaaaagaagtgacaccatcccaccatcactttctccatgtgttatttgcctgaatagagtatatacactacgatgttggtttagtgtaactgggttagaaaagtgtgggttcttgtttctccaccacaccctgactgcctgaccttgggctttgtcttagcctctttctgcaggtcagactcctctggttgatgatgaacagtatcctctggctctgcatcatcctcttacagagaccagatgatctgataaaaaacaaacaaacaaacccattctataatgacaactcttcctgaaacctaaactcctaatattttgcaatttgctctgataggaacataaagtgcaggcatggaagacagtgctgacttaggagagcaaagtgtgtgtgtgtgtgtgtgtgtgtgtgtgtgtgtgtgtgtgtatgtgtatacagtccagagatagaaaaatggtttatagttcagattcctctatcactgcgtctgtagccttttgttcagtgttgctaggatccatgcggttcccaggagagtggaagcttgattttcaaataggcctctgttttctgtctcctgttactgatcagaacttggggtcctcacagcctaacattcaatagagtgccctacatacatatattacaagttttattatggaaaagtagaaatgactgtccatcccagtaggacactaaatactttaaaaatcaccagatatttaaaaatgcatcattgaaaaaacagaggattagaagttcagtcttaaaatggatgaaaatttgcactagtagcctaggtgaataaggttcttcttcatttgttcctcaggcttacagctctgccagtgtaatctgcattatgaatcatacttaaaattcttgtcaaatattttaagttacctcagcaaatccatttttggttaccttgattaatcatttttaaataatatttttattctgtgaaatctttatacatttctacaatgtattttgatcacactttcattaatcttttgtattttaggcagattgtgacttttggtcttgttatttttgatattcattttaatatttatgatgattgaattatataaaatgctcaaagtggtaggtttaggagccatttattagaggggaatagcattcaattcttgaactataaaatactaagtaggccttaatgcctattagtcaggaactgggtcagttctctgtcctagccagtaatcaacctccagttctgaggtctctcaatgtatgatggcagcctaaaagaaaacactagaggggctggagagattgctcactggttaagagcactgactccattcctagcacccacatggcagctcacagttgtctgtaactccactatctgacaccctcacagagacatacatgcaggcaaaacaccaatgcacataaaaataaaaataaatgaataaattgtttaaaaacaaaacagaacaaagagaaactagaaataattcttccctcaggaggaccatatgggaagctaaatgttaagacatgtgagcatcagttagaaccgtggttttcctgggattgtgtggaaaggtatgactgttttctttcatgtcaattacatttgtgatgaatttccaagtgtttctagcttgtaaaaaaaagtgttctgggtgtatcatatcaggtatgaatgcatgatgtatgtaaatgtaattttaaaacaggttaatttatcttatcctcatgggatcttcacaagagtatatgcagtgcgtacagtgggggcttttgatctaaaaggtaaagaggctatggttcaaagaatttaaatattgtacctagcatcataagctagtactgttagatagaaaactttaagaaccctttagtaaaagaatgaaacagtggtttttaaatatatatgtaactatactatataaatatatacactatataaatatattattattttaactaattataatcattgactacctacctaacctccattttgccttctattctgagttctcatcatatagaatataaagaagtttatgcattggctacctttatgtcagatttcttttcttacagctgctgtggaacccaagctggctttgaaataattatgtagatcaggctgtccctgaactaacttgtgatcctcctgtctcagccttccaaattctgggcttacagccatgtaccaacattcaaggatcttttctgaacttgaatgagccatccacttttcaaaatgttcttggatttggcagttttctttttcaggtccagaagatgttttcattggttgagactcacaaggcattcccttcccctttagttgttcactggaaagtttgataaatctccctgaggtacaacaagtaaaaacatctactacacttcacattagcttagacaaagagcagccatacaccttgcccatctctagttgtcttggtggcagtgcttaccactttttagccttcctagttactctggtaaagaagagtcatgttttgaagagctagtttatagcatccaagatatcttatttgcatggtaataaatagaaaggactgtataataataggatatctgatctagaaagcatcttaaaggaatatctggtgattctagttcaacttgaacagcatcttgcacttgaagaaagagactaagccaggacttgtttgttcctactccaagggagatgtatagtttctggtattctaagaaaagtctcatgggaagttaatgctaataccctgaaaggttaaagctaatatcccaaagaatagtttttgtattatttttaaagataaaaatccagctcttttctcaatctatagaacaaaggtcaggcttagtttcatatttgtggcttttctgggaagaagggtagacaatagctccccagggagagagtaagagtccagagcatactcagaagatctggaatatgaaaactagataggctattagctgttgggataagtaggcatttagttatgttcaaatggcatttgaaataatagaattctgtcaagtgcagatcacagctgcttgatcataactcttgatcagagttagctaatgctagatttggagggcaatacttgaatcaatttttcatcttgtaagtgcaaaacgtgttatgttttgaaatcataaccactttcattgaagcctgtcctcttccttttaggtaggagtgatggtgcatgactgtaatttaagcactgaaaggcaaagggaagaggattgagcgtaacccaggttactcagtgagcccctgtctcaaaagaaagagaaagtaggggagggagaggcaagctccttttgcgtttctatataggcacacagcatcttaatgcctcaccaataagtctcctttcattggtaacctcatccttcccctctcttcctacttcttaaaaaagctcaaactgaaaaggatagactgtaaagataaactatgcaggacgaatcttctagtagaaagagcaaaaccatacatgtctgtttatacaccagtaaataaattatttggaacagtactccaaaggttgtaggcataaagatagttatttctttttttttcttgatatgtcaattgtttctaccattttgtatatttccttaattcatttatgacaagccattgtgttttctagagaaagcttcatgattatctctcattggtcatactctatcagattcacattcttttgctgtctttacagccttctaaatcgaagatctgcaatcctcaaaactttctgaagttgcaacaccttcttgttttctttttgttgtgtcccttcctctgctaaaagtattttgtgacgtaggtaggaattacgtgtttttagcaacaatttcaatatttttaagtaaataagaactgaggcttaagaattttctgacactcattgacaggttgtagatgtctccgagcattgcaagaccaagatagggaaacagtgacttagaaaaaaaagaaataagctattcaagctgggagcgatgacgctcgtctgcaattccagcactaaacaggtggagcagggcaatcaggagttcaaggtacctagcgagttcaaggcctgctgagatacatgagaccctagctggaaaaaaagtagaaaaaaaaaagaagcaatccagtagagtttatgggcactacataatcacacaatttgcaatacattgataccatatagtaagctatattaagtctggagtttgatctgactttgaatctctttttaaagactgagatgtggttcacatatcataatagtcaccatgttaaagtatacagccaagtggtttttaatatagtaaaaaacttgtgcacccattaccactgtctaactccagaatattgctgaaattccagaaagaaagtccatacatattcgtacttacacccactccttccctcttttagacctcggctactattatgctatctgttcctatgagtttccctattctaggaatttcatataaaaggaatcacacaatatactaatttctgtactggcttctttcatttggaaatatattttaaaggattgtccatattgcaggttctatcagtagtccattcatttttatagccaaataatactctatcataaggataaaccatattttgattttcatatatcagacaatgtggtttggttgtttctctcttggctactatgaatattgctgctgtgaacattggtgttcatgagcttttgaataaacacatttttaaaaacattttattcagtatagacctaggagtggaattgcttgatcagatggcaacttcacatttaactctggaggaaatgccaaactatttcccaaagcagctgcaccatttcccatttgtactagtaatatatgagggattcaatttctccatatcctggcagacacctgctactttccctttctgtttgtttgctttgtattattacagctattctagtgtgtttatttggtttgcatttccctaatggctgatgatgttggatatcttttcatgtgcttactggctacttgtttatcttctttggaagatcctttgccttttcattctgctgatgctgttgtttctagccctaaaggtttaagtttagatgaagtaacatttatctgtattggttgtttgtgattttgttgtgatctttaaaaaaacccaaaaaacaaaaacaacaacaacaacaacaacaaaacctgttgtctaatctaaagcatgtcagatttactcgaatcttttcctctaagacttttgctgttttgattcatagaccatcttcatgtattcatatttagattgaggtgggttttttttttgtaacccaagatctctcactatgtagtccacagtggccttgaacctgttctgatgatcctcctggccccacctctcaagtgttgggattgcaggcacatactaccatgcctacctagatttaatgatttttctatgtcgtaatatagctttctaacttcatttcttgtgcatgttgggatgaagttttcccagaaccatttgttgaaattattcatttttttgctgaattatcctggaacctttgtcaaaaacgagttggttataaatacacaggcttatttctagaggcttttattttttctacgtttgactatttgctgtgctatttgcaagcaagtatgaccttggacaaactactttctttgtcatgctagcacctattttttttaaagaaaactctaaaaacaataattggtattgtactgatgcttagatagtaatggaggtagggaaatggagactagtttcaggcaggctagaacagcactaatgagaatcaggggccctaatgaataaacaaatgtttgaggaacttgcaagaagtatccaatccctcaaattggctaatgatgttactgtgtcacaataaaacaaatggaatgtcaggcgtggtagtgcatgccaacaaccccatcatctgtggggaggaaacaggatggtcaggctttagaagtcagcctcagtctgacagtagtgatcttagccaactgaacttattgcagttgtgttaaaataaaataaggtgtggctcatttaagtaattttctgcattttatctatcctttctgttttttctttatgttagactttactgttatggagacctccaagagtcctttgaaagctttgaacaatcctcttctgataacaaatggcattcacacactgcagacatttctaggagatccagaaacctctagttaaaaattcctactttgaccttatataaggccattgtgacctagagtgagtttccctaagtttattttcatagtgaggttcaagggtcatattgatttgggaacacattttagggattcatatgaaatcgaagagatacttctccacatcttcttccctcttaagactgggaagctgtggcaccttaacggaacatgtaaactcgactttctgcaatgtctgagcaacctgggtagttttcgacacaggcattgtggaatgcttgaagctctgaaaggggttgtaatagaagtacagtgtcagatggagatagtcctaaaggaaggagtcagaaagaggcagagggttcagagggacagagagacaaaaatagaagcggaagccggccatttagaaactctcttgtaaatagttaagataacttcagtgaaggaggtgagatgatagaataaaggtgtaggagacaaagcacaggcattggcatgagagtgatttcagttctgggtttgtgtgtttttgaatgacttactaatgactctgtgcctcattttcctaagtctgtgatgggtcgagtaatgatcccatattcacagtcctgaaagaatttaatgtacataaagtgcttaacatagcactcagaacacatataaataatcaataaatactatgtgccttcttatgtttgctctgagcaatacattattggccattatttaataccagttttgtgccaggcatcatcatgctatgaataaaaatacaaaattgttgttgttctccaggagaggagagaattagtaggaaatacatatatgctaatgtgaatgttctagaagcccccagtatttgaagtaataaacactttctaggattggatgataacattcaccatttaaggaaaccttgcattttctttttttgcaaggatggtcacagagtgtcagttcatttgagccaatgtttaatttgactatcagatgaaattatctaaggaaatagtcctaccctgtgtggaagttgtaatcttctctaaaggcatccaattataaggtccctcttcagacatatggatgaatatgcttaagtaactgaaaatcataaaataaaattatcacatgtctcagcctttaaaatgtagctaaacaaacctttgaacctactaacctaagtgggagtggctgccttataaagaaaaccctccccatttatagcccaatttactgtaggacattcattaaatacctggttagtttagtacattgaatggatttgatttagaaacattctttgtgaatgcatttattttacttaagtgctaggcataattgtactcaatattggtgattcccatgagagggctatgcacatagtactactcactgacaatatttgaacaaataccagtggaaggatcaaattttcaggtcctgatgaagatttctaatgctagtgagatgaacaagactcctcacaatcaagagatgggtgcccttctctctcttattaatagaaccaacagtttcatccagggagacatgctttctatttgtccttagtgagagctaacttagaatatcaaagactcatagcaatatctttatgtccaagtctgaaacgactgtgggaaagtggagagaatgacagactcattagcaccgtcagttggggcgtttcttttactctctggtctgcatgaaaatgaacgttaccagattgaaagttttctggctgctcacctcacaatttccagatagagcttgatttttatctagtcatgttttagaaagcatgaataaaaaacacctggagacgaggttttttttttgtttgtttgtttttttaaacaggcaggtgctagctgaacaaatctgtaacaataaaaacaaacaaacagaagctggaggggcacttggtacagattaagtccacagttggaattcttccctacccaacttgaccaaattaaggacttttcaaaggtcagggcctgagaaagcgaaagggaaaggtatatcatcttttgtctttaatgactcagcttattagagataggataaaacagatttccatgtgtgctaatataaagtaattcaagttcatagtctggaggaaaatgtattattccgctctgaaactgcattttcccaaagctgtctgtcttttttttttcctctctctctctccatgcaggtacttagaaaggaatcatttcaggaaagagagagctagtttgaaatatagccttgttttccttccactggatgtaaaataggagcagcccgtatatcttgccttgacacgaaatagagtacaatattggagaatagggattgagaaatttgtagggcctccaactcatcacagtctcagagaagagatgccagtggagaatttgggaggaaacgatccatgctgagtgtgggagctggaatggtaagggtaatcaggaaaccaagacatagaggtagccccttgcttctgtttattggtgaaggaaaacaaaacaaaagtaaaacaaaacaaaacaaaacaaaacaaaatgaaaccaaacccaggcaagtgtctaaaagaaggtttgaaggagagtggggtgcagaaaggcttcctgattaattttcgaatgatccctattgcttaagcgtccctggggagtctatcaggccgaaagtctcccttggttacaatgtaattattctgcaatcacttttccttcagaaatgcttaatgactcttactttgtgttacttgcaggtgagagcccagcctctgcggttcttaatgcctcagcaggattattttcactaaagatggaaacactggagtcagaattgacctgtccaatctgcctcgagttgtttgaagacccccttctgcttccttgtgctcacagcctatgttttagctgtgcccaccgcatcttggtctcaagctgcagctctggtgaatccattgaacccattactgctttccagtgtcctacatgcaggtatgttatctcgctgaatcaccggggcctggatggcctcaagaggaatgtgaccctgcagaacattattgatcgcttccagaaggcttcagtcagtgggcccaattctccaagtgagagccgccgggagaggacttacaggcctagctccgccatgtcgagtgagagaattgcatgtcaattctgtgagcaggaccctccgagagatgctgtaaagacgtgcatcacctgtgaggtctcctactgtgaccgttgccttcgggccacacaccccaacaagaaacctttcaccagccatcgcctggtggaaccagtttcagacacacatcttcgagggattacctgcctggaccacgagaatgagaaggtgaacatgtactgtgtatctgatgatcaattgatctgtgccttatgcaaactggtgggtcgtcaccgagaccatcaggtcgcttctctgaatgatcgatttgagaaactaaaggtaagcagtatttgctccctcacaattttgatttagtacatagttgtacagttagcaaggtccccaataaactgggtcactttttctataggtcaaataagtcaagttattttcatagagaataacctactcactgcaagttttccctgggacttatatattacataaggctgcttgtagttctggggaagtaagcccgtggtgcacttcacaagggtaacagcagtctttctcatctgtgacacattgtgcattatatatctttgctacgatctccccacctcgtccttttagtatgtgagtacctgtgtaggtgtactgaaattagcatgtgtgataatttgcatacatttggctgggtctccgtggaggtgtgggtggaagtgtctgagtatatctatgcagatgagagatttgtggaggacattagtatatgcgtgtgtttgcaaggtctggggatgcggctcagtgatacagtgcttacatagcaagtgtcaagtccctgggttctagtaccagctctgcaagaaacaacaacgacgacaaaatacctcatcagtacaggcaaagaaagcagtgttgaaaattgccagtgagcacttcacttagagctaattcttacaccaatagatcaccaaatcaggagctgtggtcaaactcctgagctaaaagtggagagtgaaagtggtgagtttgtgcctaggtttgctattgtcagcccaagctaacacactggtttgtaggttctatcttacaagtctccaggcctttgtgttcagtgggcggggtttatgaagttatgttaaatactatttattggcaagcccgagtgcctggttttgaaaggccttttaccttactttgacggtcacaaatgtcagatgtagccaactattggtttcctattgctttcccgatatgtggtataagttttctcaagaaggaagctacttaacagagattcctgactaaatcaaatgttcagtgctggctttggcatcacacatactaaacttggaatggcagaaaattaattggcatggccccagtgcaaggatgacacacaaatttgggaagcatcccatattttgcaaatcagaatatattgtgtggaaaaagtattttcaatttaaaaagtttaaatttgttaattttaaatgttaaatgtctagggacttttggaaaactaaaacctgtaatgtctgttagatgctgttatatacaattaaatgcataattgcccacattgctgtataatttaaaacaattgttatttctgcaatgaatattatatcatcacatatttaattatgtgttcattataaaataaaatgaaacttaacaaaaataaaatgtttaaatgaatagtaagattactacccccaaatagaatctaactctacataagccaggctagaaggaaggtcccagtagcatggaggaaggcgggaaagtaatgggtacttttcttctgttagaatctggtgaacttattcaaatttacatggaaattagtgttggtaagtgtagcagcagtcagaatagattcacaatcttgtctgtaatttactgcacacagtatttagagcatcatacttacaatggtttgtgcctcttttgataattaattgtttccaatatgtcaccttttctcagctttttggttaagagcaagtgtatacctaatgtatgtaagagtcgatgtcaatgtttttatttcagcgaaggtgtaactttgattcttgtggggctacagagggtaatattattgacttaaactcttagaatcatcaaattgttaggccaaacacctggtctagtccaaaccttccattttaaagtttcatacattgagactttcttccactaagtgatgtggtaaatgttaacagacctgtttagtaattgcactggcactgaaaagcagtctccaggcagagtcaactatctttttttaactgctgtttcccctctgaaattaactttatgctccagcaactacacatcccgtaggtaggtccatgattagcagcatcaggaagaggtcataattttataactttcagcttcacaatggccaaaggtaggggtgggagtaagaagagtgggggatatggagaggatggagtaatcactgccaaatattttcaggtgttaggatcataataaggcattggctttgaaaaatattccacacagaaataccagcatccatatgtactgctgagataacaaagagactgaggagaataagcctgtgtctagagaacactggctattccagaatagcgaaaaacatggggtgatagatcaagaagatttggcagtatacagctatagttctagtctcctggctgggaaaatacaagtgtattttataaaaagatgtcttggtctgtgactaatcagtaatgtttggagaaagagtggctatatttttgatagtttccccccttaatttttaggaaatgtgcagaaaaatctgtttataaattaagtggaaactatttttgttcatttttggatggagactggaaacatctgaatcattcccaactgtgtggtttgttatgttgtctgaaaaggaaaagggagtacacacacacacacacacacacacacacacacacacacacactcttgtgagtaagagacactcttgtgagtaagagagaggggtgagggaggaagggaaggcaggagagaaaaagggaggtgaggaatttcctccatccagcgccgagtgggaaaggggattatttcttcacataaaacagagaagcctgacttaatgtcatatgtacatacttctttatgttaatttaagattagaaagcatttgtgattgtttaccttggttctgtcctaaagagaatggagaaagccagttagctggcagaagctatgggggagacaatctaagcactttcccctggctctgagaagaacagtaaattctgtcagaaaagggaaagaactattgtctgtctctctctctctctctctctctctctctctctctctctctctctctctctctctgacatgcatgcacacacaagttgacttttagggtcattgactggtgcagtgctcctttttacttttatagttcaccttctataatgttgtaaatgaaaacccaacaaaccattatggtatgtgtataagaaagattggagtcataggaaggtagtttgtctgtgtgcttgtttgttttgaatggaaatgaggactttcggggggtacctatataatgatttatgatcttatttatttagtatgcctatagggttgagattcaggacacacaactttcagaagacgaccagtgctttaatgaattcaaacaatactcatggttcttacttagttcatgatacatgctacacttttataaaactgcctcacacttcagattttctatttataccagctccttcccttacaaaaggctaatattattgtattatcaaatgttggctttatataaagaggccaatctcagtgcctctctcactgatagacttcaccttgatattctaaaatctgctttttatcatttgctgctcatttaaattttaccctcacgactctcaattttgccagcttcatctactcgggtgaacttcctaactgcatacaaaatgcccagtctggctttttttccctccacattcaccagtgttgttctcttggcttgcttaggaactctacccgttctttagagctcaagccacaccccacaagtctgctctaatacactacagagacattttaaatcccttgaggccagatacaatggtttttttcttcagtatccttctttgtgtttgtcaaacacatacatagtgcctctttaagaactccaaagaaattaggtgttcataatgacatgggggttttgtttatttgtttgttctatttttttgaggcaaagttttgattttggttttgtttgtttgttttttatgtaacacagtctgaccttgaactcacattcttcctgaatctgattcctgagtgctaggattagaggccagaacccctatgcccagtgttagaattatgttataggaagtatattagtgcacctggtttgattttgttctcatcttagtagacataaatcattcttgccattatgaataccttggatgtctaaaaatgtctcctgtgaactactgacaaattttcaaacccagagcgtgagcaaatgtatgacatgtccttaattttaagtgcctattcattttgattactggattttccaactgcctaaccctatgatgacatctgtataaatcagacgtgattattataattctctttgagagcgatgtcttcacatttccatgcccacagcctgccaaaaatgtagctgataaaaaccagggggggatggaggaatttcctggaagggataaacaagcacacgtcctttcctcattctattttctctaattcaccaccgcaaagctatatttacatatgaagactcttgttattacagtatattacctggaactggattaagttttttccattggaaagtcacacacacacacacacacacacacacacacacacacacacacacaaataaaagttgcgacagagctaaacattcccagacaaagattaaggagatataagacttggagaatgttcagaggaaagctacagtaaaagttaaaaggttagaaagaaaggtattgttgaatcgcatcattttgattactgtccttcttcctactcagtcgctctgttgtcctgccactcaccctcattctgtcactgcttttccccagtcaattgtctgtgcacccacttgacacccacttctgttggctaagacagatactctctcaagtatgtaccagtaagcatttgattacatctgaaccaatatgagtatgaatataaacatgagaagatacatatctttatgagagactgggttgggaagagggtatatttgcataaatatgtaggtactgtcatctgcgagggtgtacatttctacatgaatctgtgactgagaatgcctctgtggagctgtatcagtgtgcctatcaatatgtgtcactgtatatgaagatgaacatctgtgatatctactgacaagttgggcaggtggagatcatgagtgtaagactttctgtaggcaccttagggagggttaaagactcaagaataacctaccctaaagctaggccatacatggttaaggatcactctaataaaggagccagacctctatgctaaattagaaaaatctttagtataaagcagggtgagttactatagatgaaaggagaggtaaaacatttttattgtatcttatttacttgggtctagaataacagttgttaaatatagcaagaaaagcagcactcaatttaataaaatttctgtcaaacttaaataaaaatgaaaaaaaagttgggatttatgttcgttgaggtatggattgtaatgggtgaatgtggatgggaaggttaacatcaaggggtttctcagctaaccctgtcttcacccttcaattctagatcctaaagttacaattgcttataaagctggcatctctgttgtctctgaactggtcaagacttctcccccatcatatgcatgtataaatctagaaccaagtatggtgttgaatgcctgcagtcttagtacttgggaggtagaggaaggagggtcaggagttcaaggtcaatcttggctcatagtgggtttgcgtgcacccttggatacatgaggatatgttacaaacaaacaaacaaacaaaccatcaaaaccaaattaaaaaaacataaaagcaaacacaggcacgggcatgttagcatatgcctaaatgtcagcacttgggtgcagtaagggggtgggggtcactgcgagtttgaagcctgcctgatctacatagtgagttctggaccagccaggactacatagcaaggcatgtctcaaagataagaaaacagaacatgattctaaattaggcaaaaaaaaaaagtctgaataattctgtaaatggctatgtgggtgtctgagtaaatgtattttcatttcatctctactaaaactgctttctaagactgatctgaatccttgcttttttacttccaagacttcatcgatttctctggctctgcactcatgtagtattaataggagcctgtgctggaagatattttctgttgtcatctctctagcttaagagcaagtttagcaaatagaaactccaattatgtgtgttcccctttatgttttgaggctgttttgtcactggtcttttagtcactagtggctgagctaaataactactttgagcagacttcaaaagatgatggatgattcagattactctcgggttggtgagaatcttgtctgttactactggacaaaggaacctattacagaaatataacacatgtaaggaagcaagaattattgaagttagagtagtgacatttgaagatggaaatatggtaaagtctcttaagtccatgaacatttgacataatgagataatgcctcattctttgtctcagttgatgatataagaaactttaactgtagcaccggggatttggattagagaatccttcaatcatttgacaattaatgaacccttactttgtttattgaacattttggacattgtagtgggagtgggagctataagaaacaagacacagtctttgtcacaattggggctttgagcttagtagggaagacagacacatcaattgaaaaatccaattcggtttgattgctagcatgatagagatttgcacaggattctctgaagcccagagtttagaacagggaaaagatgtcatcagactcagaactgagaattggagatggatttgtgttcgaagaagggtcagattggaaagactccacgaggaaaggactgaataggacttaatgaatgactgcagtggttttagatggtcaagagacttaaaaaagaatgcttgaattggggatgtcttcaaaagaaaggcactgaagacagaaataaagaagttaggaagagacaacatgtaattatgggccattcaacattcctttgtcaaatatttgctgaccacctattagatgccaggcaacagaaaagatgttacagggataaacacagcttaatcccaaccctggtggaacaaggagagacagacaattgagaacatggttacaaaacaatgtaagcacaagaagttatgagagccgtggaaggacagtaggttttggacttccttattggggtattggggcaaagtcagggaatgaggatgttctggttaagagaacagaatgtgttcaaacatctggcaggtggaactgacggaatgttataagaactgtgagggcaagcatctagaaggaattgaaattcaagtttttcttgtggctgaaaaatggctagaggaatagatttaattggtttcagaatggagggtcacccatgcaaaagcaagctgagaagagggtcaagggttgactctcacagcccactcagaaattatatatgaaggaagaacagatgaaagagaaagaaaaaaatgtagccaaaagattggcagtaaggaggggctatgcaaggagaatggaattcagaggctttcactcactatgatgagtgttatcaaaataaatgctacatttaggtttatttagaaggtacaagtaacatccacctgtttaagctaaatatttactgaacctgggcatgcatccagggaggaaaggaagcatgcagaatggtttgagtagcattcctggtcacgatagaagtggaggttcaagtctgtgttcaatgtttgcagaggcgtctgaatgagaagagggagacagtgacaacccattttacctgtttgagagtctgccattttctaacaaacctgaagtggagttgacctgtgtgatacacatctagaatgtcatctgcatctcattgtaggacatagcttatgtctctacaacagcaaataagtgttgggggaaagaataaactctggcataaggatgtgggcttcagtttgtcgaccagatggtgtgttctgttgttgaaaggccatatgtaattgatatataaagtgacagactgaagcaaaagcaaagtaagtatttctaagacaaacactaggggaagagaagaagaagaagaggaaaatgaagaagaggaggaagaggaggggaagaaggaggaaggaggaggaggtagagcatgaactacaaagcatattaaggttctggcttctggtttttggaggagcaggaaatgttcatatctagataggatgaaaaaaaagggtgatgagtgcgagtggtagcaccgactgacatatttgctttgcttgtggagacaggttcccactgtgactcgaactcatggataatcttcctgcctcagcctcttgagtgctgggattaccaatgaatggatgtgtgtgtgtgtgtgtgtgtgtgtgtgcgtgcgtgtgtgtgtgtattacattgtatatatagttatatataagtatatattatcaatacacacacacacacatatatatctcagcactctctttttttgtaaattgtcttcctcctgccacattgaggtttgaacataggaccttgtacatgttaagtaagtgctggaccactgagatatatccctagacctgatgatgatgatgattttattttccccagtttttaatgcaaacagtcatttctggtccgtgttcctcatctactccatgtttcctatgccctaccttattagtctctatttccacctgtctcttgcttttcgcgactaaatgacatgcatggagatatatggaagttgtcttaatctttagaaacttaactttgagattgattctcttctctttctcactcctaccctttgtcccagggttcagttcccatatcaaagccccagagttgtgatcttgcctaggtatagaaaatattcttcctgtatcttttggaaagctagctagaaaacaggctttgatgtcaatacttgatgtcttaatagaacaaacagaaaagctggccccctttccaggtgttaagactggctgtgtctggtccatgtgtgtaagtgctcatgtgtgtaactacaaatgcctccctggaatggatcgtggcaagtatagagtccggacagctctgtgccagaagagtaacctctcttcctttaatgaagatctctctctctctctctctctctttttaaatacatgactaagtttcttgagagactaaataaaaaagagtgttaccttaagtaacctgtacctaaagaagtgagatttttttaaaagcaattatttaggtgagtcacagagggcgttttgaaaaatgggatgctgtctgacagaagagtggtcggtgcctggcttcctggacagaaaattgtgttctttagtaaaggaactggagagctcaaaaaggccaaggctatacaacacaaatgaaatggaattagggtgaaaatggaatcagtgtagactgccaatttagctaacacaggcctcttacgatctcaattatggaaggccgccaagtcatcccttctttttgtgctgtttagacacatgtacaattctgtgagagccagagtgtagtcattagaaggtgaagagggtctcagagttttataagctaaaatggcttctcaccctcacaaaagggaaatgcagagagactcagaggtaacctcctgcagcaggaaatgggaacttcatcctgctctctctgccaacctcctgtccctgtttcctcccagcagatatctccattccaatctcccctgccactttggctctcttgctgtgatggttcaactgtttggagaatgttgtactgactgggctcggacggagggaacctagcccagtccttaactggaatctatgtgcaaggagcaaaacaaagtgattcttcaaaatggaattacaataacaaagagacatgtttattttgacaggagaagatttttgtgtgcatgcacacacaaacacccacacaaatcaactttgtttactagacatggtatagacaagataatcccgtggccaaagcaatcacatcattcaaaccgagagtgtccccgaaagtttagttctcaatgatttgtgagtgttgggtattttggaaactgtgaggagatagactgcaaaattgcttcagttctctgcttccctccgcatatgttcattattgagaatcaatttcagtttgaaaggaggctttcattccttacaaatgactggaagtaagtaaacgttcagtgttttcccccaaattacgtcttataatgtaagaaaatagtggcaaaaagccatcaacagatggtgttttcattagccaaagatttatttttcaaagcatttttcatattaatgaagcaaggttgaaattagagtcatcttgtcagctctagaacagtgttgttaaaatggactggcattctgtaaattgctagggggccagagcaaactaaccatttgccataattttgtgatggtaacccaaggcctgtagtctaaccagaccccaaattatgtgtttagccctaatttttcttttccgtagctttgtacaagccataagtctctcggttcagggccataagtgaggaacacacagcagggatcttagtcctgctctgcagtatggattatttatgataaatccatttcaaagccagtgttgcaacaggttgcaagtacttgttcaaaaacattctaccaatggaatcctatgtttgaatggaaacacactgtagtgggaaacacagacttttgaatagctttttttcttctccggggttttcaatcaatgggctatttatcaaatatctcagtataatgatttttgatatgtgggatttccatttatatgggaatgtggactactcagccagaggaaatcattgactgattggatccattagtgatttcccctctctaatttacacgagcccctttgatcaaagtgagctctattctattcactttatggttaaacttttggagaggagtctaggcttgcagccttctgatgtactcttagcccatatgatttagcagctatttccaaagcctgactgaaaatccctgtacaaaggttacttgtagcctctgattacccaatcccgtccacccctcatcttttaaaacaaattttcacatttcccatggtctctgtacatttgacagtgatcggtcttttcctgaaacatgtttatcttgattatcctctgagcttggcccagatatgcatttgtaactgccctgggtattgcagaatccatacaaccagtgttcctgcctcccagcctttcctgttttcctctgttccccatattgatgctaggttaatatcccaaatgattatgtcatttccttattcaacattaaagcaaataggtacatactcatttgtacattcaaaatcctcaaaacagggctttccccccaccccccgacctaagacaggttctacttatgtagcattggctggtctagaacttgctctttagccctgactagcctgaaactcaaatagatctgcatatctttatttcccaagtgcttggactaatggtgtatataaccgtactcaacaaaacaaggcttcaagctccttttccattcttgtaccctatgttctagccaaactaaactgattgctgaacaaaaacaccatgtttcttcttgagagtggaagtattactatgttgttctgtacatagtaactgaacatcagttcaaactcctaggctcaaattatgttcctgcctcagctaactgagtagctgggactacaggtgtgtactaccactttggctgctgtatttttatttttgctcatcgtattctttgtccctgaaacaccatgccatccatcatctcttgtctgttaaattcctactcgtccttcaagatcatcttaacttcctcatctttgaagtcactgcaccttaacacagtagatgagcaatgtttttgtcgtggtaaatctctgaagtgttatttcttctttttccctttaacatctatttagtttagtgatggtgcctaattcaatgattgctgccgtttgttccccaatcccttctattgagaacacagatttagatgggaacagaattaaagaaagacgagaaagacacctcaggaattaaatgaaataaagcaggggtggcatgggttacttccagggaactaaagctaaggtaatcaagaaagatctgtgtactagagacttttctattgctataaaacaccaagaccaaaactaacttagagaacaaagagggattttgatttacagttccagagggataagagtccatcatggtggggggcttggctgcaagcagcagacatggagatgggagtagtgaatctgagaagtcacttctttgtctttactgagaagcaaagagagcaaattagaaatggggtaaggccatactttcaaagctcacagtcttagggttttagtgctgtgcagagacaccatgaccacagcaacttttacaaagaaaaaccttttaattggggctgccttacagtttcagatcttttagtccattatcattattgcaggacacatggtggcacaaaggcagatatagtgctgaaaaggtaattgagagttccacatctggattggcagacagcaggagactgtcacactgagacctcaaatactagctcctagtgacaaacctccttcaacaagtccacacttcctaatagtgccactccctatgggcctatgagaccatttttatttaaccccacccccccaataatacacttcccccaaaagactgcacctcccagaacctcttccagcagtgctaaactgtttaaatgcctaagtctatggaaaatatttcaccatcacaatgtgaaacaagagtttagctggttcttaaaattccctttgagaacaagtgaaatcagattagctggcctagatgtacatacatctatatacatatagcccttgcagcacattcaaaaaacaatgataaagttattaaggagccataactacttactagacaggaaaggatccaagatcacgagtcccctctctttgtctatatctctttgctccttagtgtccttccagcccccactttccatagagtgaactttgaacagctataaatcatagcaacatgaagacgacaatgaaacagcaagcctgacccagggaaagaataggaccagagcgagggtcaggaaattggggtgttatgtttggaacagatttggtgaggtattgaggtagtggaaaggaaagtaaaatatactgagactacaggaagcagctctcaacgctaacatttggtgataaggaaagatgagcatccttgatcaatatagaggcatattttagttttcacacaaggaatgggagagagtacctttttcaacagaaaacatgttaaagttatacatataactatactagtaaaactgtcatgttcaaaatacctgaaaagtgtttctgatgtggacctaaaaggagctgtgcaccaggaaatgatggcaaatagatattttcaagatagaatcaagcttagtgattgaaattcttagtgtctatcgaaagaaaaactgtgagttacaaaatttggcattggtgaatatcacattcaaggtacactatatttttcatgaatagacatgcccttaagtatataatgttataaacaaaaatgcagaacatcatggtttaaaaagttagagataaattcctacacctgtctacaaagttatgaatggcacctcttccctgatgaggcagatgtatacatttcttggcctgtagcagaattggtaagtctgagatacaactctattgggctgatggtgtggcacacaggcagatatagtgctgaaaaggtaattgagagttccacatctggattggcagacagcaggagactgtcacactgagaactcaaatactagcccctagtgacaaacctccttcaacaaggccacacctcctaatagtgccactccctatgggtccagaagaccatttttaggcacttgcgttgcatgtgtgaggccttcagttctgtatccatggaggggcacatacttacaattctaggactttgtgggctgaggcaggaagatataagtgggctatatgaggatccgtctcatcttcatgcctcctcccgtagaaagagagagagaggctagtcttttgctgattaacttccatattatattggttgtcaagttcattgttctttttctccctttctcctttttcctgctggcttcataccctccgtgatggcagcaaactctcgagatgaacctcaccaacctggttaagcgcaacagtgaactagaaaatcaaatggccaaactaatacagatctgccagcaagttgaggtatgtaccagtaacatttgcaattctttcattggatctgacctgggagatctgtggaggaacttcagttttgccagattgtagctcagccatattggggtgaaggactgaaactgtggtgtagatgatctctcatgcttttagtaattttgttccaagaaaggtcatagatgggtgatctttcagatttgacaaatttatagtttgtggggtacaacagatgaagaggagctctcatcttttcataagtagatggtatgagagccaaccaggaagtgatccttcatcaaactgtatattatcacttacaaagtcattacttgacagattggaaatcatgaatccttagggtagggtgatatgcactcaatagccattcttccctctcatcactctttccccactgcctagcttctcctcccttcatcccatagccccctggtccatgctatatccttactcatcatcttgtcacttattttcaatttcgtctacttagccttttttattatcaacaaataatttctatgattaagttgtctgtgaattatgaactgctgtgtaagtaagcctaaggtttcaaaatattaccgacattgaatattaaaacagcttagaaggacagttcagtgcttctttgcaggaaagagtaatagaaaggtgttattttctcttctttctttttaactgtttttttttttaaattagagactgtatttatttacatttcacatgttatcccttttcctagtttcccctctgaaaatcccctatcccctccccctgctcaacaacccacccgctcctgcttcctggcccagacattaccctatactggggcatagaaccttcataggacctagggcctctcctcccattgatgaccgactaggccatcttctgctacatatgctgctagagccatgagtccctccatgtgttttctttgattggcggtttagtcccaaggagctcttgggggtactggctagttcatattgttgttcttcctatgggactacaaaccccttcagctccttgggtactttctctagttccttcattggggaaccctgtgctccgtgcaatggatgactgtgagcatccacttctgtatttgccaggcactggcagagcctctcaggacacagctctatcaggctcctgtcagcaagctcttgttggcatctgccatagtgtctgggtttggtggttgtttatgggatggatcctcaggtggggcagtctctggatggtcgttcctttggtctctgctctaaactttgtctttgtaactccttccatgggtgttttgttccttcttctaagaaggattatgagcttctgggctaatatccattaatcagtgagtgcatatcatgtgtgttcttttgtgattggggtacctcacttaggatggtatcctccagatctacccatttgtgtaagaatttcataaattcattgtttttaatagctgtgtagtactccattgtgtaaatgtaccacattttctgtatccattcctctgttgagggacatctgggttctttccagcttctggctattaatactgctagtaataggctgctaataatacttaaaatctaaatagtgtctgggtttggtggttgtttatgggatggatcctcaggtgggacagtctctggatggtcgttcctttggtctctgctctaaactttgtctttgtaactccttccatgggtgttttgttctaaatatagaccagtaaaatataggatttctcatgggcagtgattgggccattttttctaattttatatagagtcttataattcacatttgtgtggcagataattgcaagagatctagttttgtttttttttttttgtcttaaatgatgaaataattttatcacaatccaagttcgaggttcctgtttaagactgaagaatatctcctaaggcaatgagtcattatgaataactaaatccacatcccccaattgtttggtcttcttataatcttgggtttcttcttatatagtgaacatacttaaatgatgaacatctctagctgtataatccccactgggcatctttctgtatagagtacgtgagatacaggtgaagctcatatgtgaaactggaaaataggatggtgtgggtgtagggagaagcagaaagaatgacaagaaggatcattggagtgttagtggaaaaatggatttcctacttgcctcttatataaactaactgggtacatgagtgtaagttggttaggacctctgtgtcagtatcctcccttctaaaatgtaaattgaaatgccgccgtgtttttcaccatctttccagatttcacaggtcatggatctgtcaatggtttctttattttgttctttttctgtggtgcttcattctttccaagaagggagaaacaaagtagaaagttatgatttctgagtagtttcaaccattcagaatccctctgcattacattttatcaaagcttttgattatgctgttagattatagtgtaagaaatctgctctgcgaaagggacaagcgaatattgtgagcagaagattggataaggggacgctcagcttagaatttgcatgattggcagtggagtaatagataacagtgaataaagtgaggttaaaaataaaatgatcattgtattcattctaatcaaaagacttattaagggtagagaaagtaatagtcaaaagagcaaagttacactttatctcattgctctttcatgttagaatctctcaaaaatcgccttttctgactgctgggaatttattatcctggctagcttcacctaagcatagcactcttccatctgttcgcaagtcatgctagaaaccagttcttatttatttatttattgatgcttccctcatatattacatccagaccacagtttcctcctcctctctttccagcacccctcctatcctctcccctccatctactcctcctctgtttccatttagaaaagagcaggcctcccaaggatatcaaccaaccatgcatatcaagttgcagtcagactaggcacctcccctcctattaaggctggacaatataataggaggaaaagggtccctaaagcaggcacaagagtcagagacaccccttgctcccactgctaggagtcccacagtaatgccaagatacacaactataatatatatgcagagggcctaggtcagtcccatgcaggctccctgattgacagttcagtctctgtgagctcctatgagcccaggttacttgattctgtgggtttcctggtgatgcccttgacctctctggctctgtcatccccccttctacagtatttcctgagctttgcctgtgaaactagttctttttattatttgctctgctcttttgatatggtagcaacaggcctcctaaaacaatccatcattgtgttagtaggggagaatgcactctgtccattggataggaggtgagtcttctttctgtgggtaccagaacacacgctaggcaagtgctatacatcatagcaacaagcaacaacatagcccaagaagtgatagttaaagtagcttcgtaaagttagcattcagaagttaacctgtgccttaaggatgtggtgctagcactaccatgtgtagtagagtaagagggaatcccatggtgatccagcaaagtagctatttaagtagcacccttagagatgattgttaaatcccattatataagccagtgtctgatctggttacacaaaagatcagcttttgttactaactttctatggatgttaggtacggtacaggaaaatagcttaggcatactacctacacactgaacaaaacctactctgatgtggtcacacctgttcaggagctatagataatgagataaatacactgagaagcaacaaagaacagtggggcagtataatagtgttgaacatgatgtgtattttaggagttactgcactgtttggttagtttaggattttgtcctgaatgaagttgagaggagtggtaaggagctgacagcgaatctggtaggagttgggggaaagggtttgcaggtgagtgtgattagggattcctaaagaattgtttgagattcctaaagaattcctaagattccgtcctggacaggatggcttatggcagtccatggctgttctttatgtcatcattccttctgcaagcttagagatatgcccctaccttcccctttaataacagggtgcatccacactagctattataaccattcaacacagagcctgtatgtccaaaaggctccagggcaagccccaggattagtaatgcagttaaaggagggacttgagatttcaagaatactcctaagtactttatacactgaaataaatagcaggataatgctaattatgagatccagacactgaatggtgtctggactccccccccccaattttatcttatccagatttgtctgcagagaatgactatattcacagtgtaatttaagcgtttcacattgggcgctggtggaggatgccagctacaacactctggcaagaacaggatgaggttttattcctgccaaacctgttccccttccttattgttggagagtgtttttgtcacaaattgacatttcataaagagtccataaatactgcctccccattctactttttctttcgcttccctattctcctcagagagtaaacaaggtttgagtcttcctattattacagaaacagatcaagatcaccacagatttattagctgaattgcagcttatacctttggctcaactttcataattctcaaaagagatagttgaaaactatttcatggggctgtgcagatccatagctctcctttaatctggttaaggaagggcatgctttgaccttgatactctggccacttgaactctatatttagttctttgttctggctcatcaagcatcctttgtttatttttccaaaggaagtgtctgtataacgcatagctaagggaaaatgtataccaacagatggttacttccttttggcattcctgaaaacttgccagagaagaaaatagttaactacgtaccaatccgtgcgtcagtggtgtttcttgagcatacaagacgtatgtggtgtgctgaaaggtttagagaatacaaaagaaacacttggctgatgatctccagggacttacaggctggccagagaaagtacagcctctagtaagaagagaagaatataaagcagcgagcagtgtagagagtacaagcaaaggcagtatatcccctctcacgtttgttctgaggttttagtccctgagcaacttaaacaaacactttgctgaacatttggtgagccactttcttttattcctctctcaactgatacaatacaagccctaatccaccctagaagctctgggaacaagttgatatcatctggctcttctcaagcctttcttgggactgggcagcactgcagtgtcaggacaagggacaaaggagaacaaaggagctggagagagggcactaggacagagtggtgatggtggggggagcacttcccttgcattgaggaatttaagctccatgtctctaccagttcttcattgcaattttttttttttgaaatctttgtctctttggtcttcaaagttgaggtggctttctgtttttcatctctgcttctattgcttgggtgcttggttaggcaaagatgtgtttgactggagtctgaacatttctttgagtggaaagaacatagatattttaaaggaaattaattttttaaaaaagtagtgctatcatgatttcagcagtaatccttaaatacatgaagtagttgaactagaaggaagagtagaatctaagccatttgaacacacacatggaggatataataaaaatgaatgagtaattacagcaaagtacatccaatcaggggatttttttaaatgagaaaatgcattttagctaaatgctgaaggaggaaaaaataaccctctggagaggcaggcagcagtgatattaatgaaggtgcaaatgtcagcttgcaggggaaaatggtacccatgcttctgggtgtataacaataagtagaaaatggttcctgcctccaaggcacatgcagattggccgagaacctgtcagacaaagtggcaaattgaatgtgaaggaatccttgttgtaatgaagacaaatgcaagatgacaggctggcatggaggaagaaacatccagatgtgcctgaagggctaagaaaaggatgcagagtggaaataaaagtgaagttatcttgaaaatgaataaactttgccaagtgattgaaggggctgaatgcagggatataaagaggtgattagcataaagctattcaggggactagcagaaatctgattctaccaaatctatgattggagaaccattgcaagaggaaagtttgaagaaatagcttgagcctagaaaatgaagggctttgtgtacatcatgggcagataaagtttagactttattcttagtagtctaaggatctgtaaaatgattttaagcagatgactagtgggataaaatctgtgcttagaaaaccaccaaccaaagagtacacatggaggggacccatggctccagctgcatatgtagcagaggatggccttggtcaggcatcaatgagaggagaggcccttggtcctgtgaaggctggatgcccaagtgtaggggaatgagagggcagggaggtgggagtgggtgggtatgtgggggaacatccccatacaagcaggaggagggggatgggacaggggttttctggaggggaaactaggaaaagggataacattcaaaatgtaaataaagaaaatatccaataaacttttttttttaaatagccaagactgtggggtggtaattggagcaggagttaaaggtcacaagtgactacttccattgttattgatacagggaaagtctatcaccatacctccttaaatctacagatcttttttgatatagggaaagatgaagggtcttccagaggcagtgactgtaaggttagggaggaagggataaaatcaaaccttttgtaggaggcagagttaatattacttggctctgccatggatgactgtgtaagggagtactaggataatccccaaattagttcttccttgggtgactgcatgaacacatctattcctttcaactagatgaggaaatacagaaggagttctttttaaaggcattggtgctttgttgtgcttggataagaaagtcagataggaaatgcctggtaagcagctggctggctgcgtctggatgtcaggagagaggtcttggaaagagaaaacactggaagttaccactatctcagtagcacttgaagccacagagaatgtgcaggagaggcagatgttttgggaatgtgcaaagaagaggatggaagatagattgagagaggtccaggagaaagcaagctgtaggaagatgcaagctggaagaagcttgattatgagagagatagcctgttagttattatcctttgacatacagagcagttggacacatatacatatgcaatctcctagctgtttattgttctttttctgggttaataacaataggaattaatactgcctaacaataggaatcagatctactgcctccaatcatgcaagctcaacctccccttcccgacttaccatccagcgacccttcccatacaggaccagctccaaagctttgagtgttacaactcgcttctccgagacatgctctgtaggtcctggattgcagggtgttatggtagctttggattgcagttgcactagcagcacagcattaggacagacaggttctctgaaccccagtttcatcagctacacagtttctaccggaaccttgaaaggtaggataatttgggtaaagcacccatgactgtgtgcctcgtataaggtcaaaactccataagtgatagttgaaaggagagggaagaagggagggagggggaaaggagggagggagggaggaaggaggaagggaggaaggaagagagagagaatgaatatagggagaaaagtaggtaggagcaattgttaacagtctccttagggtaccacatttatcgccagagatttcactccttgaccttaggacttgcagacatttattactgtatatgaggggtaggccaaggccagtcatcctaataaggctttcaatcaatttcaagctcagcaaatatatactggagcctcccgtggggagacatggtggtaatgaaattgtaacaccgaaaacttggatatctcagtcccatggctctttttactaaaaatgcatgcaacttctataaacacaacaaactaatgttttatgatcagtgagctggcacttttcagctcttaagttaagtagtttttatttagtaggcaaaaggtcacttccattctacaagaatagctaaggcattctttccattggctattgagtaaacttgtctctttaccatgcccaaattcctctagattcctgcctccaaggaaaggcaaaagaaaagttttagagatggacaaatgctttcagcttgagtagtttcaaaggacaggcagttatttaggatttagtgtttgttagacaaaaatattcagtgaacatttttataagagatggaagagtaagaaaagcacacttgatagatcccaggaaggacttggggctaccaatacattgtgagaataaaatacccattttgaaaccactgtggaattataggtggagaaaagtgtttccacgaacaatggaaaataggtgcatactgacctagtcagtctattattaagtatatagcaattgacatttaatatagatggagaagctagatctattgtgcagtctgaagtgtgggtacaacctatttttatactacaaaagaaaacactttataacttttcaggcacctaatgcatttaatccttcttcaaaactattttgtgacaatccttgatgtatttggagtaaaataacgtttttgaacatgttaagtgttgcattgggaatattttgagggcacagacacatgatgagctttaagaataaaatggatttagattaatactattccccaactcccatatctgtagggcaggtaagatttcaagtacggtcatgtcttcttagtcaaaatagtacacagaggcatacattttcattctgctttagtacagtcctgtgatatcacaaatctcatattgtagtcctgttccctatttgttcactgtcttagagttttatggctgtgaagagacaccatgaccaaggcaactcttataaggacatttaattggggctggcttacaggttcacaggttcagcccattatcatcaagaatggaacatggcagagtcaggcaggcatggtgttagaggagatgagagttctgtatcttgcttgttacataggcaaccaggagaagactgtcttccaggcaactaggacaagatcttaaagcccatgcccacaggaacacacctagtccaacaaggccacacctcctgatagtgccactccctgaaccaagcttatacaaaccatcacacttaccttcctcctctatttcccagtactgtaaaaattccagagttcactaaatgactagaatatttgcataattttggtctttcctgcttaagtcttcacactttgcccgaattctccatttataattaaaatactagcaatcaagctaaggacctgttcaaccttccttgtacccttgaatacctctaactttcatcttcagtttcccttatatcatctcaacctaaaggggaaaagttactttggcttaaagctaaaacaaccactatgacaactaccatgcacacacagctgtcgagacatccttttaaaaaaatctgtctttcaagagaagtccagctgcatggtatgcttagccaggattgagaagggaatcatatttgaataatttattcttgatattgtgctagaggcattcttgttcccatcctcaggatttgtgacaaccttgtgatagaataggtgacatccccattttcaagcaatgaacccagtggtcagagaaatgaggtgccttactcaaggtcacacagtaagctgagatgcagttctaaatctctggctccaaaccttcagttctttgcactgcatggtgcagctcagaatgcctatctgttcactggcctctgattcataaaaggagacagctctggagagcctacttttccctccgctgaatctctaaatctctagaagagcagatggtatgtttggggacttggcattccttaatctaagcctcatagacatatattcttgcctttggcctatccttggcagcccaggatatgtgccatatcctaagagcctgtcttggggaaggaaggagaaggagaataaaggaggcctcaggatcatactcttattgcttagattatttggggaccatgaaagtacataaaaataaagtagtcagctctaggcattagcactatcttacctatagtctgtcagtttactctgggatctaggctggctttttgaaattgcctggcagtgtccttctgctaaaggctgggcatgacgacagcacaaaggagtgcctttgagacacaaatttcctaaacagcttcaaagaattggcagtaaagtggtgttgcctcaagtatatgtaatattataacgttgaaaacaggctctaaatataaacacaccaccaaagtgaaagcatttagattttctctgcaagagtgaatacatgtgtgcatgtgtgcgtgtgtgtgtgtgtgtgtgtgtgtgtgtgtgtgtgtgtgtgggtgtgtggagagagagagagagagagagagagagagagaatgaaaatgggtggtggtggtgaattcttgttcttcaatggagtgataattgccaagttcatgaccattgactgggcatgttagctacttgttcttcagcacagaaggctgattctatatctcagcccatgtgacagttgaacattatttgggcttgcttttcccatggtggtcaattccttagcgttttctttatatgaggggaaaaactagaacaacactgggaaacatggcctttgtttattctagtttaaagtattgtctcttatgtacagagctgacttgccccctccaactcctcattctctgtcacataccaagccctgttcaccttctcctcactaaaatcaaaggccccaaatggttttggaatagttttaagcctataagacttttcctcaaagagccattataccaattggagtccatggtacatagaaccacacgtttccaccctttgctctttgaatacagtttgtgtacaagtaagcatgcattggaatggggcagcagacatctgaatgcccaaagatgtcttagtaggaaagcattaggccagggacattcttaggacgtgaagtgacaggaccagatagggaagaagaacaatggtagctagagagaagaaatatggaaaggaaggggaaacaaaacaaggcattcttttgctttgtactaaacatgctacacagttcttgccaagttccttgtgtgggggaagggagatgttctagcatctgaagggacctgagtctttaagcctgctgggggctcttctgggtttctgattgctgcctggtcaccagccaagtgctccaaaccaatttaggaggagtcgattggctttgtaatggaatggaatttgtgttgtttttgatagcctagattggatgctgatttaagaagcaaaatctgatattacagatgagtagacaaactgcacagtgtctgtttgccagagaatagaattaagcaccttcacgctttcacactccatttctgtcaaaaacaggatattggcagtaaagcatttgaaaagagtccactggcttaacagtgagcattgccaagttctgtgctaacctggtgacacattaggctagaaggtaaaaacagatcagtttctgagtgggggtaggtgtgttgataattttatgttttttttaaaatacaggatcacaatacttaacccaggttagtcttagctcacagtgtagtccaggctgtcctcaatctcacagcaatccctctggctttaggattgctgagattacaaaattgaaccaccactccatattttgtactaaaaaaaaaataataaactgtccttccagtgagtcactaaaacttcaaccacttttattctctgtggacttttgtcaaaaagcattcattaagctctattgtgtgtttagcattgtactcagcactattggggactgtagcaggagtgaaagtcgtgacacttgtctttaaggactttatagtctagttagcagagcttacaatacaaagcaacagcaagcactaaaaataggagtccatgagagagtgggattgagaaaggctaacattcttattgccatcaccagtagctaacacttactaatatttaatatgcaccaggtagtgtgttaagtattttacatgtattatttcatttaatcctctcaaatacctctgagacagacacttttattatccttcgttttcatttgagaaaatttagtgaagataagaaatttgctcaagagacttgcagtaaaagatgagactacagaggcatggagagacctggtcacaaaggattgtaatcatgttaagaagtttggaatttaccctaaggtcagagagaagccaactgatatttagcatgaaagtattttaagagtggaattaatgtgtgtgtgtggggggggggcagaagtggaggtaaatttttctgtgtgactattggattaagaattctgcaggagagctagggatatagctcagtgatggagtacttacttagcatgcataagaccatgaatttaaccccagtcttgggtggggggaataatgtatcatgaagataaaaaactggagtaggctagttagggaatgttgtactcggtttggcacatgttgtcctcaatacacatttcttggatgggtagtttagtttaacaaagatgtttttgttagatgtagtgaggcaataattagaaaggacagagaaagaaatgggttggagttatacttagtaagcgccatatatggaatgtgatgattcatcggatatacagacaagaaaaaaagagagttcgggacaggggatgccagtgtttctggacagtgagtcatgtgctacttcattcattacattttaggaccattagggatgatttagctctaatggaagtagatgagctcagctttggaaactcagtctgtagtgcctgtttttagataaacaaaacatcccagtaggtagttaagaatacaaatggagatttcaggagaatgcaaatacacatgaggcaaaatatggatccttttcaatgtaatagaattgttctcaaattggatttgctgggctggagatggctctgtagttaagagcacttgctgcatttgcagaggacaagacttcaatccccagcaaccccattggggtgggcacgggggcgggggcgggcgcagatcagaactacctgtaagtctagctccaaagcatccaatgccctcttctggcttccatgggcatctacatgcacatgcatgcacacatacacataaactttttaaaaagtcttttaaagattggactttgcaaatggttgcatcaatctttaaacttacccaaatccagtggattattaacttcaaatgtattggttatatatgatgtaatttatatctcagtaaaaaataggcagaaagctagcatatagtgccgattgatgaagcattagcaacatgtgagatgaggctaggcatggatagccacttaagagactgatgtgggaatattgaaaccttgaggtcaccctgagtaatttattgagacattgtgtcaaaataaagtaaaggatggagctccctggtaagttgctttcccagtatgaaaaaccctagatcagcccttaatgcaggagagataaaaagaaaaaccaaccaagcaaactgaaacaagataaaaattccaatcctgaaaccactaaaatccaaacactgcatttaaaatgtgccggagagacttggaatgttaggaagaaaacaaagtgggtgttgtggaagctggcagaagaccgtatttctagaagtaaatgggttttcagtttttgtaatgacatgaaaaactagtatctttaaatgccagtggattcttctacatgctaaccaccagttgtgccagcaccatttgttgaaaatgctgtcttttttccactggatggttttagctcccttgtcaaagatcaagtgaccatatgtatgtgggttcatttctgggtcttcaattctactccattgatctacctgcctgtttctgtaccaataacgcagtttttgtcactattgctctgtagtacaacttgagttcaagaagttatactccagagaatcaaacaaccctattagaaatggggtacagagctaaacaaagaattctcaactgaggaatggctgagaagcacctaaagaaatgttcaatagccgggtagtggtagaacacgcctttaatcccagcacttgggaggcagagacaggcggatctctgagttcaaggccagcctggtctacagagtgagtttcaagatcgccagggctccacagagaaacgctgtctcaaaaaacaaaacaaaagaaatgttcaatatccttagtcatcagggagatttaaatcaaaacaaccctgagattccacctcacacctgtcaagaatggctaagattaaaaactcaggtaatagcagacgctgacaaggatgtggagaaagaggaacactcctccactgttggtagaattgcaagctggtacaaccactctggaaatcagtttggtggttcctcagaaaattggacatagtgctacctaaggacctagctatacgactgctgggcatatacctagaagatgctccaacatgtaatagggacacatactccactatgttaatagcagccatatttataatagccagaagatggaaagaacccagatgtatttcaacagaggaattgttgtgatgataaaaagataaatatgtattaatatatgttttatgggggtatggtgaagtatgggggaggggtgcctcagcaggcccatgccaaggcatcccttccccctgagggaccagccacactatggtatagggtatagtatagaaaagagtttattcagggcatggggagaggagttaagagggtagtagaggcagagaaaggcagagaaagagaggtgggggagtagagaagtagaggccggccatgaccatctggagagggggggaagggaatggggagagagggggagcaagagggcaagaggcaagagaatagaggtaaaagtaagagagtaagagagaaataaaagagggcaagcaacccctcttattgttgaccaggcctacctcgctgttgccaggtaactgtggggaggagcataccccactattgccaggaaactgtggggtggagcttagacagaatcctaacaggaatggatacagaaaatgtggtacatttacacagtggagtactactcagctattaaaaacaatgaatttatgaaattcctaggcaaatggatggatctagaaaatatcattgtgagtgaggtaatccagtcacaaaggaacacacatggtatgcactcactaataagtggatattaacccaaaagctcagaatacccaagatacaattgacagaccacatgaagctcaagaaaaaggaagaccaaagcgtggatgcttcagtccttcttagaagggagaacaaaatacccatgggaggagttagagacaaagtgtggagcaaagactgaaggaaagaccatccagagactgccccacctggggatccatcccacatacagtcaccaaatccagacactattgtggatgtcaacaagtgcttgctgacagaagactgttatagctgtctcctgagaggttccaccagtgcctgacaaatacagaagtggatgcttgctgccaactattggactgagcacagaggccccaatggaggagttagagaaaggactgaaggagctgaaggggtttgcatccccataagaagaacaacagtatcaaccaaccagaccccccagatctcccagggactaagctaccaaccaaggagtacacatggaggaatccatggctccagctatatatgtagcagaggatggccttgtgggacctcaatgggaggagaggcccttggtcctgtgaaggcttgatgtcccagtgtgagggaatgctagggtggggatgcaggaatgggagggttggtgagcaggggaagggggatgggatagaggggtttccagaggagagacctggaaaggggatatcatttgaaatgtaaataaagaaattatccagtaaaagaaaagaaaaatgtcagtggaaatttaccagttgtcagggagcaattgagtggcaggaaccgggaagagcattaagtaaacaaaggaggacaccaaaagaggagaaagtgagatccagagcacagaagtgggatgacctctcaggaggaagtgccagttgccttcaagtgccagttgcctattcttttgctacaagagagaaggaagagaacatggttgaagaagtgggcatgttgtgatgggcttgtttggaatgcctattttgactgtgaagtaggagtgctatgattttactgcaagtgaggaagaaggtggtgggactggaggttggaggactatgctgccattcttatagctggctaccacaaaattagagggcagttagtcttttcataggtcacacatgcagaaacccatgagaatgaataatgctttccaaggcgaccgaactgattaggtgagaagggtttatagtggaattctttccacaaactaacttaatatctctctctctctctctctctctctccctccctccttccctccctctcttcttctcaccctccctcccttcttctcaccctccctccttttccatctgagatagggccttcatgtagtttgaattggtatgcagccacagatgaccttaaacttctgcctctgcctcctcaagtgctggtattgcaggtgtgtgccacaggtgtgtgccaccgcacccggtttaggtggtggtacggataaaacctatggcctcgtgcaagttataaaagtactctattaactgagctacatattcagttcttccataaactttcctgacaaattttaaatgattttatttttcgtatcttaaaacattaatacacctgatattattttagagtatacaacgttttgaatttgacttccagagagatagttactatgtaaaggccatttgctaaaatccaaaagtcctttttcattgaatggatatattgccttagccatatattgagtctttgcattgacttaattcttctagactgctttctgtttcactgatttaatttttaattttctattcatctcccaatgctttattattttgattataatggttttaaaaagtgaactgggcatgatggcacagacctataagtgttgcacgtgggaggctgaagcaggagtattatgacttcaatactacataatccagtccagccacacctacacagggaaagcgtgttacaaaacaaaccagaaaaaacaaagcatatcaacatctggtatctgttttcatatgaactttaaaatacttttatctatctataaaacatactcagcttaggttgtaattattatcttattatgattatatattcctttttggaagaaatatatttttatggtagggctttttatcaagaaatttgatgataatatagctatatatttttatttagttatattttattttgagatcatttttcatacacacagacccacacacatatatatgcatgtgtgtatatgtgtgtgtgtgtgtgtgtgtgtatgtatgagatactgtatccttttgttaaatcaagtcctaggtgtcttatagacctgctgagaatgtgttgcttttccattttcacttttaaaatgcagctggagaaagcttttgatttaatgtgttttcttactatacttataattttggatctatagtagagtcgtctcttgaattatctgagatgcttttatcttctttacaaaaatataccagttgcttcattttcttgcctcaaccaaacatcaagaagtgtgatgtcagatttctcttctttgttcttgattttactggaaagagccttcgcgtgttgccatttagtatgatattcgttatttgtttttagcatcttcaagcaacttttgttgtttttttaatttagagttttcatttggtttggctgctgaattttgtttaaaaatttttagaatatgttattataattccatatgttggtaaatttttaaatgttgagtcattcttttattactggaatgatttttattcctctgttgttctgttagaattcattttgaaatgtatttagaattgaatttataatttagaaatgtattcagaagtgaaacaatcctatagtcttattattcttcattatctttttaggctttgggtattgtatagtataatttgatatcatactagatttgccagatgcatttgaggtttttttaatctttatctgtgatcttaaatgaattaaataatatgggactaatctgttctttcaagaaactatagaactcatcactacaactatatggacctggaaaagatctttaagtacccttccaatcttgagtaaagttattagtctcttcattttttaaaaaattatttttggcaaaattaggtaatacttaaatgatttttcaacggtgtgtcataagtttatatgtagtattctctagtaaatatgttagtatttatccagtagtgtgttgcaattggcttgccaattcaatgcgatttcttcccattttgggcttagtggctggctacacactggtgcttaaaattcaccatggtgggaattttataccataaaacaagtgctacaaattatgaccaactcttgcatgtttaccatcccactatgtatagttcttagtatatctcctttccattgttagtattgcctgcctgcctgcctgcctgcctgcctgcctccctccctccttccttctcttccttcttttcttcatttttgagacaagatctcagatgtagtaatggctagcctgtaattttctgtgtaaagtaggctggtcttcaacacaaagatatctatctgcctctgggtttcttgttttctttttctttccattaatgagatttcaaagaaccacttttgattttagttgtgattatagttacctatggcaattttattccaaaagtgaatgtcctctccttacttagttttatttccttttctaaatgtttgaattaaatggttaatttatttctcattttatgataaaatgagtcaagcttcaagagtacccaatatatgtttggtactaagactgtgcccttgggctagactgtgtatgccctttcattgtttttgataggactaacaattttaattttgatttttttagagttatctaagagccagtttctctatttattagtggttaaggatttagatattcatatttttgtgatattatttctctttttcagaataaatattataaattccttactagtctaatgtaattttgttctttgtgattgtgaatgttcctgaatgtaagagaagaatgtaaaatttctgtaagctacaaaattctgtataggactattatattgatttttatagtattagtattagtatttaaactcttatttttgtgtgcatgtgtgcatggggacggaggctcaaggatgatgtaggtgtcctgctctttcactctgcgccttacccctttgagacagggtctctttctgaatttggaccttgccattgctcagcaaggctggatagccactgagctttgggcagccaactgtctctgaccccctccctagtgctagagctactagagctatattttgccaagcctatcttttatgtgggtgctaaggcttcaagctctagtccccttacttatgtggcaagtgctcttaactcttgagccatgtccccagccctcttattgttttgtaactcgatctgttttatactgtagccatatctttcacctcttgtcctttcttctgctctttgcaggcttggggtaaaactctgggtctcttgaatcctagtgtactatcacatacttgcggctctaggttttctcctatttgttaaatatttatttcctaataagtgaaactttcaatttagagttattgagttatattgtcaacaatctctgtttattgaggcaattcacactttcatgacaaaaatagaacaatacactggtggggctttctttcatattttcctttaccatgtcattgcagaacgatatcaagcccgtttggtcaactctctagtagaataatagataatgggtgtcagctaaagttgagaatagaaactaccacttggttagggtttatactgacaaatatgtgttatcccatggggctagtatcctgtcatttataaataagtcagctgaatattccagacttgagttactttaatacagaagaaaagcagtaaaataaatcgttttgatggaacattggaatgtcctcatgttcgactttactgttgcctttcctaatttctgccacctcttgatgttctttctgttcttccttgggatattcttttcttccgtccaatacttgctttgcaacttgttttctttcaatggcactgaaacttacaatgctctgcaaatgaatgaaataccattttacaaggggccttcatttttataaagggcaaggtaagtgttaccaccatggttctctttcctgcagtggactccagcatcttgagcttgtgtagttatggctggctttggtattgccgaatagcccaggttcaattgagacagagatttgcataacccagggcgatatggaactcacttttgggcaagtctgaccaaaattttgggatgacaggcgcaatccatcatgtcctaatcaaacttttcattttttaaagggtaatggaaagggtgcacagtaaaaatgaaagcttttttttttcactataaaatatagtcactattcatatgtgtgacctttgaaaaaacaatatcagattcttcttcaaataaatcaacagcaaggcacttctttatataactggtaaagttaaaatatggaacatgcattagattctggtattgagaaattatgtcaatcattatgtaataaaatatccttttcagatgtaaactaaagtgctggggagtaaaacaatttctttcattgagatactgagggagaaaggaaggagaacagatcagacagaaacattgacggcttttgaagcgaaaggatgagcacgttgggtttcatcatgctgtctagctttaaatagcgtagacaatttcataacaaaactacttaagatggcaataatgtttacactgcaaccagttaagaactgtcaaaatgcataaggaaagcattttaaagctttcattacccttttgttagtcatattccaaagagcttactttttgtctccaaagccatttttattaacgtcctatatgaccatcccagtaccagctcagtttttcccctatgcccattgtatcttcctttttgtccactgactggcactctcaattgaggagaatttggcaacagagaaatataggtacaagttaagccacattggctatctaaatctgatccaagggaaactgatagtcgcaagtgttttctttcctagactgcccatttggaatctagttctgaggacatgaaatgggaatttggcaaaaaaaaaatatatatcacagacatgtggtatcaccatttattcagatcaaagtaagtgagtaagttagtcacctagccaaataaaggcaacccagactttctgggtttaacttaataaatgggagaagactggtttatttgatgatttaaaaatatgtacacaatgtctaagtaataacttaaattttaaattatttagaaacatttcttcctgttcacccacatgactgtgtatgtgtgtgtctcccactgtgtgtatgtgtgtctccccctgctactccttgtgtgtgtatatatataagatagaggctcccagtgtgtgccaaagacctaccaaaagattatggaaggctaggacatggctcagtggctaaagtggtggctgtgcagctatgaaggttccgatgctcaggacccacagaacaggtgggaaattgtggtagccacttgcaatcccagaactgaggaggcaaagatagaggattcctggaataagatagctaagagaccttgtttcaataaacaacaacaacaacaaaaccaacccccccaccctcacacacaaacaaacaaaaagcatggagagcaattgaggaagacatccagtgtgaacttcacaactccacatgcactcacatgagcagcactcccctatgtgtgcctacagacatagaggaatgtacacacacatgtgaacatggacacacatacataacacagattttatttttatttttttggttattttatttatttacatttcaatgttatccccttccaggtttcccctttggaaattccctatcccatcccctctcctctgtgcctctatgagggtgttccccaacccacccatccactctcattctcccgccctggtattcccctacactggggcatcgaaccccctcaggcccaaggggctgctcctcccactgacatccaacaaggccattctctgtcgcatatgtggctggagccatggatccctccatgtgtactccttggttggtggtttagtccctgggagctttggcgggtctggcataacacagattttaaaaaagattatgagagtagtcattttaagtgatcatccaaaagctgaaatgtgagccaccctgtgttacagtaagacaagtaggatcatgaatcaaagcctgaatttcggcttggggcgaaagcagtgttgcctgttttcaatccagcacagcaggttggagtgggagagcaatggggaaggaaatccgtatttatttaactcctactgtgtacttggtactatgagatccctgtctctattagttcatttggttttcacaactacttctgagatagtgttatttctgttttacaggtcagaaagataagctcagagaaaagtgattagaatccagtcaagcctacttgacttccaatacagagctctttctacttgactgtgctgccttctggggtagaaaaaaaagtactaataaaacacagaaacagcacatgaaactcctcaaaagaaagaggggccagttttcccaaataatagttttagctacaaagagtgtgatcaaaaagcaggacgactttgatggttctaatggaacgtgggtgggctgaggatctagctctatcgctagagatacattgagccctcatgggttcaatgtccagcactgaatgaattcctagcacttgggagatagaggcaagagaatcaaaagtttaaggtaatccttagctatgtgtaccttgttaaaaagagagggagggagggagggagggagggagggagggagggaacatagataatctgtttcagagttggcagctcagcttacgttggaaccaacactaacaagcttgcttgattttttttttttattcctatggacctgttaatcattatccataaaatgcagacatcactctgatccatatacctcttgggttgctgtaaagatagatatagacatgaaatagcttacagagctctctttatgctaaaccatgatgactgtacagtactgttattctctccatggcctcactaggtagatatgggtgaatgaagttaacggtgtcactaagggcaaatttgtatgagaaagtggctctgtaaagttaggtttttttgtctagcaactattggggtggggaaaacaggcttacttgccttaccttaagagtagttgagagagttatgtaatataaaatttatgtaaaattacacacacacacacacacacacacacacacacatatatatatatatgaccacaaatacatacgtatatatgtacatatattttgtaacttacagaaacttttttctgttatattcacagaacattcacacacaagtatatgtgtgaatgtatatatgtatatgtatatgtatatgtatatgtatatgtatatgtatatgtatatgtatatgtatatgtatatataatggcttttcacagcaaggcaacactcattgagatctctgggtaagcctatttccttgtgactccagcagcacttgtataatgtcagagttgctgttattttaataactgactctctttcccaccccaatggcaggcaggcaggctaataggttgattccctgctatgctacatagaatggaaattgaatgagagaaagtagacatttgttagcaagtgttttaatgagcttcctgtatacagagattttactctgcttggagctcccagcacagaacagatggaaaactccctccagaagcactataaagaagacttaaatctgaatgcaattacagtgatatatttttataactaaatgaatatggtagttacctttctttcattgacacctatttcttttagattccagcgaatatcttttggccctcaaagcctggggattgtgttaattatggggtatcctagagcagaaaaacaagtttgggccagccaaattcttttctagctaaccatatgaaatgtgattggtgttttgtcaaaactcagtggttgactccctcctgccattgcccctttgctctgaatgatgatactaaataggtgatgatgtggttcctggtagggagagagtcaatccctctgggcactgaccttttcttctgaatactgatgggaagtgtgatagcgtggcaccaggaggatagtctgtcttccttttagagaggagctaaccctgtcctacagtgtggaggtcactgtgttctcgaatgggatcaagagctacagaaggaagagtaagggaaagggtaaaaatggtaaaaacaaatcatgcctggtccgggatgtcccacaaaacaaagcacatcacagttttaaaccaaagaaaagtatttcagatgataaaatgatacttgcttctttctgcagatgatgaaaaagttataggaggagtcacagttgccatagtcatagatgtcatggtgaaacaagacaaaaacaaaaggaaactgacattttatcacacattagaaagtgtataagatgattaaatgacactatctaataaacatatacaaaatcttctgagattagtatttctattatcctatatagagtagaggaaactgagcccacttgttgtaaaggaggcttgtctagcaatatattttgattttatgctcatttttttaaaaatccattttcaattttaatggaattttgttatggtgaagttaggctgtcatcccaggagttccagagaacttttcttcctttatattatccttaagaatttgtacttagaacatgttctgggtgatatgcgcgcgcgcgcgcgcgtgtgtgtgtgtgtgtgtgtgtgtgtgtgtgtgtgtgtgtgtgtgtagtgtaatatatgtggacagacaccaatatattaatatagatctgtttctctccttttcttaactcatccatcaagtgcactagtccttcttgccatatgacttagttgagacccatggaactatatcctcaagaaatacttgtcttttgtcacagagatgagactattctgagacttcctatcagttacgtgcgcaaacatgactcatcatgttcttttccgtagggctttttcctctggtgcctctctcctctcctcactcttgacctgacctgtcctgtccagctccgaggagtgcacttttctgctgtagctgattgcattcttctgctttgtttttttgttttgttttgttttgttttgttttgttttgttttgttttgttttgttttctagtggtcccctgccttttctgaacacggaccgaggattttctgttttgtcctcggaaatccactgcttctgaaagaagctcttctttctcagaataattcctttcctgtccttagatgttagacttggcatttctctggaccttccagtagagattgctggctctgaatgtgtgtagagaatatttgaatgctgtattcatcttcaagaaacgaaggtcttggggaagaatgcttatgacagacatgagtgccaagagggactaaattttccctgcatcccagtccaagaataaagaaggtataaactttccattacttgccctgtctttccctccttctgttattcagagaagcacaaccagggcagctttgaataaagctcatgtaatagtcagaaacttactttctgggactaccattgccacccacatggtacatgaacttaagcagagcatcatgtgggcacctctactatactgttgtactgaaatttcctgaccatacatatatcatgtgttaaactaacagcttcctgaaggcaggagtcatggctttgccatagtcatttagaaaactgctatgcctaatggttctttctgatccattctgtcaccaccctgcccctcaccatccaggttccatactatccaaaagtttgggctttctacaatgcaaatgcattatgccacttctctttcacaaagacttcagtgcttccccactgcatttaatgtaaaggtatgtaagacccaccatgatcaggactgtggttcccttcatagtctgttcttttagcatctgcatttcatgttttgttcaccaacttcacaaacacttatgttcatgtttacccttggccaggcacttgaggtacagtgatggacatagaccttgtctacgcaggagctaactggttttcttttcttctggctgactgtcctataaagcactgttgaagactcttcctccccaggaaagccatgacccatgttccatccatcttccttgcccttcttctacctagtttaggttcttccctttcctatgcccagagtacgccaatcatactttcacctctgcacttttgtgtattaattttttttctctccaccagacaaaactctaagagtaagatatcctgtaattgtattcattcttttcttgtgcagtacacccctacagcaacttcccatcatccttactcctccaagctccccctcccctgccttctcccctagatccattactcctacatttattttccttcaggaaagaacaggcctcccagggataccaactgtaaatacacaataagttacaataagactaggcacaaaccctcacatcaaggctggatgagacaactcagtaggaggaaaaggatcccaaataaaagcaaaagagccagagacacccccattcacattgtcaggagttcccccaaaacaccaagccaacaaccataacatatgtgcagaggacctagcacaattgcatgcaggctctgcaattaccatgtcagtctctgtgaataccccacccccaccccaacccccatgagtcgcatttattagttctctgggccttgctctcttagtgtctttgacccttctggctaccacaattctgcctccccatcttctgtgggggtccctgagctctagggggaggggcatgatggagacttccaacctagacactctgcctaatgtttggctgtgggtctctgtagcagttcccatcagtggctggaggtagcctcttttatgatgattgggctagacactgatctctgaatatcattatgaatgatttcctaattttttttttggccatgttcagttttaccctaggtttctgggctaccaatcctccagttcctgatcatccaggcattgtccagcatgggtttcctctaatggaatggccttgaattagaccagtcacttgtttggccactcttacaagttctgcactactattgcccagcacatcttgtaggcaggacagattgtaggtggaaggttttgtggctggattggtgtcccaccccaccacttggaagcctcgcctggctatagaagatggccagttcaagcttaggctccatatcccccattactaggagtcttcactagagtccccttcatagattccaggcagtttccacttcactcggtttctatgtcccccccccatatgccctccaattccagtcatctgtccctatactttatccctccatatctcttccaatttgatccttcctctttccatccatactatcccccagtccaccagcaaaatctattctgtttccctgtcccagggagatccatgcattcccctataagcctccttgttacctaagctctttgtgtctgtgggtcgcaatataattatcctttgctttataggcaatatccacttataaatgaatatgtaccatgtttgtgtttctgggttacctcactcgggatgattttttttttctagttgcatccatttgcctgcaaatttcatgtcattttttaaactgctgagtaatattccattgtgcaaatgtggagaaagaatttttttttaaccaactccacatctgatagaaggccaatatccaaaatatataaagaactcaagaaactagacataaaaggaaccccaaacaatctaatttaaaaatgtggtacacatctaaacagagaattctcaatggaggaatctcaaatggctgagaagcccttaaagaagtgttcaacgtccttagccatcagggaaatgcaaaccaaaactactttgagattccatcttaaacctgtcagagaagctaacataaataacacaagtgacatcttgttctggcgacgacgtagagcaagggaaacatttcctcattgctggtgggagtgcaaacttgtatagccactatacaagtgggatttgtatggtttacaaatgggattaatatggttgttctgtagaaaattgagaatctatctcaagacccacctctactacttttgggcatctagcaaatggatgctcccttctactgtaaagacgcttgcttaactatgttcatagtggcttcattcataattgccagaatctggaaacaatctagatgtccctctactgaaaactagataaataaaatggggtatataagcttcttttgttttatacccagcacatggcttggtactagcactgttaagaaaacgatgattaagtaaacagctccccctggtggctaggttttcgaagtatagtttttaatgccccagaagggtgaaccagttaccctggtaaggtaattttttctttcaacagtaagaaaggaagtattttaaaatatgtggtctcctaaaacctatgttgttatttagacatttctccgttttttcatatttcagcaaacaatattgagatgacaaaacagatcaaagaaaacaattttgagccatcttgtaaaaagaaaatataagcgctatttgtctcatgtagtgaaaaaaatgtaacacggcacagttctccttcagtatccatggaggattggctcagataccaaaattctcagatgctcaagtccctggcatagcaggatttagtatttgcatataatctaactatatccttgtatatactttaaatatttgcagattacttataatagcacagtgtagcggctatataaatagttgttgtactaaattgcttgggaataagaccaaatatctgtacatattcaatacggatgccaatttgttcagatatttcaattatgaagttgattaaatccacaggtacggaacttacagatgtgaaaagctatctgtataggctttgttcattatatcttgacttcagagtcaacacagtcattcttattcgttgactgattcaactgatacttgtagctttacctacagtatgtcaggcactaggctacatgttgtggattcagttgtgagcaaaacaatggccccaccattaaggagcttgcatccaagttaagaggcacaatttttttgtttgtttttgttttttgagacagggtttctctgtgtagccctggctgtcctgggctcactctgtagagcaggctggactcaaactcagaaatccacctgcctctgcctcccaagtgctgggattaaaggcgtgcaccaccactgcctggcaaacatttttaaaacatattcttattaagaattatgactggtataaaaataatgaaggatgcagaatgatatatgtgtggagggagaggcatagaacgagagacacagaggaagagattgagattatattggattcaactattttaccagacatttgtaattgttagagtttcagaaaactacagaaatgtctccctaggcatgcctaaaagcttataggaactctagagagtttccttttttgtttgtttacattttgacttgggaggaggcgtatattttgtcatgtatatgtattctcatgatcactactggaattaagtcattttgttatctccccttcaaaatcacatgtgctacctccttttaaaaattagatttaggtatttatttctactttatgtgtatgatgttttgcctgcattcatatctgtgcacagactgcatgtctggtgctcacagagaccagaagagactgttggaacccctagacccgacattacagatggttgtgaatcattggatgtgcatggtggaaactaaacctgcaagagcagccagtgctcttaaccactgagttgtttgttgaaccccatgtgctaccaatttgtagtatagtcacatctgtcttccttatagccactggtctgttcatcattataattttgtcatttctgtaatgttttgtaagtagaatcatatagtattcaaaataattatgattttctgtgtcacttataatgcctctgtgatccattcagcttgtatcaatagttttgttctatgattttatatggttgggagggcgttctgttatatgaatgttccattgtttgcttattcttgctctcagcagggaatatttcggttgtttccagctttggggctattatagtagttcatattagttgtgtgtgcacgcttgcataaatgttcttatttgtagagtaaatgcatagaggtacaagttagagacttgtatctccttgtgggtttgtaaccagttactgtgtagtagagaagtagtgagtgaaagaacaccagatgagcagtccaaacacagctccagagtggcgtttaatacgatgttggatgattctgtcctgtttccagaactcacaatttagcaatacagtgataaggttgaaatctatgaggtttttcagtctttttcaaatctaatctgttcatagttctgatgggatatgtatgtgtgtatgtatgtatgtatgtatgtatgtatatgtatgtatgtattgttttgttttgttttttgggtgttttgttttgggtttttgtttgtttgtttgtttgttttgttttgtttttttgagacagggtttctctgtgtacccctggctgtcctggaactcactctgtagaccaggctggcctcgaactcagaaatctgcctgcctctgcctcccaagtgctgggattaaaggcgtgcgccaccacttcctggctgcatgtatgtattcttacttattcactttacatcatgctcactgcctccatcccgatcacccctgcccatgacccttcccccattccccccacccttctcttctgagcccaggggctcatacttgttatcccacagaccctggcacatcaagtcgctgtgagactaggtgcatcctttcccattgaggccagacatggcagcctggatagaagaacatagcccatggataggcaacagcttttgggacagtcccccgtttcttccagtttgggacccacatgaagaccaagctacacatttgctgcatatgtgtagggagtcctaggtctagcccgtgtatgatctttggttggtgattcagtctgagagccccaagggtccaggttagctgactctgttggtcttcctgtggagttcttatcccctttggggccctcaatcctttctcttgttcttctataagagtccccaagctccttccactgtttggctgtgggtgtctacatctgtctgagacagctgcagggtggagcctctcagaagacagccatgcttctgtctgcaagcagaacagagtatcattaatagtgtcagagattgatgtttgcacataagatgggtctcaattcgggccagttatcagttggccattccctcagtctctactccattccccattcctgcatttcttgtagacgggataattttgtgtttgaaagttttgtgggtgggtttttgttcctatcgctctactggtgttcctgcctggcaacagaaggtggcctttgaggggtttttatttttaaagtaggtctctacctcatttcacaaagaaaatttaattgtgtacatacataaaacactagatgcaaagtctaggtcatacctttcctgctcttttctttcatgtcctgagcaattgccttgtataaaaagggcatattgatggaaacagatgcagcagcccacagccaaacattaggtggagcttgagaaattctgccaaagaaggggaggaaagattgtcaaagccaaaggggtcaaggacaccataagaacatggcctacagaatcaactaatctgggctcacacagactgaattgccaacaagggagcctgcatggaacagaccaaggcactctgcacatgtgtaacagttgtatagcttggtcttcttgtggaactcctcacagtgggaggaggggctggctctgaccctctatttatttatttatttatttatttatttatttatttatttacatattttcctcaattacatttacaatgctatcccaaaagtcccccataccctcccccccacttccctacccacttcttcccatttttttggccctggcgttcccctgtactggggcatatacagtttgcgtgtccaatgggcctctctttccagtgatggcagactaggccatcttttgatacatatgcagctagagtcaagagctccggggtactggttagttcataatgttgttccacctatagggttgcagatccctttagctccttgggtactttctcttggctctgaccctcttaactgcctttgtgacactttccttctactagtttgcctcacattgcgttaataggagaggaggtgcctagtcttcctgtaacttgatatgccatggctgtttgatatccatgagagacctgcccttttctgaagagacacagcggaggaatggatgggcaggggagagggtgagtgtgggaagattgggaggaagagagaagggaggagaagctggggtaggcttgtaaaacaaataagattattaaaggggtcacattgagggagacattagctaacttgaagactacaaaggtttcatggtctgattccgggaaagaaagttctccaaacccagcaccgaaattaccatattcaattgttctagaaaagccattcctaaggcaggtatgtggagcaaactggcccttccctatattgtcaaagatttttggtaggtaggcaagggtaaaataagcatgtgtacatcaattacattttccacatgtgggatgtattgtattttcctgtcaaataagaaaaatacacagtgcttacagcaattaattctagaaaatgtggttatcctgagagcaatcacttcacttaacacgcgcgcgcacgcgcgcgcgcacacacacacacacacacacacacacacacacacacacacacagtggttaaaatcagacatgtacagctgcctagtttaaaatcctgattttgactctagctgtatgaccttgtacagatgtctacaacctctgtgcttcttaatttctttttcagaaagaataatgatggtgccttccgcagagggctggtaggttaaccaaagcagctaaaatccacgaggtcattagaaaagtgacaagcagcacaaagtgttaagtattgtgtatctgtcccataagctgacaggaaatgtgtctcttagtcaatatctgtctggtgctcaactcattagcattcttacaccactggagatggcttagctcccattccccacttgcttggcttcaacaactatttcacatccatatcctaatgtctcatgtcacttccttgccaacaaacaaacaaacaaacaaaaaacaccaaaaaacaaagcaaacaaaaaaaccaccaaggacctatggctgttagaattgtataactttgcccaagtaacctttgcctctctcctagggtgtagttcccccaagggcggggagctaaagatcatattaataacttcatatatttcttagtttttaaggtggccaccttttcccaaatcaaaaggaaaacaccaggtatattggagaaagtcctgcttccttagttgtttttatgtaaatcttcactactgtctttgaaatgttgtggtgttttgaaaacaacataaaagatctctcttcttccctgtattcctttgaacctagcagctgtctgcggggaggtgctggcgctggccatgggggttgtgtatgtatgtccttaaagtgtgatctggcttaacaccttagctttgatgctaccacagtcagtactatgtctgcttcgtacatattgcattttcttgagggcatcattgtaaaaagcaataatgttttgcagctttgttcgatggcagagctgttcataacagcttcttggtaattcatcagctgcccaatttacctctccctttcccttctcagctcccttgcacagaaagcaactgaatgtgaatgacttccaacttaggctcttttgtctgatgttatggagtgtgagacgaaggagcaaaacagtaaccgacaaacaggaaatgggagtttgctgtgtcctctctcacttctttgggtcctgtgcctattttctctccctacatgctttgggtgttactataacaccaagatcctgattcaaaatggcagcacatatttccatagcatatctgcaaacttcatgggtttcttttgtgtatataagcatgtatatgttacatgtacatgtatgtacacatgtcggggtggagcaagaggctggtattggctgtctccatctactcctccttgccttattttttttaatggggtctctcacagactctggaacttatcagttcagcaggactagcaggccagtgagatccaggcagcttcatggttcttgttttttctcaacactagccctgagagtgcccaccaccatgcatggctttttatgcatgttctagggatccaaactggggtcctcattcttgcatggcaggcacattacccacaaaatcgtttccccagttccgtttctttctttaataaaacatagttttgctttattcctcatggtgcccttaatctcagaaacctcctgcctcagccttttgagagctccaagtataggtgcaagccactttgcccaatttgaaatctttttaaaacactgcctctgtgtgtgtggtgtgtgtgtgtgtgtgtgtgtgtgtgtgtgtgtgtgtgtgtgtgtgtgtgtacaggaacacatgcctgtatgcgtatgtgcctgtggaggctagcagaaaacatctgaatgacctttctagtttctctacaccttctgttttggagaccatggtcttattgctgaacctggaacttgctcttttggctagactagttgttggccagtgagctccagagacctctgtctgtcctttccctgctgtattgggatcacgggtgcttgtggatacacctgactttttgcatgtatgttagggatctgagctctggtcctcatgcttatgcaaaagcagtttactcaccagactagactgtctcccgatccctgcattgctgcttccaaacttacttcactctgttgcccgggcaatctgatctgcttcaccaggcacattctctcctgttcctccctatacctttactttctaaagaaagtaaagtaagtatctaagtattttctaaagaaagtatcatatcattctctgcctgggcttctctccctttaaccccacttctttttttttttccattttttattaggtatttaactcatttacatttccaatgctataccaaaagtcccccatatccacccacccccactcccctgcccacccactccccctttttggccctggtgctcccctgtactggggcatataaagtttgcaagtccaatgggcctctctttctagtgatggccaactaggccatcttttgatacatatgcagctagagtcaagagctccggggtactggttagttcataatgttgttccacctatagggttgcagatccctttagctccttggctactttctctagctcctccattgggagccctatgatccatccattagctgactgtgagcatccacttctgtttaaccccactttttcatgcccaactgttgccagatcagctacagaagacattttatgatcttctggcaaagctagatgcttcctggtgtgttctcatagggctttgatgtatttcattgtataacttgagcgttctttaaattctaattagttgtattcacacttcattctttctactaaacattaagtgccttgaaggcagaagctgtgtttttcatcattatattccactccttgtaaattgcaggcactcactttgcagaaacaaaaagttctccatgtgatctttaatgctgggattttagaaatgtctaggtggaaggtgatgatctatttgagaagacagtttcttagttggcattgacttgtcaagtggaagatactgagatggaagagccagaaagcagtctgggtatctgggataatttatcagtaaataggtattgttccacctgaaccagaattcttagtgccttctgaactcctgcccaactctctataggatgggtgatgtgaggatgaggaggaaggtgtgggtaaggacatttctcacagaggcagagagaaggcagacgcactttaaacacaggaataaaacaaagacttggagaatgagatttccccttaaaattgtccaatgcatttgcaatggcttattgatcattagttgagaggttttagaaacatcaaggagctaagcctctgggcatgcctgggagggattatctagattgagtttattaaggcgggaagatccactctaactgtgggagggatctatgtggagtcttacagtgaagaaaaaaggagagcgcccgcccgctgagtaccagcgcttcccattcttggtttctgattgcctatggaatgtagctagctgtctccaggtctatctgctgtcatcctcccacagtaatgtacactggaactttgagccaaagcaagctcttccttcctgaccttgcttttgtcgcttatgtggcagtagcaaaagaaaagtagttaatacaacatctctgaaaggagctaagggtctaggccacttacattccaatagagagtttaagcacttggccaaaataactatttacttcaaaaagatctttgtaacctatgacatttgtgaacaccccatgtatttgtttccttgcagtgactatcagtaaaaatcctctcaacaaaggagctgttgaaaggtaaacagttgacaagagtagatcttactttacagttagtcttggagctgagacagtctcagcagtagagtgtttgcttagcactatgaggtcttaggtttaatcctcaccactcaaaaaggaggcgtggtatatggctggaaaacaatatgcaagtcaagttcttgctgcaattgaaaagaaaattaaacaacatggaaccaataagacctggggcctggccagggccgcctgggtacctagaaaatagtgaggctaagatactttgtcttcagtatcatggaatgctccccaaaagctttctgacgtaggtaagttaacacaggtttgcagaattacctcagtggtatcttcaaggaggataaatgtttaaacacaaaatttagtgtaaatttatataaaatcatttagccaagcccactaactcgaaacaaagtccaaagaaagaactggaggcttccacacaccgactaatccgccaaagacatttaatgagacaacctgagtgacgttaaatgaagggttaaaatgtaactgaagtaaccttactgtatattcaaataaaactgcaaacaaaacactggcctttcaaatgccgtccaagcaatttgagttgttttattcacatcatgaagacagatttttccctggagtttttcctgttcagaaatcatttcaagaccttgctcttctgggctgcttcttgacatggaaacattttaatgtcattgctttagccttgatttggagttttgcctcttcagccaactttctgctctactagttgtgcttggtgtgtgtgtgtgttattgctgttgttttaatgaaatggctcccaatctgtccccatcctaggttccacacttcaacctaaattttctcaacaaaatatatttacgatggcataactacatacatacatacacacatatatgtatgtatgtatgtatgtatgtatgtatgtatgtatattactgggccaattctattagcaaatgttctgtaagtaatcattttgcacaaggcattgtgccaggcacagtggaaggaacaacgcagtggaaaaatctcttctcaaggagcttggtgtttaattgaagatttttgagcaaagagtatattagttatgtttcttgttactgtgacaaaatacctggcagaagcaatttaagtccaggaaggttgattgtggttggtggttggagagaagaaagggcagcaggaatgggacagctgctcacactatgtctgcagtcaagaagcagctcactgtgtcctttaattcaatctaagactccagaccatggcagggggctgcccaccctcatgtcatgttgacaatgaaggctatcatgagatgattcctcatgtttgacttgtcctcttcacttcctaacaagttccttaatcctccttaagtttgttattagcccatccgatccaatgctacttcttcattaaaaaaaaaagtcaactgaggacttccattatcttgctttcccttacccctcaagaacatttgatggagaggtggttcagtggttagtctagcgtgttgctctttcagaagactggagtttagtcttgagcatttatggtaggcagctcataaccacctgggaccagttccagaggttcttacactcacctctggcctctgtgtgtgtcccgccagtgtgcatggacagacacagtcacttatgcacacagaaagttcttgacatggactctcattcaatccttgtttgattttaaatttcttccttctttgaaatcgccaactccttcctttaatgtttaatagaaggctcatctcattctggtatgtttctcacttgctcactgagagtgccctgttttctttcaatttctgtgtttatagttggcgtgactcagttggtacttatgctaccttgatttgtttctctctctctctctctctctctctctctctctctctctctcacacacacacacacacacacacacaccatcctttctcatttagattactaagtatttgaagacaaggccttgcgtaatgcatcttacaaaaagatgcttaataaatgtatgatgaagaaggcaaagaaagagttttgggcctgcatggaaaagacttattttgagaacagagaattcagttaaagaggccttttgaaaaatgtgtaaagggtcataaaggaattaatgtattggcaacttggctcagatcctcattttattactagaggaactttagggagatccaaatgacaatagagaagggctttgggactattgagaatttacatggactattagggacaagtttgctgcgagactgtttttagtgatctcagatgctatataaagtcttaccaacatgactccccgaggtagatgagagagaagactatatggcctcaaccctacacgatgaagtacaggcaactaaggaactctgagattgggagaagtagtctttcccagggaagtacacatcagttgccaaattatcagccctgaaaatatacatacaaataacatactgattgagcatattgtatttaggaacacacacacacacacacacacacacacacacacacacacacaagcatataacaacaattaatgaaaaaagaggccatggatttgaaggcaagtagatgtatgagagaggtaggagggaagcaaagggaaggaggaaattatgtaattgtattaaaatatcaaaaataaaagaaagaaaaaagctttttttaaaaaaaatagttactaaatccaagtaactgtaataacattgttgataaaagtgagtaaatcagaagtggatagtagatatgaaggaaaaatggtttcattattagatatcatatacagaatttatactaacacagagaaccatttgcacatattaaaagagcagtaggagttgccgtttttaggattatcatttcgttcactccaacagatactgacataatgtctaggatgcatcgttcactattctggagatagacaaagcacaatctctgcctccagacttcccgtttaagtggaaaagactctaatacaattgcagtggtatgaaatagcaagcagtattactgaattatatggaaagtgttatgtaaatgtaagtaggcgagtgactgattgtgtagttaccaatgaggaaaaggtaaagaagagatgattgcagagtttgccttggaagataaatagaagtttgctcaatcactgaggaccctgccctgccaaataagaggataatctcaggaaaaagcatcgcacaggcaaaatcatggcattttagggaaacaataagacgtctaaaatgattaaggaaaaaaggatgtcagaataaagatgggcagtgcaaaaggcatggtgattatcagaaactaaacacagacgttgttacagtggacccgagaggaaggatgtgttaaaagtgcgctgtctgagtggatccctctggaactagtcttgtctctctcactcctaactgtgtaggcttcaacgagtcacttaatctctccgggctcatgttttcttatctgctgagtggaaacaatgataccttccataagagattgtttgggggattgaaaggtgataaatataatagattacactggtgcctggcataccacaagtgttctgcaaaggttagtccaaggactaaatgacaagtaacaaggcacggggctagtctctgctataccagtagctgcctgaaaaagaaatctaatggattatgtctatgtttccagatctctaagcaatgaccctgggagaactaggttgctcttttattctcagaggaatgagagttccttgagatgatatgatatctactttgggaaagtagagctaacttagggaaaagcagaggagtctgagaaaaaacaaccatggagaagggccaggggaactgttcatttagaataaataaaagctgtcattatcgcatccctcctggaaaggagtcataaagaaaagtaatgttgccattaagtggcagacattttgcttagataaattttataattggggctgtgtagatggttcagtggttaagagcactgtgtgtgtgcacttgcagagaactcttttcagttaccagatgctacatggtgactcatctagctccttgagttttgatgctctcaagaaaaccattgtctatttatcggctttctagagttctgctcaagtggtccttgaatagactcttgggatgattgttcttctctgggtcactgctccatgtgttgctgaaatggaggtgaacctcatttgacagttcctgctgacggtccttctcagctaaccttgggattcatttaactgacctcagtttgaaatatgccttttggtacttaattaagcattatgacaagttactcaaattctcaaagcctcagcttctgcatttgtgaagtgagaaaaattgcttctgtattaaaaagttacaatgatataatgatattttaatacattaactactgctactgtagtgcttggcatgtcgaggtcttcaaagatgttagctcctcatctcttctttcctccttatatcttgagaatcccatgatctcctgaattcattttagcatgtcctggggactttgtaccaaccaatattaccagttgaggaaaggaggtgaagaagtctgtccatggaaagacaatgaatagtggctttttattcaactcatcctgactttgtggcagagatatgctgatgtagagacagtatctcaaaataggaaaagtatttagatattggatagaattttttctctaagccaagaaatatgagtaaaacattatgacaactatgtgaaaaatatctacacattcatgtttaatgtaaaatctctctgcacattcacatatttaaaatcagaaaactgaaaaccttttaagacagaaatatgttattgcactgtaatcttaatatcattgtgcctttggaagaggctcttctttccttgagatacatgaatcttcttgccttctttttgaaagaaccacaggaggacaggttgatggagtacagggatttgcacagtgggaaaaacatgtccccatctcatctgtccttctgcccagccttccattaaccatcatgacctaccagaggcctggagagcttcctatctgtggtgcttcaatgcctttgcatcattaatatcatcatctctactcttcttctaggagtggatcttatcgagggaggtatggaagaagtgcatgtttagctgtcagtccgatccttttagagccagcaggggacaaaagcaataatcattgtgtaacactttggactttcttggcaggtgaatactgctatgcatgaggcaaaacttatggaagaatgtgacgagttggtagagatcatccagcagaggaaacaaatgattgctgtcaaaatcaaagagacaaaggtaaaccacagtgcttcagtgaagccaaggtgcagtgacttttcacaaaagtcagagttcattcctgatgattgcagtttggagttgaaaaataaaatcaaaaggaaataaggtcatagggagagataccaagaagtaatgtttggactttcctaagagtctgaaaaaaaatggtggcagctctgggtgatgcaaacattctatacctcgacctggatgctggttatgtacgtgtgtgtgtgtgtgtgtgtgtgtgtgtgtgtgtgtgtgtgtgtgatcatttacttagtatgtggatgatttactttagcatgctttaggttttttgtgtccattggtgttttgcctggatgtatgtctgtgcaccatgtgcatacagtgttcttggaaaccagaagaggctgttggatcccttgaggctggagttatagtcagttgtgagctggtatgtgggtgttcttgaaaagaaatcgttactcttaacaactgaactctgtctctagcttcttctctcctatattttaaggtaatgaaaacaaagaaatgatggtagaaacatgaatctggttttcagaagaaatatgaccaacttacaaaaagtgttgtgaaactattatgattctgtaaaaggatgcattctgatatagtagaggtatgcatggtagatcagaacatgatgacattgaagccaggaaagcttggagacctacagcgatttctggtatgagttatggaagatgtaagcctgactaatgatagaacatggaaaggaaaagcataataactgatagagagaaaatgatcttatccaacttattagctacaatagatgaaatagagccaagtcaaagaactgcagatttctctctctctctctctctctctctctctctctctctctctctctctctctctctctctctctttctctctctctctctctctctcatttgtttgcttgtttgtttgtttgttttttgaatcagggtttctctgtgtaatagccctggctgtcctggaactcgatttgtagaccaggctggactcaaactcacagagacctgcctctgcctctagagtgctgagattaaaggcgtgcattatcacccagctgaatggcagatttctaagcagggagctaaagagtaagagtcaaaggcatcaggtgaggccatgcagcttctagatgtgtctaggctgctggtaaatgataatgattataaggccatggtaaatgtgtaaagttatagggctcacttaatgatcagtactttgtgtcatactggatggttggaagtaacaatgagctgaagtttccaaaattacatcgtggtaggtatataggcacttagagaaatatatacatgtaaatatagctactcataaataaaaatgaggtacttttgttaaatatatgtaaaaatacattgccaataaaatgtaaacaataatgatctccaggtggtagaattgctttttacatttgtgtttaaatttttctataattaacatgcattgcttttacaatcaaaacaatgttattgaatctgtagataacagggtagatggctgaatgcaatgtaagtgaacaggttatactttggacaagagacttagcaggcagggtgagaaggtgaacagttgtttcggggctcatgggatattaattaccgttatttttagaatcactacggcagatctccttcatgttgttttattgtttttaattaagcgcagtatgttttatgtcatcttttctcctaccaattctcttaaggttatgaaactgagaaagttggcacagcaggttgctaattgccgccagtgtcttgagcggtcaacagtcctcatcaaccaagctgagcatatcctaaaggaaaatgaccaagcacggtttctgcagtctgcaaaaaacattgccgagaggtatgtgtgctcctgatgttcttttgaaatgcctgctcttgtgcaaaggggctggcataaagtcacttaattctcttcaggcattgtgtagtagctgccacctgaagatttttaccagctaggtaattattgagccttagtgacaaatcaccctgcagatttctggacccctttctctgtctttgctgcctgccagctcttttaatgcatagccaaacatagggctacctcctgccgttagcttcctgctaggtcttgagcaatctgtgatagttgtggtgtgtgggaagacaaactccgggctacactgataggatgtgcctttcctaagcctatgcatggttttacttttttgaaatcaatttcgcccccactatcttgcctccaattcctctcctatcccccatgctaattttttctccatacttcacgcgaccgacctccctccctctctctctctctttctctctctctctctctctctctttctttctttctttctaccaaacccattgagttcatttattgttgtctgtatgtgtgtggatgtatgtacagtttttgttgtttgcctttagctttttcttgcataaattccttagagaagtaattctttggcttttgcttaatctctttgtcctttgaaagttaatgtcatgaaccttgtatcagagaactcatgaatcattaataatcaacctattggcccagagtctatgctctaaagtaaatcattacccaattagtcaccaattattcaaggggctacagtaacccattagtccagatatggtcttctttacatattcccctctcattcattgaagacttgtttttaagctcatgatcttcccattggtactgccatcattttgagtgagttcacttggacagctaacctatgtaatatgcttacctagccattcaccttctctgacatcttctccagagacttccaactcaggtcactcacttcctaggcaatcatcatcattgtcatcgtcatcatcatcatcatcacttaaaatcacagccataagttaaagcatcacgttttctaaacacagcctctttttaaattcaaatacatcttttctttattaagttgtattatttcctatttttactagtgacctatttctactttgttctaagtttatttgggctttatgacttattactccagctattatattttcctaatcccctttcccattgcccttttactaatcaccctgacaaaatcctatacctgagtcagcccaaccatctctactctttttcatgcctatatttcactttcaaaactatggtaaagaaaatttgcacaaccaaggatgaatcacagtacttagtgcaaagtactgactagagtaagttggttgggttggttctataactaagacattgtgaatagtgctgtaataaacattaatgtataagaatgtctatgatatggtgacttggagtgttttagttgggtcataccaatttttacttcttgagtaacttccatgttgatttccatagtaatttactagtttacattcccactatcagtatataagggttttctcttatccacatcctggccagaatttattatttctttttaagtggatactattctgacttggataagatggaatcacagtgtagtttttatttgtactttttgatcgctagtgaagttgaacatttttcatgattattgctgcttgcatttcatctttctatttttgggattaatggtttgtatacatgtatgtattatgaaggtgaacatgtgttttcctactcataattgtatgtgtgtgcatgtggcaagaaggggacaaccttaggtgtcattcctgagtctccatccacttggtggttttgagacatggtctctcactggcctggaattcaccacgtaggttagggtatctgggtactgtgcctcagggatctaccagtctgcctttccagcactcgaatattaagtgtgtgctaccatacctagatggctttttttaaaatttgggctctgaagatattctagatattaaccctctgacagataaaaagtgagcaaagggttttatcctagtctgtctatctcttcactcatttaactatttcctttgctatacaagttccttttaattccatgagatcccatgtatccactgttcacattatttcctgaatgactggtcaagttgtactacagagccatattaattaaaataactaacatgattcctgactaaaaaaccagaaacataaattaatgaaattagaataaaaaattcaggtattaacctgtacaactgcagctacccgatgtttaacaaagacaccagaaatacatattggggcgaaaaagcagtcttttcaacaaatggtgagttgaaaactgggtgtccactgtagaagaatgaaactagacccacacctctcaccttgcttaaatcttatcttcaagacctgtgacagtgaaattgttagaggaaaaggcaggaaaaacatttccatacacgagcaaggatacgatattctgtgtctttgagacaggctctcagttttagccccttggcatggaacttactctctaccccaaactgtcatcaaatactggacaataatcctgcctcagccccctaagtgctacgattatgggtacgaactgccacccttggctttcttagttttctttctgtcttgctaataaaattaaacttttagcacttgcatttttatttccaagagtttcctttttaaaatcttctattgattctttgagaatttcatacagtatattttgatcatattcaccctctctccaaacttttctcatagtcacctccacctccttagctacccagctttgtgtttttttctttttgttaactgatcatgtacagtttgtgctacccagatagtcttgaatatgaggcctgccatgaaatggagttgatcgaccaggggttacactgttaaagaaacctgacaagccctttctcagcagctatcaaatgcaaatagctcctcagctggggctgggacttcatgcccatcttcccttttccattctgagatttttgtctgtactgagcttacacatgccttatgcatgatgttagaactgctctgacttcatttgtgcaggaggccctgttgtgcccagaaaacagtttgtttgaagtgcttcagtacttcagactcttaaaatttgtatgcttacatttccttgaagatccatgagccttgaggagaggaatatgatataggcatcccatttagggatgtgagtctctgtgttgattgcttgctgtctactgctagaaaacatcatatggaaacttactgtggtagcatatctgtctgtttgtctgtctaccaggtcagtgagatctcatagatccttcaggacattacagactcttgctgttacttttggttaccctccaaaacttggtggtaagaatttattgctgaagacaccacatacttgagtcgaggtacaataaggattgggctgtcaggatgtacctcctggtgcaatagtggcacaagttctgtggctataaccaatcactgtggtttgcatcaaaggcctgcttccggagatgggagccataactggaatcattaatgagaccaagaactggggtcaacaacctgtggttagttaagtcataatcccttggagagaatttactattgctgtgctaaataagatagtattataatgactcccagtgagttattgctatgcccatagaccaatgcatctctcagccctcatcagagcagaaacttcttgatctttgtttctttcttaacattctaatcttattttgtgcacataaactatttgcttgtttctttagaaatcctgttttctccaagtttattcctttgttaataggcatttagatccataaatatgcctcctttaaaaggaatttaggaagctgggcatggtggtgtacgcctttaatcccagcacttgggaggcagaggcaggtcgatttctgagtttgaggccagcctagtctacaaagtgagttccaggacagccagggctacaaagagaaaccctgtcttgaaaaacaaacaaacaaacaaacaaacaaacaaacaaaaaaagcatttaggagacaagttgttaataaatgaaaaataatttattgccagtttagctgaaccaaggaaagatttttagattctttgagtcttttctttctttttgttatttatttatgtatttatttatttttggtttttcgagacggggtttctctgtgtagccctggctgtcctggaactcaccatgtagaccagactggccttgaactcagaaatctgtcttcctctacctcccaagtgctgggattaaaggcatacaccaccactgcccagctttctttcagtcttttctattcaagtgtaataatgctatagcaaagatgaaacagaagtcaggaaatatacatagattaaggtatcagaactgtgtgaaatatttttctaggaggcaagttcctcctctgattgggatcctagtcccagcatgggattcctggggaaatgatacgtctttgcaagtccttatttcagtcctctgatagctgaagtgagaggcccaagtatctgtggaatagctcctctcctgccaggtccattacattacttgctgtacttccatgaatacctgctaaacttttgacttccttttacattttagcactgaaaggtgctgagaagctgtgagggggtgggggcaatttgttgcttggtgaacttcactgtagaattatcaaacggagtgccagttttttattgtgggctctcaactgtcagtactgtaggtgtttctttttgagtctctttttctaggaaggaatcctgcagtctcctgcttcgagtggggggtgtatatgcagggggcgggggaggagggacaagcatataagcacagctgtcagcattctaggagccaagcagggaagaagtctgagtctttccagatttttttttttttaaataagatgtcaagattctgccgaagtaaacctcacatctcctgccaggctgaggaaaaggcaggccgtttgagtggatctggggctctagctattcttcatgcaaactttcagctttgtgtcactaaatcagcttgatgttgttggcttctccatccagctttgtctgctctgttgttggttactgcacatctgtccttttctagcttccaaacatttgtggatagtctcttcattgttggcatctatttgtttctttctctttgtctttgtgggttaaggtcatttttattctttttctttccggtgggattttaggaaagcaaagatgaaatatatatttaaaccactatatttaactgtcctgagcctgcagcctctgaaatgttgtctcccatcttcacgttattgaatgtgttttttcaaggccaccagaagaagacctcattgctaaatataaaagatactcttttgtttcatctttccctttaatcttattgtatctcagtagcatgtgtccccattgaccacttttacttgcagtcttcctgttttgtgtcataaaaattcccattacctgtgtcctttactttgatttccttttccttttttctcactctctttctccctccctctcccatctctcttcccttctccccctacccaacttctctctctgccattgagagcaggtcttccatcatctatttccttaataatactgttcttccttattcagtattagggaagtctcctctctccccacacagctttccttacaaacccattagtgtttaaggcttcagttaccatttaattacaatcaactgctctgctgatgattccaaatctctatgtaaatcttttcatggattcaaatgcatggaatagatggatatctatgtgacaccacttgaaaatcccaatagaaacactttttctctgctctctcacagaatctgaaattcatcgccatccttattcattgtattgtattaaggtaccatcacttaagataaaatgaaattttaggtgggaaagaatagtatttaggaatatagaattgtaaaacacacacacacttatacaaatacacatacagacttcacaaatggaagataatgttgaatactctcttatagtttacattcaaaataatatatcacagaatttgtttttctgttcaaaactgaagcttttaattctcaaaaacatctaagcaaatgaagattcttggggccagggactgagttctgaccctcattacaaactgcctctaaactacacccccgttcagtttattcacttgcagagatgaggactcttgcatcctaggctggactggaactgtgtggctgaggatgccctccgtatcctgattttcttttttttttttcttttctttttttaaaaaatattttttattaggtattttcctcatttacatttccaatgctatcccaaaagtcccccataccctcccccccccacttccctacccacccattcccatttttttagtcctggcgttcccctgtactggggcatatacagtttgcttgtccaatgggcctctctttgcagtgatggccgactaggccatcttttgatacatatgcagctagagtcaagagctccggggtactggttagttcataatgttgttccacctatagggttgcagatccctttacttccttgggtactttctctagctcctccattgggagccctgtgatcaaacacatgaaactcaagaagaatgaagactgaagtgtggacactatgcccctccttagaattgggaacaaaacacccatggaaggagttacagagacaaagtttggagctgagacgaaaggatggaccatctagagaattttttatatcgttgaaaaactttatttttggtggcatatggaatttctcatacacacacacacacacacacacacacacacacacacacacacacacacacttgtttcagtctccagtgctagggaattagcttacatatggtatgctgagtgtatttatagttactacatgcatgtcacttacttgctttgcaagaattttatgaagggtccaatgagatcatgagatcatttggcagttaagagcacttgctgtgtaatcataaagattagagttcatatcccaccacccatacaagctaaatgctctacccctgcctgtaactccaactctgaggtgtatggatccagaaggattttttagattgtctggcttccagtaaacatttaaaaaaaaaaaagctccaggttttggtgacctagaatatcccttgtagtccatgctagcctcaaatttgtggaaatccagctgcttgagttctggaatgacaggtatgcaacacatctggcttgtttttgtgttgctgctgttgtcatttaatgtttacattatttatttattatttatctatgcgtctctcagtgggcatgtgtaaggtcagaaaaccacttctgagagccgatggtgtgctttcactttgtggggtctggagatcacactcaggcagggaggcaacaaacaccgtgactcattgcccatctcaaggcaccgttgtttccatgatttttgaatgaactttattcgtgtgtgtgtgtgtgtgtgtgtgtgtgtgtgtgtgtgtgtgtacagtaaatcagtggattcaacccggggatttgtgactgcttaataagtcctctactcctttttcacttttgattacactcttgtgccctgtcacagacagtgggattctggaaggagacaaggcactaggatgccaccagtagcaacctgagttcttttcagagacctgcactcaaatgaagccaaggttttcgactgcaagcagaatttcagatggagtcagtttgaagcagagttggagtttatcaggaagagtgtttgacacagatttgaccttgggggtgttaatagaaaagtgctcaggaaaaggatgaaatacacctgtgagcgtcagcctgagcttctcatgcgagaaacccccttgaatgccttagtggtagctcaatataagattttggaggtttttgaaattatatacatcaaggtgtttcaaagggaacaccactcctctgtctcttttcttcgttttaataaggagaagaatggaatggctctgtaggagccttgggtaagagtgcaacctgatcaggtaaaaccaggggtccgcaggttgtacaaggctgttaagatgtgccttttactagaaatgtggtggtgattgtgagattccttaacagttgacagcttcgagaagatagtccctcatgtccctgtcctactatcctgccgcattaccacctcacttactgcttattcataggtgacttaaaaagtccactgctaaggcattcaaggggaattctcgcgtgcgacgctcacactcacttcttccactacagctttaaaactctcgttaaaatatatttatgcacattattcctttacccaaattgctccagtggcccctattcttatttttaggttaaaggctcaagtgaaatacataacatataatattccacatgattcagcttcattctttaccctttaagcctttgttaattgatcatcatgtaggccatggcttaagagtagcttctagcctggcacagtggcgcacgactttaatctcagtactgaagagacagaggtaggtggatctctgagtttgaggccagggtggcctacagagttccaggagagctcgggcttcacagagaaaccctgtcttaaggaaacaaacaagcaaacaaacaagcatacaccaaaacccaaaccaaaaccccaaataaaactgaaactcgctctggggagatttgtctttgctcccatgtttctgttagatgacgtgtgttcccacaccctccttgcattgcccatttaaggtctctattccccatgacctgtgagctcattgaacacgtgcgtcacagcaaacttgtttccttgagtacctgtagaatggagcacactgcggggcaccttagttttgcttaataacttttgggtagatgcatggatggataagtagatgagtaaaagaagattgggaaggccaggaaaaaatttagaccagttttctgacttaacattaagattgttatttatcaaatactacaaaaatagatgttcaatgtgaaaccttaagattgttttgtgctgggctggagagacggctcagtggttaagagcactgactgctcttccagaggtcctgagttcaagtcctagcagccacaaccatctgtaatgagatctgatgccctcttctggtctgttttctgaagacagctacaatgtacttatataaaaataaataaatctttaaaaaaaaaaagattggtctgtgttggccatccagttgtacaactttaatctcagcactaaggaggtattagaagaggatcaaaggttcaaggtcaccctcagctacataggaaggtgaaggtcagcctaaagcacaccagattctgttaaaacaacaaaatgaaacaaagccaaaaataaaatccataacccccatttattttgactgtcatgcaatctattccagaaacatctacggtttcagaaatagtcaaaagctattgtttgtagatctgcaacagagcatatgtatttgcccagttgctcattgccttacaaatggctcagtataaaaattgccgttctgattttattctgtccactagaacctccgtagtgtttgcaaggtaacgtttccttctatcttgccctctgtctgcacaaaggacttcattgactctgcttcagaaggtctgatacaggactaaagcctgaatatttctgtaaaagcttcctcagataagccctattaatcattagatcataagaattgctgacgtacataaaatgtatagttaaaattaggaaaaacattcatagttatggaaatagaatttaagatcagacaagcatggcttcaattaaaatttgatttttactattatgtgtgatcttgacagcctacttagcttttaaatgtgcatgcttcctcatttagaaaatggaaataacttctactatataacactgtggtaaggagaaaaattagataatttatgtaaaaatttcatttttgtgcacagtgccttatatatactaagcattccataaatgttagtattatattgtttttgtaagtcattcagttactcattcaacatttttttattcactatgtgttcaacattcttttaggaaccatagaagaagagatgggaagtaaaataggagccctattgctgtgccttaaagttagttggccagttgaacctaaagatgtaactcacctagcagagtgtttgcctagcatacacagagccttagattgaatccacagcacctcctaaatgggacatggtggcacatgtccatctttctgacccccaggagataggagaaacaggatttcaaagtaatccttggctatgtagcaagttcaaggctagcctgggatatgtgaaaattattttaaataaatacataaataggaaagaaacacttagttggggacataattatcacagtattaatgcaattagagaacaaggcaatggaatataaatatttttaaatatcaaataatgaatgatattaatggggatatactaactcaacatgttggcttgttagttagcataaaaaaagagacatagaaaagcaatcttaaaactgctcttaccaagccagcagaggtctactttgatgctgcctgccagatggaaaatgatgcagaggggaaaaaatcctgtatttacttctcaaaattaagacaggatgggggagtgtgtttgagggatgaacatatgtgtataaatatggtataactcttaattggttccttacgattaaaatggaaactgtttccgttagaaaggcagagatatggtattttcacttacaagtgatttatttttacctcgttaaaccagaaatcaaacactagatgaaggttgcaagcctattttgatgtattgatgtctttttttttccttttcagggtcgctatggcaactgcatcttcgcaagttctgattccagacatcaattttaatgatgcctttgaaaactttgctttagatttttctagagaaaagaaactattggaggggctagactatttaacaggtgtggaagagctgtgctttcctccccattgtagttagtttttcccttctgtgccctttctgtctaaagtaaacagaaaagaaaaatgtttgccgtaattttaaaaaaataataagctttttctggtacacgtagttttccagacaagatcaagtatgtttgagctggtatagtgctcgatcatgtgtacctttagaaacaattttgttttagttcatgtaacatgaaagtggacttctggctgtggctcattagcagagatcttgaccagcagtcttcaatagctgcaaaaaagaagtgatttatttaaaaaaatcaaatttacttcttataatgcatcacatgattctcctgagctgttaggactcaggattagttttcacataacaaatagctgtcagaggtggcagcctacaattgttaaaatgaccgaaataaagactaataaatatccatgaagaaaaaaaaaagatagtaaagaataatgccagcttgttcagaatgctggttgttttcaggattaaaaaaacagtcacttcttgaaacaaatctatacacaataacttttttgtttgtagccatattgttattagatcaatgcagctattacttgtctgcttcattccatacactgtaaattgattttgtatcattattcctcataacaaatctataagggggctatcatgtccattttatggtgggaaattcttattaatttgcagcttaaatactgtcaaatgtttaggaaaaaattatcttgaaataaaaacaggttgaagtccatgtaatgagaaagcagtattttgctttgctatctatagatgcatttttacaagcattctaaatggaaactggggagatcattacaataacttagtcatatatatttgtcacaaatgcatttggggggagctgaagtctcagcacatagctgcagtctggtggttgttttctattaagaaaatttcttcagagttaaggatgtagctccatggtactgtgattgtctggcatggactcaatccccatgactgaaaaaaaatatgagaaacaaaaactcctactacttctgatgagacaaagtattttcttaccattttcttcacgtttccttttcagctccaaacccaccatctatccgagaagagctctgtactgcttcccatgacaccattacagtccactggatctcagacgacgaattcagcatcagctcctatgagcttcagtacaccatattcactggccaggctaacttcatcagtaagtcatggtgtagttggggcctgtggccagagataaggaaatgtaaggaagcagtaagctgctcaagattggccggtgcgccacgaggcaagtgtttgtaagacatgtgaggttgtttagtatagactttcatagacagtgcaagctccccaggggattgtaaaacattactgatggctgataagcaagttgtgtattttcttgctgggtagccactgggatcatccctaatggtttatgtaatccatagccgttcttcaatccataccactccattgacccaaagtgccactgcttaatatttgttcctgggtagctaagtcaccaccattccatgtgagtgaatctctctctctctctctctctctctctctctctctctctctctccctctctctctctctctctctctctctctctctccattatcatgctaaaataaaattccgttcaaagaccattgcttcctttattctacctatttgtgtctatgactatgtagatcagtcttctgccctgtcattcttctctttgctacttctttgtttccagaaataaatccagtacatataaaagcatgatggagccaggttcagtggctcatgctgataatcccaacatgcaggaagttgaggcaatagaattgtaatcaaggcctgtttcaaaagcaaacaaatgaacaaacaaacaaacaaacaaacaaaaagcagtatcagtgtgccacaaagttaaagatgtttaaaaggctgtatcaacctacatgtgaggatggtttcacctactatgaactggagcaagaccagacccagtaggagcttaactgattggctgcactcagtaggatttgagcagaaaggttcccctcacttcactgggggaaaggggaggcgatggaatccaagctgagtcaaaactgaatttgagcagttgcattggcaaagctgaaaaatattattttcttttactttgtgctttgcatttatgtctctcttcacagaccagcatgaatagacttttttaaataaaccctcctcatgggctttcttttcctaattggtgaaaattcttaggcagacttctgttttttgttttgctttttgtttttgttttgacactaccgggatggagagatgaggggacatttaggagtaaaaaaaaaaaaaaaaaaaaaaaaaaaccacttgcctcttgcagctccattctaagccccttggctcacttagccatcgtttctgggcatttcttcagattatgaagtcacaagctctaaggccttacttataagttttttcttacagtacactctgtacattctagaagccagtatcaaagagaggaactgtcctttaacttcatgatagaggaagaataaacatttcccagaagttgagaacaggttcaagatctgacaaacccgagagtcctttgtaatggaaggactaaaggagttgctactaatgacaaggttatatacatcttaaccttggaatggcccttagaagataactggtgtaatcttctctttactcacaagtaaatatctttgaatgttgctagtgaggaaatgttcattgtcatgaaagcagtccatttgatttctggaccgctataaatgatctccagtgcttccgtaagggaggcctgtttctctttgtaaataacaaggacagaagaaagctgtgtgttcattctgctttgccatttgcacagctattatcccatttagtcttcaagtgctctcagccttcagagattgtactgattccatttttatacgagaaattggtgctgatgttaagttagtttcccaaggacacagaactcaaataggatgggactgagatcagaacctgtaactgtcagccttcacgcttgagttttcttaattaagctttctgggcttcattaacgaacattccatgtttctcacataacagttgctcaagtattttaggtaactcatatggcactactaactttcctcatttttatgactcaacctttttagttcttccagttgttccccatacagtctgcttttcagggccgttatcaccatgagatttgtcttacgggcagtcttctgttggtcaaagtgcttttaaaacatgcatccatcgtgtcaaaagggaatatgagtacttggaatgtgtttcagattccccagaggatatctttttttgttcttctctgaggcaggctctcaagtagctcaggctggccttcaatttcctgtgtgagagtgaccttgaacttctgggtcttctgtcaccacagcctgagtgctgggattctaggcatgtaaggccatacccagctttatgtagtgctggagatgggatgtagggctttcttcatactaggtaagccctggactaactcaagtgcatcctcagtcaatgggttatatttcttatactgtaccttttttggaagccacattgatgactgaatgtttaccgagcctataattatctgagattcccatgtgtgataagttctgtctccacacggctcaaactcagcacttttgactttctgcttatgacattttgccttgtcaccttgattctgcatcaagtcatgcctggatcctccttagctggtttctatttttccttacatttgctttccctctcagcctgactgctgtgctttcaaacattgacagaaaagtttaataggctaggacaaacagcaaagccttgcagcaagattcagactacagcgaggaatttgttttagacgagtccttcctctggagccctaactggctgggaactcactgtgtggaccaaattggcccggaattcacagagattcccttgtctctgcgtcctgagtgctgggattaaaggcaacgggcaaccattttactagaaagaaatatcattccaagtcctggtctccccagctggtcaggtctgccgaggatggccgagcaccagcactgacagctactttctcttgacacagtttcacattgtcattatctagaacttactttttccctttgtcccttctttgctcccgcccctcctctccctctctctctccctctcccctccttccctctccctctccctctccctctctccctctccctctccctctccctctccctctccctctccctctccctctccctctcctctcctctcctctccctctccctttccctttccctctcccctccttccctctccctctccctctccctctctcttctatctcttcccccccctcctcttattttttccttttgttttcttttgttttgaggcagggttttgctatggaaccctggttcacctgtgactcatagtaatcttgcctccatctcccagagtacgggattaaaggcatatatcaccctacctggttacaagaggcagctctccctccccatccagacgtttccccctggattctgagtgttcctatcatctcttctcaattagaaatgatcacagtcaataaggttccaggccatatgcccttagctgaatgagaattccaacaggtccttttggttcagtgttttcctttgcattacaaaaatcattagacagaaagtttatctagtcaggcagtctgtagcatattgccacaaagatagaactttatcaatttatcttttcagtaatacattttttttgtttttgtttttttgagacagggtttctctgtatagctctggctgtcctggaattcattctgtagaccaggctggcctagaactcagaaatccacctgcctctgcctcccgagtgctgggattaaaggcgtgcgccaccacgcccggctcaatttatcttttcagtaatacatttgtctccatcacacacattcatcctgtctcttacatttccatattttgacattttttgttgactatgaagtgtatttttttttacattattcatgtgctggtcccatcgcaccaagtcttattgattcccacagaatcatattcaccattgcaatcttagaaactgagttcagtccccaggcttgctggccagacaacctagcccacttgattagttccacaccactgagagactctatatcagtaaaaaaataatagacagagcctgaagaatgacacccaggagtgacacacacacacacacagacacacacacacacacacatatacacacaaataaataagaatgattttgaaataaaaattccaatactagcacaaagaacactcttccctttttcatatatatttgtgcatccctggtgtttgtaaggccagaagaagatatgaaagcccctagaactgacaagccctgaactctgacaggcccgttcttatgcagattcagtggaagcttctacacctaccgtgagtcctgactacactgcctgaggcttgcccagaacacttggtcgccatcttctggctcttacattattcctgcttcctcttttccagtgtcccctaatcctttacacatctgtcaacttttagaaattcagtatcagaggcttgtggatctttgtgagttcaaggccagccagagctgcataatgggactcttgtctcaaaaagttaacaaccatataattctcttatatagcctcccatttgcattctaggtttgacagttagttcaataatattgattataatatataaagagtccatcattgacctttataatgtaggatgtaattatcatatatttggcttccttttagcccagtagacttcctcaatcattctttgtctttgatagtttttgacatataaaacaatgcccattttctagatgtagtggtacacatcactaattccagcacaagaagtttgatttaggagtattatagctcaagacttgcctgggctacataggaagaccctatctcttcttacaccttttcttaatttatctgatacttcctcacagttatattcaagtcatacgcattcattttatttgcatgcctagttggaatagtgcatatgtgatagagtataacagcaacagtatacttcttagaatgtcatatccagaggtatgtaatgtccatttatactatgttattgatgttaattttacatatcttattactatgttccctgacttttaaaattatgtacttctgtgtttttttcttttactaccagtaagcagtctgtatggtgatgctttaaaattatacaaaatatcctgcttcttcctccacgccatctcacccgactctttcccctaactgagcatctactcatgatcttgcttctctccagtctttagatgctgattgtgaaatgaagtttcccaccggaggactctctcccatacttacaaaatgtcactcgatattttgtgtagcaagagcctctctccctatttcatcttttttatttattcatcaggagagactcacagatgcattttcatcaatgatttagaattctttagtaccttcatttttcttgtgtaaatgtcccagatttagccagtgagagcctttcaagacatttctagaggttgtgccatattttcctgtcctttttgtgagcattttgtttgctttttggcctaacaaaaatattgcagactcattttaactttatcctgtccaaaccttcaaatcagctatattcccaggagccctggctatgtttagtaggacagtgatatgaaaaactaaaaccttagtagtatacacaaacacgcacacgtaatatattatcttgttacttctctactgttatgataatataccatggccaggcaacttacagatgaagagtttatttgggcttacagctccagtggcttacagtctgatggctaaagtatggcagcaggctaatagcaggctgatagcaggttgatagctcacatcatgaactataaacaggaagccaagagagtgacctctgaatggcacatagctttaaaaaaaagatttatttatttatttatttaatctaagtacactgtagctgtcttcagacacaccagaagagagcttcagatttcagtacagatggttgtgagccaccatgtggttgctgggatttgaactctggacctctgtaagagcagtcagtgctcttaacccctgagccatctctccagcccaagcacatagcttcttaaaagttccagtgacatacttcttccagcaagattatacctcctaaacctatccagacagtgacaccagccgggcgtggtggtgcacgcctttaatcccagcactcgggaggcagaggcaggcggatttctgagttcgaggccagcctggtctacaaagtgagctccaggacagccagggctatacagagaaaccctgtctcgaaaaaccaaagaaaaaacaacaaaaaaaaaaaacaaaaaaaaacccaaaaacaaaaacagacagtgacaccaactggggaccaagtattcaaacatctgagcctatagggacattctcattcaaaccaccacatatacttatgtgcattctctacatatgtttacatctatatgcaaatatgaaagcctgttagtattcatgtggaattggttacatgacctcctaaggataccagaatctgtaaatgctcagatccctacataaaatggtgtaatatttgcatacaacctatagccatcttccagtatatgttaagtcatttctagattatttatagtgtctagtaaaatataaattttgtaaatagttactatattgttaatgttgaaggattatgaattgaaggacagcctagcctatataggaaattttaggccagcctgggttatatgataaggtcctatctcaaatctttaaatctgtagttttgagggtctggagagatgtcttggtgattaagagtactagctctttttactgaggacccagattcatttcccagcattcacatggcagcttataactatctgtaactcaaattccaggggacttgacactctcttctagtctctgtgggtactccatacacttggtgcacatatatacatgtaagcaaaacacccacaaaacaaaaagaaatcttttttttaaaaacacattaaaatctgtagttggttgaatccttgaatgcagaatgcacagagaaaggtgggctaactgtacatattttagaagtcatacagtgctctgtgagcagcttttcttgagcaacagcactcaccaatacacacacacatacacaaacacacactatattcaccccagagagggaatgcacagtaggccaaagaaatgattgcaccaaagtccaacttgctgaaccaatgcatttttattgcagtaaataataagagtatgggtaaaaggttacttggaaaaacagggatggctcaaaaaagcaactgtatctcacccaagatagctcatggcttaggaaagttgcaagcctggagccctgagcacagcttgcaggcagttcctcagtggtctctcctgcacaccttggctgctctatgtctccttccccagtagttgtttactccttttatagaactgccaacgtgagggcgggaggctagagaatcttccattttcctagacatgtgatgttttgtttatctcctgggtcgcttgagctctggatttctcctggagggaaagtttgaaataggaggaaactgcagccagacagcatgcagacagatcaagaccacccacttctaactcatctccacaagttctttcttgccttcaccctttccatatgcatgttcttttctccgtagtaagaatttggggtctcaagaacatgaatacatatttgctcaacccggcaaatatgtctaaaatattttcagaactgatttgctcagggactgagtatatagttgcatggaagagtacttaaacagttcttccctcatctgtatgttccatggtcattattcctttaaaatgtagtggatttaatttgtttcagtttgcctttagtcccattccccccccactgttttgttgatttaattttaaccttttgaactgctatgtaatttttaaatgtgaaattataatttattgatagagttttagtttttgcacttattttaatgaaatttttcttaaaagggaaatatgcaaaaaagtatactcatgggaatttccttttttctggtatcccttttccctccaccctcatcctttgtaagtgaccaactttgttatcatcttggttattgttaccattgttatagtttttggaagtccaagaaaatgtaatatgatttattatttgcctttctccaaaaatactatagaatatgtatgatcttttgtagttagacttttccagttaacagtatttccctatcagctcatagagagcatcctcagtcttcttttacaactatatagtacttcacatgtagaaaatttgtagctgtttttgtttttaaaatttttgagagactggtttcttctttgtgataaaggttttcccgtgatttattgcccacactgtccagtggtgtccagtggtgtccagtggtgtccagttaaggaaaagttttgttctgatcctcatccttttttcacaagaagacaagagtcatttaatatctcaatcaattcttttttaatttacttacttgtgttttacgtgcattggtgtaaaggagtgagattccctggaactggagtgacaggcagttatgggaattaaacagccatctctccagcctcctctcaatcaatgctttgtcctatttctgtagtacatctttttgttccctcattatgatttttgtttgtttggttgttgtttgatcttttgagatagccttgcctgagcccagaagttgctctatagtcaaggctgacaatgaaagcctgaccctcctgcctctacctctgaggtgctgggattacaggtatgtaccaccatgctcaaatttatgtctcaattttttgtattaattttggccttttcagcataccttgaattaagtatgaatcacttgatcagctcccttgtaaaatattcacaatactatttctaatttttaatctcactcaattcttcattcgaactctataacaatgacttaaattggtcctcattttccatgccctttcctttccatcttcaagtagaattgtatttttaaaatgttaaaccaactgggaaacggataacagaagagagaagccaaagagaaaaaaagaagaacccatcagaatagagtatcagtattcattttaccaaaaactagccaaatacttttaattaaatatatttcatcctgtttaagtcactatatctataatctcaagattattttcaaaagcaaaagcattcttgaggtccttttccttgcttgggcagaaaaagaaaaccttttggataataatacaattctcgaccatgtgacccaaggagaatatgggatggggattgagtcaggaagaggtagaaaacaaaacaaaacaacaaacaaaaaagaaataaaaacaaaacaaaaagccaaacatcctatcagagcaagaagattctaccctacttagtcaagtcatcttggcttcttttgaagtctagcaaatttggaaaggaagggtgaagatgaggtggaaaggcagggtaatgtggctctgaaagtctcactgtcatacagggacaagggcacattgtcattcacacacacacacacacacacacacacacacacacacacacccgcagagatgcagtgcacacatcactgaaataggatgaaaagataaaagcttcatctatgaccacggacaagtcactttccttccattattgtttactctgaaagatgaaggggattcatgtctaggtgtcccttctgctctgaattttcatgatactgagttctgtacagggatgtttccatctatccaagaccagactcagttcacacagaaacagattttagtggtaaagatccagatagtccataactgtgaggattttactatttgtgttctttggcataaaaacaatataccctagcttttgtcagtggttgctagattccagaagcctggtacaactctttaagtgcgtggaaaatagtcattagtggactcataagtgccagttcatctcattatatctttcaaggctcaaaagaaaatgaattcacgtaggtggtttataattgattttcagtgtatttttttttttaaatcttgacttttttttttaacctgttggatgatacttttgtctttccctacttcacaggcctgtacaattcagtggatagctggatgattgtgcccaacattaagcagaaccattacacagttcatggactccagagtgggacacgctacatctttatcgtgaaagccataaatcaagcaggcagccggaacagcgaacccaccagactaaaaacgaacagtaagttgtggtgatttcaggagtaaagactccttttcctctctgtgtcaaggaggacacttagcctgaggggactcccagagtagtggcactgagtcaaggggacttattgttgtagtttgtgctttacttaaaggatttattggtgctcatgggtgtttgtggactaagagatgtatagtgtagctcgtggcttggaatgaggttaggaggttagggaagggttttctctgtcttccacccctgtctcccatgcttgggagaaaattgagttaaagagtattacttgtgatgatccagcaaagctctaccacagagaagccatagttttaggagtgctcttgagcaaaaccgacaagagtcctagcgagatttccaaggagtttaagtgaatagtggttttttgtttgtttgtctttttttttaacttcctgtcacacattgcaagaagtttgaaggcaacctgctcatggctaatatagcagctctgagatcccatgaaaggttgaagctcctttgtgtttacccaccaggccacaagatgtccagtgcaacctctgatgtcatatttcccttcaagacaggaagaagaagggaaaacgttggcaatctttttaatcaacgaaaaaggagcttgatcagaatgttcttccaatctgcttgactttagtttccttcctattaactattcctagcagcaagggtggctgggagactgagtgagagatggggaaagatgacgaatggatgcggaataaacacacagtgtttatcacagaggcatactgcacacactaaagctctttccatagccagcactcagggtcacgggacagtgttttagtcgcatggttataagagtctctgaactgaagcacatgctatctttcatcatcgatgatggaacagccactctaacaaagtgacctaattatatgtgcactccgatttcaagaaagcaaacgtctcccgttgctgagtttttctcacttcttttttcttttgtgagcagttgcctcattaagacagactttcttacctcaaacattgtaacactccttaaaaatttacctaaatcccaagccacttgggaaaagaaaacattcttttacattttttttcaggccaacagtttaaactagatcccaaaatgactcccaagaaggtgaagctcctcaatgatggatggaggatggaggatgagagctctctgaagctctcacatttgaggatgtgagacttcgagtggtcccttttaatatcataatacatgatgggaacactttctcctctgtgattggaatattacttccagcaaaatgagatacccacatttttcacagagagggaaaataatacatgaaggctattctatgggagggcgacatcttacttagttgcaacttgacactcttgcctgcttttgtaatatagttcaaactgcagccaacctagatcatcattggagatcctctgctaatgatggtcttggaggggaaaggtacagttcatcacaatgatgtttcatcatgggggttttcccctttctttcactttttttgtttcaggccaaccatttaaactagatcccaaaatgactcacaagaagttgaagatctccaatgatggattgcagatggagaaggatgagagctctctgaagaagagccacactccggagagatttagtggcacagggtgttatggggcagcaggaaatatattcatcgacagtggctgccactactgggaggtggtcatgggttcttcaacatggtaagtggagtttgttttctttctttctctcatcctctctgcttttaggctcttaggagattcaattgaacagctaaacaaaaatactaggaagtcaaggttaagagatatttgataagaagtaatcctagaaaattttgccagtttttagaagataaaattttggaaaatatactgggctaggagatgggaagtactgcatcactctagttgctggctttataggctctgattatcttagcattctgcatgcaagtataaatgctttaaggaagaagaagcacagagtgagtcactcctagaccctaaacaactcctatcgctaataaaagtttctgtcgtctccactgtcttaggtatgctattggtattgcctacaaatcagctccaaagaatgagtggattggcaagaatgcctcttcctgggtcttctctcgatgcaacagtaacttcgtggttcggcacaacaacaaggaaatgctggtggatgtgcccccacagttgaagcgtctaggtgtccttctggattatgacaacaacatgctgtctttctatgacccagctaactctctccatcttcatacttttgatgttaccttcattcttccagtttgtccaacattcacaatctggaacaaatccctaatgattctttctggcttgcctgcccctgattttattgattatcctgagcggcaggaatgcaactgcaggcctcaagaatccccttatgtgtcagggatgaaagcttgccattaagtgtcaagagagcatgtaagtcactggctctccggttcagcacttcccctcttaagcctccattagtgctccatatatgagatgcaaactaaagtccattggaagcactcgaaataactagatatcgtagatttaaatttttgtgcattaaaaatcatgtttgaattcatgtattgagttactcagaacaaattaatctgaatagtctgggtttgtgccaccagggaagaattctagagagtatctctgtcgtcattggagaatttaaaattcccagtgatttgggagtataaatgatactgttagcaattagcccttctagtaatggctagtttgaccaggtagaatttgcacagtgtcaaattatcatttattatatgtcactttttaataaactaataaaagaggggttttgagaacaacatatacgtgcatatataatatataaaatgactgaattcattttatgagcaaaatgacagataatttttatctattatgtatacacaataaaccttaatttgcccatttaaataagaaatatatggaaaaggaaaataaatgacactgtccattcctaactcttaggtaaaaccatcatggctagccagcatttctctctctttcccttacagccgttctttcctccctcttgcctcatgtacaaacacatgcaatcaagacacaggaagtgaaaagagctcttggttagatgaggagagatctggggacaagattgcacaagagatgctaatgctacatagaaattggattctggtagagaagtgtctcgtatagcctaatttcattgatactgcttaatggaggagattcatctgaattgttaaaaactatcatagactatttcaaagaaatatagttttgttattctcaaatacaaagttactagacttaggcttaagaatagagttgtataatggagtttcttcagaactcaccttacttgaacagtaagaatggagtgttacaggttcaacaactatatgtgtacaaatgtacttatattttcagacaaagcactgaaatgctgttttcctcgataggatcatactcattatttttggaattttgtttatactattcattcatttgcatcccctccacgacaaacaaaaacataaattccatcctcgtttttatcacagaagttgagcttcacagcctgtgatttcaccatttctgttgcggagattaattggaaatgccagagaaatagaaccttcttccaggagccaaatctacttcttggcacttgtaaaatgattactactgtttaattgttaaatgatagtagtagccattccctggattgtatgtagccttgatacagtgtcaaacgttagcccctcgttctactagcatggtggattcttatttattcatttgttcaatgatgccacattactgctgcaagaatgcacatattactagaatgcagaccttggtgtcaaatgtctcactcttatgcacaagagacaacatatctctgtaaatctcacctaatgatccttacagattgtttgcttatctaccacaaaaaaagcaagacctgtgccaatacaaaagaaagacttagatttacatgccaggtagcaaagtcaggttctctgccttcaaagattatatgtaccgtatagctcattaggaaatgagcaacttcagtaaaattcaacagtgctggtagttggcttgtggtatgataaaactcccagccttgtaattgaaatagccctagcttctctgccatttacctaacagtgtgacctcaggaacgcacttcttcaaacctgtttcctcttctgtaaaatgatccccagtttatgatgtaaagctgtaaaaaggttagtgtgtatcagttgccgagcacagcgcctggcattcactatgtgtgccaccaacgttcatctcttccccaacaccattcatttgtttttgtgttctttacgttttagtcctgggaacaaagctttagttccccgttctactatggactgcagcttagactacctttcctcatcccatcttctcagctaactagtgacctctggaattggcatttgtggctccctgtggcactcccctggcacactgagaccctccccacccagcaataatatggaagtgttttcagaatgccatcatgtaaagagccattttagaagtattgttagtgatttgttccttaaaacaattgattcttggcccctgcccctgatatacttaattaaactatatgaacataaggaaacttacatttgagacaagcttctcaggttgttctgaatcacacaaagtttaatgtagaataataatcttccctagaatgagactaccttggggtaagcactgtggcttttgttgttgtatttttaagacccagaacagtgtctggaacaaagtagttggctggctaatgtttgttgaaagaatgtatgaacgaagaaatgaataattctaattgctgtttgactgtgatgtccatttgtgatatttgttattcttgggggcaagttggttgctttagtctgtattgctattattttgtaaatgtaccagggcttatacatacaaatgaacattgttccagattggcagttatcatgaagaattgtctttggagcacgtggtatcattctaccagttacatttcatactttcatgaacttcaatgaacgttgttcttgaaggtagatttaagtttttattacaggcagagttaagcctactgaataaactgaaaaattaaatgaggtttgtgggaagcaataaagcttgactctgaaatgctagcttctgaggcacgtaatgccttccaagaaacaaaatggtggcaaatcactcagagggctatggtgagttccagatatttacttcagtaaacttaaaagactttcatagaacactggcaagggaccagagggtaactctagctaaagccagttgcaccaatggaacatgaccatttaacatcatcaagaaagatgattctataaacatggttgctgtcgctttactccatctaactattcagaactttttctcctagaaaattattttctgtctgcaatttatgcttgtttccactttttatattgtcttattaaagaaagcacaaactgaagctaagcttgttttgagactacaaaagaaattttaatgccacattgatgttcttgctacttataagagtaactgcatctggctgtgtttttatgatgtaattccattgtgtgtctttggatgcagtgaagttcatattgtaacaaaatcacttatatatacttttcagctcagacattctaggtgaattctcagtttacatatttgtatatgactacctggatggatcagttcatggatggacttttgaacaagcttagatgctggaaccccttctatcaaggaatggaaaatgtgaggcaggtagacatgaaccactcccacacttacttgtagctcctgaagccaattccagccttagagccattgggctgtatttggctgtgtattacaagttggccagatttattgccatcaggtcaggcaaaactgccttttatggtgtggtctgccagcttcagaaatatgctgtgttattgttattggctagaatatttattagactattgttgaactattttttatcaaatgctttaccccaggcttgtttgtactgggagctctggaccaatagtgtctctcctagtaacagaaatatgaacatctgtggattacacagtcttaccctctctaaagatcccaacccatccaaatgctatattatgaattaaataaatatatatgtattcatga

SEQ ID NO: 601 - DNA, 102783 bp, mus musculus
gacagtgtggtgctgcggtggtgtcatggtgctgcctctggaccgagaggcgaaaactctttaagtttagcccgggagacctagacgcgggaacgtcgcggtctccgtgctgtcccccgtggggcgcgcgggctggcggatcccggctgttgcgcggcggcggcggcggccgcagcggcgaaggcgggcggcggcctagagtggtggtggcggcggcggcggcggcagcagcgacagcggcccgggagcttgcacgggagcccgagccagcttgctgcggaggccggcgagcgcccggcgctccccggcgcgcgtaggagatggctggcacccgggaacaatatgggtaaaacgcgtcccctcgccgaggcccggggggatggtggtggtggtggggtggctagtgtcgccgcccgcgccgggcttggccctggctggctcctgctgctcttcaggtgccgccggggctggaactggccgaggacacttgggcttgggggggggggcggcaagaggggggagacggggtcctggcggcaatggcagggccccggttgtctgtcacactgttgtgacccgagctcctgccgctgccctcctgggaaggagtttgcactcctagatcccaggctggggaccggcccgaggcctcccgcttggccaggccgagcagggagaaagcagtggagcggctcagctctcgtggcgcctaggcgcaagtctgggaaagggcgcagccgccttcccacgctcccgaaatccacggcgtcctcggcccgggcggcgccccgaggtcggcggttggctcagtggtgctggcgcagcagcctgagattctgtggacaccctgcgagcgggaaccccgggagaaacttaattctccctccccttttcctccctgctggggaaacgatcttcaggtctctgtctgggtggttctttatttctggcctagctgtgaaagcagccccgtggggggggggggggtggagagggaaaaacttgagtgtgtccataggacacactgcgactgaagcagggacaggggagccttttccattccgggctcataaaaattactggaacattactggttatgagctggcttgggttgtttcgcacttcacgtgcagcatagtatttatttatttaggaggcatttcgatttagaggaggaaattaggatccagggattgttggactcttcactttccccactcttccacactccttaggtactgtctctattcaagcccccacatctcccaccagagttcctgcactctcagcttttctctgtcaacctgtgcaatgcggcttcttgcttttcaatcactttgattttttttgaagattttggagggtggggctgctgaatggcattagttgtgtgtctgtctctaaggaggagtatttatgaagcaagacattggaaactgtaatagtacacaactattgtgtggggattaattaatctgattctcgaattggaccacaagagttgactttaatcccattccatttcctctctgaaatcgaatcagatctctgacactattccaatagaagatggagttgctaaatggagagtttacattcttgctcacttctgcttggggagcttttgctgtaccctagattcctatcccagcatccccacctttttttaacctcctcctctctgctcatcactgccccaagggagaatcaatctttgctatttttatatattcctgctcaatcaattagcttaacacagactcataatatgaattagatttctcgtgattgttccttacaaaactcgtttcatgtggttgaaacacaagcctggaagccaagaagatcagagagttcattccagatgtgacgttgcattggctttaaggcctttagacatttgtatgacctctctttcacagttgcttcacttgcataaaaggcataatattgtgtactgggtattgtgagtattggcttggtcctttgaagataaaaggattctataaacctcagcattatactcttcaatgaaagcacttcatttatcctttattgggttactggattgactgggtataaatgggaacactaatttacaggaaccctaatttgccattattagttcccttgagattcaaattatcattgtaatttagatcttaagtcaatttgtttcatgaatgtatatgcaactgaatggaaacatatatacaattaggcatagaaagtaatggtgatgattttaagtcgagtcataaatcatattgattacactttaccctaacaatgtgagtcagactcatttgaatattcaacctcacccatttttttagtctacatggggggagttagttaatgaccaataaaagtaatatagatacatttaggtctggctatataagcaaaattagcacctagcagcagtgagtcaatatttttcaaagcacctttaatgtacagaagcctctgctgtctgtgttgagtgaggacctgcccttgacccagtattttgggctcatatttgccctatgctaaactctacttacagttccatggctccatggctaggatgcagtcagggtgggtgatgtgtggagtagggagagagggttatggcacatgaagagctgtctctcctatttactttcatgactactgggattcctgcttagcatgttgtaccttgcaagaccacttctgagaggcacttgctgcaaatgagtggcttggttgcttcacaaacatatcatctgaacagcgcaaattgacttagataaaattggtttggttaatccctcctctaaaaacagggcaacttgctccaacctgcaggtcttaaaatagtgccagtggagtgtcataattgcatccaagcagtgtcctgagtggtgagcctttccattctctcctcccataaaacctgctgacaccacaattaggaaggaaactacagaagaatgcattttgaatcattggcttgatgaagagtgaagaatattgtctctggttgtcaggttttccttagaagtagactttctcttccttaacatggatgtagagcccctaaagacaaagacagggatgcggcacacagttaagtctcagatggcagtttttagcgataactacttgactgtcattcggtctttatacagcttgctaaatttctagatgttagcaatgggactcagctgctagaggaggcccgagggtgtctgagggtgctccaagtccatttagtattgactttttgtcctgtcttctgtgcaaaagaaagctgtgtctctgacacgcctccttaagcagagggtcctgactcgacacactctatcattaaagtatgaggtatgacatgtttatgatggatagaataagacactcacttaaatttttacagttatttatttgtgtgaatgtgcgtgcatatgagcatgcatgtgtgccatagaatacaagcagagattagaggaaaacttgtggaaatctacacttttcttccactgcatcagtgttttggatcaaactccagccaccagtcttggttgtcagcaagtttactcgctgagcagtttcactagccctaaatatagtcacttttttgaaaattggatacaaagtatgatattgtactgtgtgtatttctggatcctcaacaaatacagtgttcatcactgagcggtaacagaggaggctagaaaagtgcttctctgtgtgttgagtcacagcatcaagtgagaagttcagatgactggtggcaagaaaagacaatcccactctattgtctgccctgggcagactgttagtgccctttcccacttctcaccttcaagggccaagaatcctgtcgccatccattttcatagattaaaactgcagaaagttttctgtgcactgtagaaggctgtgctctgtggctttttctgtctgctacctttttcatcttttttttttttttcatgaccataaaatcacataacatttttgatagtcagacttccagaaagcctataaacatggcagaggcatttggggaaaagaagtgacaccatcccaccatcactttctccatgtgttatttgcctgaatagagtatatacactacgatgttggtttagtgtaactgggttagaaaagtgtgggttcttgtttctccaccacaccctgactgcctgaccttgggctttgtcttagcctctttctgcaggtcagactcctctggttgatgatgaacagtatcctctggctctgcatcatcctcttacagagaccagatgatctgataaaaaacaaacaaacaaacccattctataatgacaactcttcctgaaacctaaactcctaatattttgcaatttgctctgataggaacataaagtgcaggcatggaagacagtgctgacttaggagagcaaagtgtgtgtgtgtgtgtgtgtgtgtgtgtgtgtgtgtgtgtgtatgtgtatacagtccagagatagaaaaatggtttatagttcagattcctctatcactgcgtctgtagccttttgttcagtgttgctaggatccatgcggttcccaggagagtggaagcttgattttcaaataggcctctgttttctgtctcctgttactgatcagaacttggggtcctcacagcctaacattcaatagagtgccctacatacatatattacaagttttattatggaaaagtagaaatgactgtccatcccagtaggacactaaatactttaaaaatcaccagatatttaaaaatgcatcattgaaaaaacagaggattagaagttcagtcttaaaatggatgaaaatttgcactagtagcctaggtgaataaggttcttcttcatttgttcctcaggcttacagctctgccagtgtaatctgcattatgaatcatacttaaaattcttgtcaaatattttaagttacctcagcaaatccatttttggttaccttgattaatcatttttaaataatatttttattctgtgaaatctttatacatttctacaatgtattttgatcacactttcattaatcttttgtattttaggcagattgtgacttttggtcttgttatttttgatattcattttaatatttatgatgattgaattatataaaatgctcaaagtggtaggtttaggagccatttattagaggggaatagcattcaattcttgaactataaaatactaagtaggccttaatgcctattagtcaggaactgggtcagttctctgtcctagccagtaatcaacctccagttctgaggtctctcaatgtatgatggcagcctaaaagaaaacactagaggggctggagagattgctcactggttaagagcactgactccattcctagcacccacatggcagctcacagttgtctgtaactccactatctgacaccctcacagagacatacatgcaggcaaaacaccaatgcacataaaaataaaaataaatgaataaattgtttaaaaacaaaacagaacaaagagaaactagaaataattcttccctcaggaggaccatatgggaagctaaatgttaagacatgtgagcatcagttagaaccgtggttttcctgggattgtgtggaaaggtatgactgttttctttcatgtcaattacatttgtgatgaatttccaagtgtttctagcttgtaaaaaaaagtgttctgggtgtatcatatcaggtatgaatgcatgatgtatgtaaatgtaattttaaaacaggttaatttatcttatcctcatgggatcttcacaagagtatatgcagtgcgtacagtgggggcttttgatctaaaaggtaaagaggctatggttcaaagaatttaaatattgtacctagcatcataagctagtactgttagatagaaaactttaagaaccctttagtaaaagaatgaaacagtggtttttaaatatatatgtaactatactatataaatatatacactatataaatatattattattttaactaattataatcattgactacctacctaacctccattttgccttctattctgagttctcatcatatagaatataaagaagtttatgcattggctacctttatgtcagatttcttttcttacagctgctgtggaacccaagctggctttgaaataattatgtagatcaggctgtccctgaactaacttgtgatcctcctgtctcagccttccaaattctgggcttacagccatgtaccaacattcaaggatcttttctgaacttgaatgagccatccacttttcaaaatgttcttggatttggcagttttctttttcaggtccagaagatgttttcattggttgagactcacaaggcattcccttcccctttagttgttcactggaaagtttgataaatctccctgaggtacaacaagtaaaaacatctactacacttcacattagcttagacaaagagcagccatacaccttgcccatctctagttgtcttggtggcagtgcttaccactttttagccttcctagttactctggtaaagaagagtcatgttttgaagagctagtttatagcatccaagatatcttatttgcatggtaataaatagaaaggactgtataataataggatatctgatctagaaagcatcttaaaggaatatctggtgattctagttcaacttgaacagcatcttgcacttgaagaaagagactaagccaggacttgtttgttcctactccaagggagatgtatagtttctggtattctaagaaaagtctcatgggaagttaatgctaataccctgaaaggttaaagctaatatcccaaagaatagtttttgtattatttttaaagataaaaatccagctcttttctcaatctatagaacaaaggtcaggcttagtttcatatttgtggcttttctgggaagaagggtagacaatagctccccagggagagagtaagagtccagagcatactcagaagatctggaatatgaaaactagataggctattagctgttgggataagtaggcatttagttatgttcaaatggcatttgaaataatagaattctgtcaagtgcagatcacagctgcttgatcataactcttgatcagagttagctaatgctagatttggagggcaatacttgaatcaatttttcatcttgtaagtgcaaaacgtgttatgttttgaaatcataaccactttcattgaagcctgtcctcttccttttaggtaggagtgatggtgcatgactgtaatttaagcactgaaaggcaaagggaagaggattgagcgtaacccaggttactcagtgagcccctgtctcaaaagaaagagaaagtaggggagggagaggcaagctccttttgcgtttctatataggcacacagcatcttaatgcctcaccaataagtctcctttcattggtaacctcatccttcccctctcttcctacttcttaaaaaagctcaaactgaaaaggatagactgtaaagataaactatgcaggacgaatcttctagtagaaagagcaaaaccatacatgtctgtttatacaccagtaaataaattatttggaacagtactccaaaggttgtaggcataaagatagttatttctttttttttcttgatatgtcaattgtttctaccattttgtatatttccttaattcatttatgacaagccattgtgttttctagagaaagcttcatgattatctctcattggtcatactctatcagattcacattcttttgctgtctttacagccttctaaatcgaagatctgcaatcctcaaaactttctgaagttgcaacaccttcttgttttctttttgttgtgtcccttcctctgctaaaagtattttgtgacgtaggtaggaattacgtgtttttagcaacaatttcaatatttttaagtaaataagaactgaggcttaagaattttctgacactcattgacaggttgtagatgtctccgagcattgcaagaccaagatagggaaacagtgacttagaaaaaaaagaaataagctattcaagctgggagcgatgacgctcgtctgcaattccagcactaaacaggtggagcagggcaatcaggagttcaaggtacctagcgagttcaaggcctgctgagatacatgagaccctagctggaaaaaaagtagaaaaaaaaaagaagcaatccagtagagtttatgggcactacataatcacacaatttgcaatacattgataccatatagtaagctatattaagtctggagtttgatctgactttgaatctctttttaaagactgagatgtggttcacatatcataatagtcaccatgttaaagtatacagccaagtggtttttaatatagtaaaaaacttgtgcacccattaccactgtctaactccagaatattgctgaaattccagaaagaaagtccatacatattcgtacttacacccactccttccctcttttagacctcggctactattatgctatctgttcctatgagtttccctattctaggaatttcatataaaaggaatcacacaatatactaatttctgtactggcttctttcatttggaaatatattttaaaggattgtccatattgcaggttctatcagtagtccattcatttttatagccaaataatactctatcataaggataaaccatattttgattttcatatatcagacaatgtggtttggttgtttctctcttggctactatgaatattgctgctgtgaacattggtgttcatgagcttttgaataaacacatttttaaaaacattttattcagtatagacctaggagtggaattgcttgatcagatggcaacttcacatttaactctggaggaaatgccaaactatttcccaaagcagctgcaccatttcccatttgtactagtaatatatgagggattcaatttctccatatcctggcagacacctgctactttccctttctgtttgtttgctttgtattattacagctattctagtgtgtttatttggtttgcatttccctaatggctgatgatgttggatatcttttcatgtgcttactggctacttgtttatcttctttggaagatcctttgccttttcattctgctgatgctgttgtttctagccctaaaggtttaagtttagatgaagtaacatttatctgtattggttgtttgtgattttgttgtgatctttaaaaaaacccaaaaaacaaaaacaacaacaacaacaacaacaaaacctgttgtctaatctaaagcatgtcagatttactcgaatcttttcctctaagacttttgctgttttgattcatagaccatcttcatgtattcatatttagattgaggtgggttttttttttgtaacccaagatctctcactatgtagtccacagtggccttgaacctgttctgatgatcctcctggccccacctctcaagtgttgggattgcaggcacatactaccatgcctacctagatttaatgatttttctatgtcgtaatatagctttctaacttcatttcttgtgcatgttgggatgaagttttcccagaaccatttgttgaaattattcatttttttgctgaattatcctggaacctttgtcaaaaacgagttggttataaatacacaggcttatttctagaggcttttattttttctacgtttgactatttgctgtgctatttgcaagcaagtatgaccttggacaaactactttctttgtcatgctagcacctattttttttaaagaaaactctaaaaacaataattggtattgtactgatgcttagatagtaatggaggtagggaaatggagactagtttcaggcaggctagaacagcactaatgagaatcaggggccctaatgaataaacaaatgtttgaggaacttgcaagaagtatccaatccctcaaattggctaatgatgttactgtgtcacaataaaacaaatggaatgtcaggcgtggtagtgcatgccaacaaccccatcatctgtggggaggaaacaggatggtcaggctttagaagtcagcctcagtctgacagtagtgatcttagccaactgaacttattgcagttgtgttaaaataaaataaggtgtggctcatttaagtaattttctgcattttatctatcctttctgttttttctttatgttagactttactgttatggagacctccaagagtcctttgaaagctttgaacaatcctcttctgataacaaatggcattcacacactgcagacatttctaggagatccagaaacctctagttaaaaattcctactttgaccttatataaggccattgtgacctagagtgagtttccctaagtttattttcatagtgaggttcaagggtcatattgatttgggaacacattttagggattcatatgaaatcgaagagatacttctccacatcttcttccctcttaagactgggaagctgtggcaccttaacggaacatgtaaactcgactttctgcaatgtctgagcaacctgggtagttttcgacacaggcattgtggaatgcttgaagctctgaaaggggttgtaatagaagtacagtgtcagatggagatagtcctaaaggaaggagtcagaaagaggcagagggttcagagggacagagagacaaaaatagaagcggaagccggccatttagaaactctcttgtaaatagttaagataacttcagtgaaggaggtgagatgatagaataaaggtgtaggagacaaagcacaggcattggcatgagagtgatttcagttctgggtttgtgtgtttttgaatgacttactaatgactctgtgcctcattttcctaagtctgtgatgggtcgagtaatgatcccatattcacagtcctgaaagaatttaatgtacataaagtgcttaacatagcactcagaacacatataaataatcaataaatactatgtgccttcttatgtttgctctgagcaatacattattggccattatttaataccagttttgtgccaggcatcatcatgctatgaataaaaatacaaaattgttgttgttctccaggagaggagagaattagtaggaaatacatatatgctaatgtgaatgttctagaagcccccagtatttgaagtaataaacactttctaggattggatgataacattcaccatttaaggaaaccttgcattttctttttttgcaaggatggtcacagagtgtcagttcatttgagccaatgtttaatttgactatcagatgaaattatctaaggaaatagtcctaccctgtgtggaagttgtaatcttctctaaaggcatccaattataaggtccctcttcagacatatggatgaatatgcttaagtaactgaaaatcataaaataaaattatcacatgtctcagcctttaaaatgtagctaaacaaacctttgaacctactaacctaagtgggagtggctgccttataaagaaaaccctccccatttatagcccaatttactgtaggacattcattaaatacctggttagtttagtacattgaatggatttgatttagaaacattctttgtgaatgcatttattttacttaagtgctaggcataattgtactcaatattggtgattcccatgagagggctatgcacatagtactactcactgacaatatttgaacaaataccagtggaaggatcaaattttcaggtcctgatgaagatttctaatgctagtgagatgaacaagactcctcacaatcaagagatgggtgcccttctctctcttattaatagaaccaacagtttcatccagggagacatgctttctatttgtccttagtgagagctaacttagaatatcaaagactcatagcaatatctttatgtccaagtctgaaacgactgtgggaaagtggagagaatgacagactcattagcaccgtcagttggggcgtttcttttactctctggtctgcatgaaaatgaacgttaccagattgaaagttttctggctgctcacctcacaatttccagatagagcttgatttttatctagtcatgttttagaaagcatgaataaaaaacacctggagacgaggttttttttttgtttgtttgtttttttaaacaggcaggtgctagctgaacaaatctgtaacaataaaaacaaacaaacagaagctggaggggcacttggtacagattaagtccacagttggaattcttccctacccaacttgaccaaattaaggacttttcaaaggtcagggcctgagaaagcgaaagggaaaggtatatcatcttttgtctttaatgactcagcttattagagataggataaaacagatttccatgtgtgctaatataaagtaattcaagttcatagtctggaggaaaatgtattattccgctctgaaactgcattttcccaaagctgtctgtcttttttttttcctctctctctctccatgcaggtacttagaaaggaatcatttcaggaaagagagagctagtttgaaatatagccttgttttccttccactggatgtaaaataggagcagcccgtatatcttgccttgacacgaaatagagtacaatattggagaatagggattgagaaatttgtagggcctccaactcatcacagtctcagagaagagatgccagtggagaatttgggaggaaacgatccatgctgagtgtgggagctggaatggtaagggtaatcaggaaaccaagacatagaggtagccccttgcttctgtttattggtgaaggaaaacaaaacaaaagtaaaacaaaacaaaacaaaacaaaacaaaatgaaaccaaacccaggcaagtgtctaaaagaaggtttgaaggagagtggggtgcagaaaggcttcctgattaattttcgaatgatccctattgcttaagcgtccctggggagtctatcaggccgaaagtctcccttggttacaatgtaattattctgcaatcacttttccttcagaaatgcttaatgactcttactttgtgttacttgcaggtgagagcccagcctctgcggttcttaatgcctcagcaggattattttcactaaagatggaaacactggagtcagaattgacctgtccaatctgcctcgagttgtttgaagacccccttctgcttccttgtgctcacagcctatgttttagctgtgcccaccgcatcttggtctcaagctgcagctctggtgaatccattgaacccattactgctttccagtgtcctacatgcaggtatgttatctcgctgaatcaccggggcctggatggcctcaagaggaatgtgaccctgcagaacattattgatcgcttccagaaggcttcagtcagtgggcccaattctccaagtgagagccgccgggagaggacttacaggcctagctccgccatgtcgagtgagagaattgcatgtcaattctgtgagcaggaccctccgagagatgctgtaaagacgtgcatcacctgtgaggtctcctactgtgaccgttgccttcgggccacacaccccaacaagaaacctttcaccagccatcgcctggtggaaccagtttcagacacacatcttcgagggattacctgcctggaccacgagaatgagaaggtgaacatgtactgtgtatctgatgatcaattgatctgtgccttatgcaaactggtgggtcgtcaccgagaccatcaggtcgcttctctgaatgatcgatttgagaaactaaaggtaagcagtatttgctccctcacaattttgatttagtacatagttgtacagttagcaaggtccccaataaactgggtcactttttctataggtcaaataagtcaagttattttcatagagaataacctactcactgcaagttttccctgggacttatatattacataaggctgcttgtagttctggggaagtaagcccgtggtgcacttcacaagggtaacagcagtctttctcatctgtgacacattgtgcattatatatctttgctacgatctccccacctcgtccttttagtatgtgagtacctgtgtaggtgtactgaaattagcatgtgtgataatttgcatacatttggctgggtctccgtggaggtgtgggtggaagtgtctgagtatatctatgcagatgagagatttgtggaggacattagtatatgcgtgtgtttgcaaggtctggggatgcggctcagtgatacagtgcttacatagcaagtgtcaagtccctgggttctagtaccagctctgcaagaaacaacaacgacgacaaaatacctcatcagtacaggcaaagaaagcagtgttgaaaattgccagtgagcacttcacttagagctaattcttacaccaatagatcaccaaatcaggagctgtggtcaaactcctgagctaaaagtggagagtgaaagtggtgagtttgtgcctaggtttgctattgtcagcccaagctaacacactggtttgtaggttctatcttacaagtctccaggcctttgtgttcagtgggcggggtttatgaagttatgttaaatactatttattggcaagcccgagtgcctggttttgaaaggccttttaccttactttgacggtcacaaatgtcagatgtagccaactattggtttcctattgctttcccgatatgtggtataagttttctcaagaaggaagctacttaacagagattcctgactaaatcaaatgttcagtgctggctttggcatcacacatactaaacttggaatggcagaaaattaattggcatggccccagtgcaaggatgacacacaaatttgggaagcatcccatattttgcaaatcagaatatattgtgtggaaaaagtattttcaatttaaaaagtttaaatttgttaattttaaatgttaaatgtctagggacttttggaaaactaaaacctgtaatgtctgttagatgctgttatatacaattaaatgcataattgcccacattgctgtataatttaaaacaattgttatttctgcaatgaatattatatcatcacatatttaattatgtgttcattataaaataaaatgaaacttaacaaaaataaaatgtttaaatgaatagtaagattactacccccaaatagaatctaactctacataagccaggctagaaggaaggtcccagtagcatggaggaaggcgggaaagtaatgggtacttttcttctgttagaatctggtgaacttattcaaatttacatggaaattagtgttggtaagtgtagcagcagtcagaatagattcacaatcttgtctgtaatttactgcacacagtatttagagcatcatacttacaatggtttgtgcctcttttgataattaattgtttccaatatgtcaccttttctcagctttttggttaagagcaagtgtatacctaatgtatgtaagagtcgatgtcaatgtttttatttcagcgaaggtgtaactttgattcttgtggggctacagagggtaatattattgacttaaactcttagaatcatcaaattgttaggccaaacacctggtctagtccaaaccttccattttaaagtttcatacattgagactttcttccactaagtgatgtggtaaatgttaacagacctgtttagtaattgcactggcactgaaaagcagtctccaggcagagtcaactatctttttttaactgctgtttcccctctgaaattaactttatgctccagcaactacacatcccgtaggtaggtccatgattagcagcatcaggaagaggtcataattttataactttcagcttcacaatggccaaaggtaggggtgggagtaagaagagtgggggatatggagaggatggagtaatcactgccaaatattttcaggtgttaggatcataataaggcattggctttgaaaaatattccacacagaaataccagcatccatatgtactgctgagataacaaagagactgaggagaataagcctgtgtctagagaacactggctattccagaatagcgaaaaacatggggtgatagatcaagaagatttggcagtatacagctatagttctagtctcctggctgggaaaatacaagtgtattttataaaaagatgtcttggtctgtgactaatcagtaatgtttggagaaagagtggctatatttttgatagtttccccccttaatttttaggaaatgtgcagaaaaatctgtttataaattaagtggaaactatttttgttcatttttggatggagactggaaacatctgaatcattcccaactgtgtggtttgttatgttgtctgaaaaggaaaagggagtacacacacacacacacacacacacacacacacacacacacactcttgtgagtaagagacactcttgtgagtaagagagaggggtgagggaggaagggaaggcaggagagaaaaagggaggtgaggaatttcctccatccagcgccgagtgggaaaggggattatttcttcacataaaacagagaagcctgacttaatgtcatatgtacatacttctttatgttaatttaagattagaaagcatttgtgattgtttaccttggttctgtcctaaagagaatggagaaagccagttagctggcagaagctatgggggagacaatctaagcactttcccctggctctgagaagaacagtaaattctgtcagaaaagggaaagaactattgtctgtctctctctctctctctctctctctctctctctctctctctctctctctctctctgacatgcatgcacacacaagttgacttttagggtcattgactggtgcagtgctcctttttacttttatagttcaccttctataatgttgtaaatgaaaacccaacaaaccattatggtatgtgtataagaaagattggagtcataggaaggtagtttgtctgtgtgcttgtttgttttgaatggaaatgaggactttcggggggtacctatataatgatttatgatcttatttatttagtatgcctatagggttgagattcaggacacacaactttcagaagacgaccagtgctttaatgaattcaaacaatactcatggttcttacttagttcatgatacatgctacacttttataaaactgcctcacacttcagattttctatttataccagctccttcccttacaaaaggctaatattattgtattatcaaatgttggctttatataaagaggccaatctcagtgcctctctcactgatagacttcaccttgatattctaaaatctgctttttatcatttgctgctcatttaaattttaccctcacgactctcaattttgccagcttcatctactcgggtgaacttcctaactgcatacaaaatgcccagtctggctttttttccctccacattcaccagtgttgttctcttggcttgcttaggaactctacccgttctttagagctcaagccacaccccacaagtctgctctaatacactacagagacattttaaatcccttgaggccagatacaatggtttttttcttcagtatccttctttgtgtttgtcaaacacatacatagtgcctctttaagaactccaaagaaattaggtgttcataatgacatgggggttttgtttatttgtttgttctatttttttgaggcaaagttttgattttggttttgtttgtttgttttttatgtaacacagtctgaccttgaactcacattcttcctgaatctgattcctgagtgctaggattagaggccagaacccctatgcccagtgttagaattatgttataggaagtatattagtgcacctggtttgattttgttctcatcttagtagacataaatcattcttgccattatgaataccttggatgtctaaaaatgtctcctgtgaactactgacaaattttcaaacccagagcgtgagcaaatgtatgacatgtccttaattttaagtgcctattcattttgattactggattttccaactgcctaaccctatgatgacatctgtataaatcagacgtgattattataattctctttgagagcgatgtcttcacatttccatgcccacagcctgccaaaaatgtagctgataaaaaccagggggggatggaggaatttcctggaagggataaacaagcacacgtcctttcctcattctattttctctaattcaccaccgcaaagctatatttacatatgaagactcttgttattacagtatattacctggaactggattaagttttttccattggaaagtcacacacacacacacacacacacacacacacacacacacacacacaaataaaagttgcgacagagctaaacattcccagacaaagattaaggagatataagacttggagaatgttcagaggaaagctacagtaaaagttaaaaggttagaaagaaaggtattgttgaatcgcatcattttgattactgtccttcttcctactcagtcgctctgttgtcctgccactcaccctcattctgtcactgcttttccccagtcaattgtctgtgcacccacttgacacccacttctgttggctaagacagatactctctcaagtatgtaccagtaagcatttgattacatctgaaccaatatgagtatgaatataaacatgagaagatacatatctttatgagagactgggttgggaagagggtatatttgcataaatatgtaggtactgtcatctgcgagggtgtacatttctacatgaatctgtgactgagaatgcctctgtggagctgtatcagtgtgcctatcaatatgtgtcactgtatatgaagatgaacatctgtgatatctactgacaagttgggcaggtggagatcatgagtgtaagactttctgtaggcaccttagggagggttaaagactcaagaataacctaccctaaagctaggccatacatggttaaggatcactctaataaaggagccagacctctatgctaaattagaaaaatctttagtataaagcagggtgagttactatagatgaaaggagaggtaaaacatttttattgtatcttatttacttgggtctagaataacagttgttaaatatagcaagaaaagcagcactcaatttaataaaatttctgtcaaacttaaataaaaatgaaaaaaaagttgggatttatgttcgttgaggtatggattgtaatgggtgaatgtggatgggaaggttaacatcaaggggtttctcagctaaccctgtcttcacccttcaattctagatcctaaagttacaattgcttataaagctggcatctctgttgtctctgaactggtcaagacttctcccccatcatatgcatgtataaatctagaaccaagtatggtgttgaatgcctgcagtcttagtacttgggaggtagaggaaggagggtcaggagttcaaggtcaatcttggctcatagtgggtttgcgtgcacccttggatacatgaggatatgttacaaacaaacaaacaaacaaaccatcaaaaccaaattaaaaaaacataaaagcaaacacaggcacgggcatgttagcatatgcctaaatgtcagcacttgggtgcagtaagggggtgggggtcactgcgagtttgaagcctgcctgatctacatagtgagttctggaccagccaggactacatagcaaggcatgtctcaaagataagaaaacagaacatgattctaaattaggcaaaaaaaaaaagtctgaataattctgtaaatggctatgtgggtgtctgagtaaatgtattttcatttcatctctactaaaactgctttctaagactgatctgaatccttgcttttttacttccaagacttcatcgatttctctggctctgcactcatgtagtattaataggagcctgtgctggaagatattttctgttgtcatctctctagcttaagagcaagtttagcaaatagaaactccaattatgtgtgttcccctttatgttttgaggctgttttgtcactggtcttttagtcactagtggctgagctaaataactactttgagcagacttcaaaagatgatggatgattcagattactctcgggttggtgagaatcttgtctgttactactggacaaaggaacctattacagaaatataacacatgtaaggaagcaagaattattgaagttagagtagtgacatttgaagatggaaatatggtaaagtctcttaagtccatgaacatttgacataatgagataatgcctcattctttgtctcagttgatgatataagaaactttaactgtagcaccggggatttggattagagaatccttcaatcatttgacaattaatgaacccttactttgtttattgaacattttggacattgtagtgggagtgggagctataagaaacaagacacagtctttgtcacaattggggctttgagcttagtagggaagacagacacatcaattgaaaaatccaattcggtttgattgctagcatgatagagatttgcacaggattctctgaagcccagagtttagaacagggaaaagatgtcatcagactcagaactgagaattggagatggatttgtgttcgaagaagggtcagattggaaagactccacgaggaaaggactgaataggacttaatgaatgactgcagtggttttagatggtcaagagacttaaaaaagaatgcttgaattggggatgtcttcaaaagaaaggcactgaagacagaaataaagaagttaggaagagacaacatgtaattatgggccattcaacattcctttgtcaaatatttgctgaccacctattagatgccaggcaacagaaaagatgttacagggataaacacagcttaatcccaaccctggtggaacaaggagagacagacaattgagaacatggttacaaaacaatgtaagcacaagaagttatgagagccgtggaaggacagtaggttttggacttccttattggggtattggggcaaagtcagggaatgaggatgttctggttaagagaacagaatgtgttcaaacatctggcaggtggaactgacggaatgttataagaactgtgagggcaagcatctagaaggaattgaaattcaagtttttcttgtggctgaaaaatggctagaggaatagatttaattggtttcagaatggagggtcacccatgcaaaagcaagctgagaagagggtcaagggttgactctcacagcccactcagaaattatatatgaaggaagaacagatgaaagagaaagaaaaaaatgtagccaaaagattggcagtaaggaggggctatgcaaggagaatggaattcagaggctttcactcactatgatgagtgttatcaaaataaatgctacatttaggtttatttagaaggtacaagtaacatccacctgtttaagctaaatatttactgaacctgggcatgcatccagggaggaaaggaagcatgcagaatggtttgagtagcattcctggtcacgatagaagtggaggttcaagtctgtgttcaatgtttgcagaggcgtctgaatgagaagagggagacagtgacaacccattttacctgtttgagagtctgccattttctaacaaacctgaagtggagttgacctgtgtgatacacatctagaatgtcatctgcatctcattgtaggacatagcttatgtctctacaacagcaaataagtgttgggggaaagaataaactctggcataaggatgtgggcttcagtttgtcgaccagatggtgtgttctgttgttgaaaggccatatgtaattgatatataaagtgacagactgaagcaaaagcaaagtaagtatttctaagacaaacactaggggaagagaagaagaagaagaggaaaatgaagaagaggaggaagaggaggggaagaaggaggaaggaggaggaggtagagcatgaactacaaagcatattaaggttctggcttctggtttttggaggagcaggaaatgttcatatctagataggatgaaaaaaaagggtgatgagtgcgagtggtagcaccgactgacatatttgctttgcttgtggagacaggttcccactgtgactcgaactcatggataatcttcctgcctcagcctcttgagtgctgggattaccaatgaatggatgtgtgtgtgtgtgtgtgtgtgtgtgtgcgtgcgtgtgtgtgtgtattacattgtatatatagttatatataagtatatattatcaatacacacacacacacatatatatctcagcactctctttttttgtaaattgtcttcctcctgccacattgaggtttgaacataggaccttgtacatgttaagtaagtgctggaccactgagatatatccctagacctgatgatgatgatgattttattttccccagtttttaatgcaaacagtcatttctggtccgtgttcctcatctactccatgtttcctatgccctaccttattagtctctatttccacctgtctcttgcttttcgcgactaaatgacatgcatggagatatatggaagttgtcttaatctttagaaacttaactttgagattgattctcttctctttctcactcctaccctttgtcccagggttcagttcccatatcaaagccccagagttgtgatcttgcctaggtatagaaaatattcttcctgtatcttttggaaagctagctagaaaacaggctttgatgtcaatacttgatgtcttaatagaacaaacagaaaagctggccccctttccaggtgttaagactggctgtgtctggtccatgtgtgtaagtgctcatgtgtgtaactacaaatgcctccctggaatggatcgtggcaagtatagagtccggacagctctgtgccagaagagtaacctctcttcctttaatgaagatctctctctctctctctctctctttttaaatacatgactaagtttcttgagagactaaataaaaaagagtgttaccttaagtaacctgtacctaaagaagtgagatttttttaaaagcaattatttaggtgagtcacagagggcgttttgaaaaatgggatgctgtctgacagaagagtggtcggtgcctggcttcctggacagaaaattgtgttctttagtaaaggaactggagagctcaaaaaggccaaggctatacaacacaaatgaaatggaattagggtgaaaatggaatcagtgtagactgccaatttagctaacacaggcctcttacgatctcaattatggaaggccgccaagtcatcccttctttttgtgctgtttagacacatgtacaattctgtgagagccagagtgtagtcattagaaggtgaagagggtctcagagttttataagctaaaatggcttctcaccctcacaaaagggaaatgcagagagactcagaggtaacctcctgcagcaggaaatgggaacttcatcctgctctctctgccaacctcctgtccctgtttcctcccagcagatatctccattccaatctcccctgccactttggctctcttgctgtgatggttcaactgtttggagaatgttgtactgactgggctcggacggagggaacctagcccagtccttaactggaatctatgtgcaaggagcaaaacaaagtgattcttcaaaatggaattacaataacaaagagacatgtttattttgacaggagaagatttttgtgtgcatgcacacacaaacacccacacaaatcaactttgtttactagacatggtatagacaagataatcccgtggccaaagcaatcacatcattcaaaccgagagtgtccccgaaagtttagttctcaatgatttgtgagtgttgggtattttggaaactgtgaggagatagactgcaaaattgcttcagttctctgcttccctccgcatatgttcattattgagaatcaatttcagtttgaaaggaggctttcattccttacaaatgactggaagtaagtaaacgttcagtgttttcccccaaattacgtcttataatgtaagaaaatagtggcaaaaagccatcaacagatggtgttttcattagccaaagatttatttttcaaagcatttttcatattaatgaagcaaggttgaaattagagtcatcttgtcagctctagaacagtgttgttaaaatggactggcattctgtaaattgctagggggccagagcaaactaaccatttgccataattttgtgatggtaacccaaggcctgtagtctaaccagaccccaaattatgtgtttagccctaatttttcttttccgtagctttgtacaagccataagtctctcggttcagggccataagtgaggaacacacagcagggatcttagtcctgctctgcagtatggattatttatgataaatccatttcaaagccagtgttgcaacaggttgcaagtacttgttcaaaaacattctaccaatggaatcctatgtttgaatggaaacacactgtagtgggaaacacagacttttgaatagctttttttcttctccggggttttcaatcaatgggctatttatcaaatatctcagtataatgatttttgatatgtgggatttccatttatatgggaatgtggactactcagccagaggaaatcattgactgattggatccattagtgatttcccctctctaatttacacgagcccctttgatcaaagtgagctctattctattcactttatggttaaacttttggagaggagtctaggcttgcagccttctgatgtactcttagcccatatgatttagcagctatttccaaagcctgactgaaaatccctgtacaaaggttacttgtagcctctgattacccaatcccgtccacccctcatcttttaaaacaaattttcacatttcccatggtctctgtacatttgacagtgatcggtcttttcctgaaacatgtttatcttgattatcctctgagcttggcccagatatgcatttgtaactgccctgggtattgcagaatccatacaaccagtgttcctgcctcccagcctttcctgttttcctctgttccccatattgatgctaggttaatatcccaaatgattatgtcatttccttattcaacattaaagcaaataggtacatactcatttgtacattcaaaatcctcaaaacagggctttccccccaccccccgacctaagacaggttctacttatgtagcattggctggtctagaacttgctctttagccctgactagcctgaaactcaaatagatctgcatatctttatttcccaagtgcttggactaatggtgtatataaccgtactcaacaaaacaaggcttcaagctccttttccattcttgtaccctatgttctagccaaactaaactgattgctgaacaaaaacaccatgtttcttcttgagagtggaagtattactatgttgttctgtacatagtaactgaacatcagttcaaactcctaggctcaaattatgttcctgcctcagctaactgagtagctgggactacaggtgtgtactaccactttggctgctgtatttttatttttgctcatcgtattctttgtccctgaaacaccatgccatccatcatctcttgtctgttaaattcctactcgtccttcaagatcatcttaacttcctcatctttgaagtcactgcaccttaacacagtagatgagcaatgtttttgtcgtggtaaatctctgaagtgttatttcttctttttccctttaacatctatttagtttagtgatggtgcctaattcaatgattgctgccgtttgttccccaatcccttctattgagaacacagatttagatgggaacagaattaaagaaagacgagaaagacacctcaggaattaaatgaaataaagcaggggtggcatgggttacttccagggaactaaagctaaggtaatcaagaaagatctgtgtactagagacttttctattgctataaaacaccaagaccaaaactaacttagagaacaaagagggattttgatttacagttccagagggataagagtccatcatggtggggggcttggctgcaagcagcagacatggagatgggagtagtgaatctgagaagtcacttctttgtctttactgagaagcaaagagagcaaattagaaatggggtaaggccatactttcaaagctcacagtcttagggttttagtgctgtgcagagacaccatgaccacagcaacttttacaaagaaaaaccttttaattggggctgccttacagtttcagatcttttagtccattatcattattgcaggacacatggtggcacaaaggcagatatagtgctgaaaaggtaattgagagttccacatctggattggcagacagcaggagactgtcacactgagacctcaaatactagctcctagtgacaaacctccttcaacaagtccacacttcctaatagtgccactccctatgggcctatgagaccatttttatttaaccccacccccccaataatacacttcccccaaaagactgcacctcccagaacctcttccagcagtgctaaactgtttaaatgcctaagtctatggaaaatatttcaccatcacaatgtgaaacaagagtttagctggttcttaaaattccctttgagaacaagtgaaatcagattagctggcctagatgtacatacatctatatacatatagcccttgcagcacattcaaaaaacaatgataaagttattaaggagccataactacttactagacaggaaaggatccaagatcacgagtcccctctctttgtctatatctctttgctccttagtgtccttccagcccccactttccatagagtgaactttgaacagctataaatcatagcaacatgaagacgacaatgaaacagcaagcctgacccagggaaagaataggaccagagcgagggtcaggaaattggggtgttatgtttggaacagatttggtgaggtattgaggtagtggaaaggaaagtaaaatatactgagactacaggaagcagctctcaacgctaacatttggtgataaggaaagatgagcatccttgatcaatatagaggcatattttagttttcacacaaggaatgggagagagtacctttttcaacagaaaacatgttaaagttatacatataactatactagtaaaactgtcatgttcaaaatacctgaaaagtgtttctgatgtggacctaaaaggagctgtgcaccaggaaatgatggcaaatagatattttcaagatagaatcaagcttagtgattgaaattcttagtgtctatcgaaagaaaaactgtgagttacaaaatttggcattggtgaatatcacattcaaggtacactatatttttcatgaatagacatgcccttaagtatataatgttataaacaaaaatgcagaacatcatggtttaaaaagttagagataaattcctacacctgtctacaaagttatgaatggcacctcttccctgatgaggcagatgtatacatttcttggcctgtagcagaattggtaagtctgagatacaactctattgggctgatggtgtggcacacaggcagatatagtgctgaaaaggtaattgagagttccacatctggattggcagacagcaggagactgtcacactgagaactcaaatactagcccctagtgacaaacctccttcaacaaggccacacctcctaatagtgccactccctatgggtccagaagaccatttttaggcacttgcgttgcatgtgtgaggccttcagttctgtatccatggaggggcacatacttacaattctaggactttgtgggctgaggcaggaagatataagtgggctatatgaggatccgtctcatcttcatgcctcctcccgtagaaagagagagagaggctagtcttttgctgattaacttccatattatattggttgtcaagttcattgttctttttctccctttctcctttttcctgctggcttcataccctccgtgatggcagcaaactctcgagatgaacctcaccaacctggttaagcgcaacagtgaactagaaaatcaaatggccaaactaatacagatctgccagcaagttgaggtatgtaccagtaacatttgcaattctttcattggatctgacctgggagatctgtggaggaacttcagttttgccagattgtagctcagccatattggggtgaaggactgaaactgtggtgtagatgatctctcatgcttttagtaattttgttccaagaaaggtcatagatgggtgatctttcagatttgacaaatttatagtttgtggggtacaacagatgaagaggagctctcatcttttcataagtagatggtatgagagccaaccaggaagtgatccttcatcaaactgtatattatcacttacaaagtcattacttgacagattggaaatcatgaatccttagggtagggtgatatgcactcaatagccattcttccctctcatcactctttccccactgcctagcttctcctcccttcatcccatagccccctggtccatgctatatccttactcatcatcttgtcacttattttcaatttcgtctacttagccttttttattatcaacaaataatttctatgattaagttgtctgtgaattatgaactgctgtgtaagtaagcctaaggtttcaaaatattaccgacattgaatattaaaacagcttagaaggacagttcagtgcttctttgcaggaaagagtaatagaaaggtgttattttctcttctttctttttaactgtttttttttttaaattagagactgtatttatttacatttcacatgttatcccttttcctagtttcccctctgaaaatcccctatcccctccccctgctcaacaacccacccgctcctgcttcctggcccagacattaccctatactggggcatagaaccttcataggacctagggcctctcctcccattgatgaccgactaggccatcttctgctacatatgctgctagagccatgagtccctccatgtgttttctttgattggcggtttagtcccaaggagctcttgggggtactggctagttcatattgttgttcttcctatgggactacaaaccccttcagctccttgggtactttctctagttccttcattggggaaccctgtgctccgtgcaatggatgactgtgagcatccacttctgtatttgccaggcactggcagagcctctcaggacacagctctatcaggctcctgtcagcaagctcttgttggcatctgccatagtgtctgggtttggtggttgtttatgggatggatcctcaggtggggcagtctctggatggtcgttcctttggtctctgctctaaactttgtctttgtaactccttccatgggtgttttgttccttcttctaagaaggattatgagcttctgggctaatatccattaatcagtgagtgcatatcatgtgtgttcttttgtgattggggtacctcacttaggatggtatcctccagatctacccatttgtgtaagaatttcataaattcattgtttttaatagctgtgtagtactccattgtgtaaatgtaccacattttctgtatccattcctctgttgagggacatctgggttctttccagcttctggctattaatactgctagtaataggctgctaataatacttaaaatctaaatagtgtctgggtttggtggttgtttatgggatggatcctcaggtgggacagtctctggatggtcgttcctttggtctctgctctaaactttgtctttgtaactccttccatgggtgttttgttctaaatatagaccagtaaaatataggatttctcatgggcagtgattgggccattttttctaattttatatagagtcttataattcacatttgtgtggcagataattgcaagagatctagttttgtttttttttttttgtcttaaatgatgaaataattttatcacaatccaagttcgaggttcctgtttaagactgaagaatatctcctaaggcaatgagtcattatgaataactaaatccacatcccccaattgtttggtcttcttataatcttgggtttcttcttatatagtgaacatacttaaatgatgaacatctctagctgtataatccccactgggcatctttctgtatagagtacgtgagatacaggtgaagctcatatgtgaaactggaaaataggatggtgtgggtgtagggagaagcagaaagaatgacaagaaggatcattggagtgttagtggaaaaatggatttcctacttgcctcttatataaactaactgggtacatgagtgtaagttggttaggacctctgtgtcagtatcctcccttctaaaatgtaaattgaaatgccgccgtgtttttcaccatctttccagatttcacaggtcatggatctgtcaatggtttctttattttgttctttttctgtggtgcttcattctttccaagaagggagaaacaaagtagaaagttatgatttctgagtagtttcaaccattcagaatccctctgcattacattttatcaaagcttttgattatgctgttagattatagtgtaagaaatctgctctgcgaaagggacaagcgaatattgtgagcagaagattggataaggggacgctcagcttagaatttgcatgattggcagtggagtaatagataacagtgaataaagtgaggttaaaaataaaatgatcattgtattcattctaatcaaaagacttattaagggtagagaaagtaatagtcaaaagagcaaagttacactttatctcattgctctttcatgttagaatctctcaaaaatcgccttttctgactgctgggaatttattatcctggctagcttcacctaagcatagcactcttccatctgttcgcaagtcatgctagaaaccagttcttatttatttatttattgatgcttccctcatatattacatccagaccacagtttcctcctcctctctttccagcacccctcctatcctctcccctccatctactcctcctctgtttccatttagaaaagagcaggcctcccaaggatatcaaccaaccatgcatatcaagttgcagtcagactaggcacctcccctcctattaaggctggacaatataataggaggaaaagggtccctaaagcaggcacaagagtcagagacaccccttgctcccactgctaggagtcccacagtaatgccaagatacacaactataatatatatgcagagggcctaggtcagtcccatgcaggctccctgattgacagttcagtctctgtgagctcctatgagcccaggttacttgattctgtgggtttcctggtgatgcccttgacctctctggctctgtcatccccccttctacagtatttcctgagctttgcctgtgaaactagttctttttattatttgctctgctcttttgatatggtagcaacaggcctcctaaaacaatccatcattgtgttagtaggggagaatgcactctgtccattggataggaggtgagtcttctttctgtgggtaccagaacacacgctaggcaagtgctatacatcatagcaacaagcaacaacatagcccaagaagtgatagttaaagtagcttcgtaaagttagcattcagaagttaacctgtgccttaaggatgtggtgctagcactaccatgtgtagtagagtaagagggaatcccatggtgatccagcaaagtagctatttaagtagcacccttagagatgattgttaaatcccattatataagccagtgtctgatctggttacacaaaagatcagcttttgttactaactttctatggatgttaggtacggtacaggaaaatagcttaggcatactacctacacactgaacaaaacctactctgatgtggtcacacctgttcaggagctatagataatgagataaatacactgagaagcaacaaagaacagtggggcagtataatagtgttgaacatgatgtgtattttaggagttactgcactgtttggttagtttaggattttgtcctgaatgaagttgagaggagtggtaaggagctgacagcgaatctggtaggagttgggggaaagggtttgcaggtgagtgtgattagggattcctaaagaattgtttgagattcctaaagaattcctaagattccgtcctggacaggatggcttatggcagtccatggctgttctttatgtcatcattccttctgcaagcttagagatatgcccctaccttcccctttaataacagggtgcatccacactagctattataaccattcaacacagagcctgtatgtccaaaaggctccagggcaagccccaggattagtaatgcagttaaaggagggacttgagatttcaagaatactcctaagtactttatacactgaaataaatagcaggataatgctaattatgagatccagacactgaatggtgtctggactccccccccccaattttatcttatccagatttgtctgcagagaatgactatattcacagtgtaatttaagcgtttcacattgggcgctggtggaggatgccagctacaacactctggcaagaacaggatgaggttttattcctgccaaacctgttccccttccttattgttggagagtgtttttgtcacaaattgacatttcataaagagtccataaatactgcctccccattctactttttctttcgcttccctattctcctcagagagtaaacaaggtttgagtcttcctattattacagaaacagatcaagatcaccacagatttattagctgaattgcagcttatacctttggctcaactttcataattctcaaaagagatagttgaaaactatttcatggggctgtgcagatccatagctctcctttaatctggttaaggaagggcatgctttgaccttgatactctggccacttgaactctatatttagttctttgttctggctcatcaagcatcctttgtttatttttccaaaggaagtgtctgtataacgcatagctaagggaaaatgtataccaacagatggttacttccttttggcattcctgaaaacttgccagagaagaaaatagttaactacgtaccaatccgtgcgtcagtggtgtttcttgagcatacaagacgtatgtggtgtgctgaaaggtttagagaatacaaaagaaacacttggctgatgatctccagggacttacaggctggccagagaaagtacagcctctagtaagaagagaagaatataaagcagcgagcagtgtagagagtacaagcaaaggcagtatatcccctctcacgtttgttctgaggttttagtccctgagcaacttaaacaaacactttgctgaacatttggtgagccactttcttttattcctctctcaactgatacaatacaagccctaatccaccctagaagctctgggaacaagttgatatcatctggctcttctcaagcctttcttgggactgggcagcactgcagtgtcaggacaagggacaaaggagaacaaaggagctggagagagggcactaggacagagtggtgatggtggggggagcacttcccttgcattgaggaatttaagctccatgtctctaccagttcttcattgcaattttttttttttgaaatctttgtctctttggtcttcaaagttgaggtggctttctgtttttcatctctgcttctattgcttgggtgcttggttaggcaaagatgtgtttgactggagtctgaacatttctttgagtggaaagaacatagatattttaaaggaaattaattttttaaaaaagtagtgctatcatgatttcagcagtaatccttaaatacatgaagtagttgaactagaaggaagagtagaatctaagccatttgaacacacacatggaggatataataaaaatgaatgagtaattacagcaaagtacatccaatcaggggatttttttaaatgagaaaatgcattttagctaaatgctgaaggaggaaaaaataaccctctggagaggcaggcagcagtgatattaatgaaggtgcaaatgtcagcttgcaggggaaaatggtacccatgcttctgggtgtataacaataagtagaaaatggttcctgcctccaaggcacatgcagattggccgagaacctgtcagacaaagtggcaaattgaatgtgaaggaatccttgttgtaatgaagacaaatgcaagatgacaggctggcatggaggaagaaacatccagatgtgcctgaagggctaagaaaaggatgcagagtggaaataaaagtgaagttatcttgaaaatgaataaactttgccaagtgattgaaggggctgaatgcagggatataaagaggtgattagcataaagctattcaggggactagcagaaatctgattctaccaaatctatgattggagaaccattgcaagaggaaagtttgaagaaatagcttgagcctagaaaatgaagggctttgtgtacatcatgggcagataaagtttagactttattcttagtagtctaaggatctgtaaaatgattttaagcagatgactagtgggataaaatctgtgcttagaaaaccaccaaccaaagagtacacatggaggggacccatggctccagctgcatatgtagcagaggatggccttggtcaggcatcaatgagaggagaggcccttggtcctgtgaaggctggatgcccaagtgtaggggaatgagagggcagggaggtgggagtgggtgggtatgtgggggaacatccccatacaagcaggaggagggggatgggacaggggttttctggaggggaaactaggaaaagggataacattcaaaatgtaaataaagaaaatatccaataaacttttttttttaaatagccaagactgtggggtggtaattggagcaggagttaaaggtcacaagtgactacttccattgttattgatacagggaaagtctatcaccatacctccttaaatctacagatcttttttgatatagggaaagatgaagggtcttccagaggcagtgactgtaaggttagggaggaagggataaaatcaaaccttttgtaggaggcagagttaatattacttggctctgccatggatgactgtgtaagggagtactaggataatccccaaattagttcttccttgggtgactgcatgaacacatctattcctttcaactagatgaggaaatacagaaggagttctttttaaaggcattggtgctttgttgtgcttggataagaaagtcagataggaaatgcctggtaagcagctggctggctgcgtctggatgtcaggagagaggtcttggaaagagaaaacactggaagttaccactatctcagtagcacttgaagccacagagaatgtgcaggagaggcagatgttttgggaatgtgcaaagaagaggatggaagatagattgagagaggtccaggagaaagcaagctgtaggaagatgcaagctggaagaagcttgattatgagagagatagcctgttagttattatcctttgacatacagagcagttggacacatatacatatgcaatctcctagctgtttattgttctttttctgggttaataacaataggaattaatactgcctaacaataggaatcagatctactgcctccaatcatgcaagctcaacctccccttcccgacttaccatccagcgacccttcccatacaggaccagctccaaagctttgagtgttacaactcgcttctccgagacatgctctgtaggtcctggattgcagggtgttatggtagctttggattgcagttgcactagcagcacagcattaggacagacaggttctctgaaccccagtttcatcagctacacagtttctaccggaaccttgaaaggtaggataatttgggtaaagcacccatgactgtgtgcctcgtataaggtcaaaactccataagtgatagttgaaaggagagggaagaagggagggagggggaaaggagggagggagggaggaaggaggaagggaggaaggaagagagagagaatgaatatagggagaaaagtaggtaggagcaattgttaacagtctccttagggtaccacatttatcgccagagatttcactccttgaccttaggacttgcagacatttattactgtatatgaggggtaggccaaggccagtcatcctaataaggctttcaatcaatttcaagctcagcaaatatatactggagcctcccgtggggagacatggtggtaatgaaattgtaacaccgaaaacttggatatctcagtcccatggctctttttactaaaaatgcatgcaacttctataaacacaacaaactaatgttttatgatcagtgagctggcacttttcagctcttaagttaagtagtttttatttagtaggcaaaaggtcacttccattctacaagaatagctaaggcattctttccattggctattgagtaaacttgtctctttaccatgcccaaattcctctagattcctgcctccaaggaaaggcaaaagaaaagttttagagatggacaaatgctttcagcttgagtagtttcaaaggacaggcagttatttaggatttagtgtttgttagacaaaaatattcagtgaacatttttataagagatggaagagtaagaaaagcacacttgatagatcccaggaaggacttggggctaccaatacattgtgagaataaaatacccattttgaaaccactgtggaattataggtggagaaaagtgtttccacgaacaatggaaaataggtgcatactgacctagtcagtctattattaagtatatagcaattgacatttaatatagatggagaagctagatctattgtgcagtctgaagtgtgggtacaacctatttttatactacaaaagaaaacactttataacttttcaggcacctaatgcatttaatccttcttcaaaactattttgtgacaatccttgatgtatttggagtaaaataacgtttttgaacatgttaagtgttgcattgggaatattttgagggcacagacacatgatgagctttaagaataaaatggatttagattaatactattccccaactcccatatctgtagggcaggtaagatttcaagtacggtcatgtcttcttagtcaaaatagtacacagaggcatacattttcattctgctttagtacagtcctgtgatatcacaaatctcatattgtagtcctgttccctatttgttcactgtcttagagttttatggctgtgaagagacaccatgaccaaggcaactcttataaggacatttaattggggctggcttacaggttcacaggttcagcccattatcatcaagaatggaacatggcagagtcaggcaggcatggtgttagaggagatgagagttctgtatcttgcttgttacataggcaaccaggagaagactgtcttccaggcaactaggacaagatcttaaagcccatgcccacaggaacacacctagtccaacaaggccacacctcctgatagtgccactccctgaaccaagcttatacaaaccatcacacttaccttcctcctctatttcccagtactgtaaaaattccagagttcactaaatgactagaatatttgcataattttggtctttcctgcttaagtcttcacactttgcccgaattctccatttataattaaaatactagcaatcaagctaaggacctgttcaaccttccttgtacccttgaatacctctaactttcatcttcagtttcccttatatcatctcaacctaaaggggaaaagttactttggcttaaagctaaaacaaccactatgacaactaccatgcacacacagctgtcgagacatccttttaaaaaaatctgtctttcaagagaagtccagctgcatggtatgcttagccaggattgagaagggaatcatatttgaataatttattcttgatattgtgctagaggcattcttgttcccatcctcaggatttgtgacaaccttgtgatagaataggtgacatccccattttcaagcaatgaacccagtggtcagagaaatgaggtgccttactcaaggtcacacagtaagctgagatgcagttctaaatctctggctccaaaccttcagttctttgcactgcatggtgcagctcagaatgcctatctgttcactggcctctgattcataaaaggagacagctctggagagcctacttttccctccgctgaatctctaaatctctagaagagcagatggtatgtttggggacttggcattccttaatctaagcctcatagacatatattcttgcctttggcctatccttggcagcccaggatatgtgccatatcctaagagcctgtcttggggaaggaaggagaaggagaataaaggaggcctcaggatcatactcttattgcttagattatttggggaccatgaaagtacataaaaataaagtagtcagctctaggcattagcactatcttacctatagtctgtcagtttactctgggatctaggctggctttttgaaattgcctggcagtgtccttctgctaaaggctgggcatgacgacagcacaaaggagtgcctttgagacacaaatttcctaaacagcttcaaagaattggcagtaaagtggtgttgcctcaagtatatgtaatattataacgttgaaaacaggctctaaatataaacacaccaccaaagtgaaagcatttagattttctctgcaagagtgaatacatgtgtgcatgtgtgcgtgtgtgtgtgtgtgtgtgtgtgtgtgtgtgtgtgtgtgtgggtgtgtggagagagagagagagagagagagagagagagaatgaaaatgggtggtggtggtgaattcttgttcttcaatggagtgataattgccaagttcatgaccattgactgggcatgttagctacttgttcttcagcacagaaggctgattctatatctcagcccatgtgacagttgaacattatttgggcttgcttttcccatggtggtcaattccttagcgttttctttatatgaggggaaaaactagaacaacactgggaaacatggcctttgtttattctagtttaaagtattgtctcttatgtacagagctgacttgccccctccaactcctcattctctgtcacataccaagccctgttcaccttctcctcactaaaatcaaaggccccaaatggttttggaatagttttaagcctataagacttttcctcaaagagccattataccaattggagtccatggtacatagaaccacacgtttccaccctttgctctttgaatacagtttgtgtacaagtaagcatgcattggaatggggcagcagacatctgaatgcccaaagatgtcttagtaggaaagcattaggccagggacattcttaggacgtgaagtgacaggaccagatagggaagaagaacaatggtagctagagagaagaaatatggaaaggaaggggaaacaaaacaaggcattcttttgctttgtactaaacatgctacacagttcttgccaagttccttgtgtgggggaagggagatgttctagcatctgaagggacctgagtctttaagcctgctgggggctcttctgggtttctgattgctgcctggtcaccagccaagtgctccaaaccaatttaggaggagtcgattggctttgtaatggaatggaatttgtgttgtttttgatagcctagattggatgctgatttaagaagcaaaatctgatattacagatgagtagacaaactgcacagtgtctgtttgccagagaatagaattaagcaccttcacgctttcacactccatttctgtcaaaaacaggatattggcagtaaagcatttgaaaagagtccactggcttaacagtgagcattgccaagttctgtgctaacctggtgacacattaggctagaaggtaaaaacagatcagtttctgagtgggggtaggtgtgttgataattttatgttttttttaaaatacaggatcacaatacttaacccaggttagtcttagctcacagtgtagtccaggctgtcctcaatctcacagcaatccctctggctttaggattgctgagattacaaaattgaaccaccactccatattttgtactaaaaaaaaaataataaactgtccttccagtgagtcactaaaacttcaaccacttttattctctgtggacttttgtcaaaaagcattcattaagctctattgtgtgtttagcattgtactcagcactattggggactgtagcaggagtgaaagtcgtgacacttgtctttaaggactttatagtctagttagcagagcttacaatacaaagcaacagcaagcactaaaaataggagtccatgagagagtgggattgagaaaggctaacattcttattgccatcaccagtagctaacacttactaatatttaatatgcaccaggtagtgtgttaagtattttacatgtattatttcatttaatcctctcaaatacctctgagacagacacttttattatccttcgttttcatttgagaaaatttagtgaagataagaaatttgctcaagagacttgcagtaaaagatgagactacagaggcatggagagacctggtcacaaaggattgtaatcatgttaagaagtttggaatttaccctaaggtcagagagaagccaactgatatttagcatgaaagtattttaagagtggaattaatgtgtgtgtgtggggggggggcagaagtggaggtaaatttttctgtgtgactattggattaagaattctgcaggagagctagggatatagctcagtgatggagtacttacttagcatgcataagaccatgaatttaaccccagtcttgggtggggggaataatgtatcatgaagataaaaaactggagtaggctagttagggaatgttgtactcggtttggcacatgttgtcctcaatacacatttcttggatgggtagtttagtttaacaaagatgtttttgttagatgtagtgaggcaataattagaaaggacagagaaagaaatgggttggagttatacttagtaagcgccatatatggaatgtgatgattcatcggatatacagacaagaaaaaaagagagttcgggacaggggatgccagtgtttctggacagtgagtcatgtgctacttcattcattacattttaggaccattagggatgatttagctctaatggaagtagatgagctcagctttggaaactcagtctgtagtgcctgtttttagataaacaaaacatcccagtaggtagttaagaatacaaatggagatttcaggagaatgcaaatacacatgaggcaaaatatggatccttttcaatgtaatagaattgttctcaaattggatttgctgggctggagatggctctgtagttaagagcacttgctgcatttgcagaggacaagacttcaatccccagcaaccccattggggtgggcacgggggcgggggcgggcgcagatcagaactacctgtaagtctagctccaaagcatccaatgccctcttctggcttccatgggcatctacatgcacatgcatgcacacatacacataaactttttaaaaagtcttttaaagattggactttgcaaatggttgcatcaatctttaaacttacccaaatccagtggattattaacttcaaatgtattggttatatatgatgtaatttatatctcagtaaaaaataggcagaaagctagcatatagtgccgattgatgaagcattagcaacatgtgagatgaggctaggcatggatagccacttaagagactgatgtgggaatattgaaaccttgaggtcaccctgagtaatttattgagacattgtgtcaaaataaagtaaaggatggagctccctggtaagttgctttcccagtatgaaaaaccctagatcagcccttaatgcaggagagataaaaagaaaaaccaaccaagcaaactgaaacaagataaaaattccaatcctgaaaccactaaaatccaaacactgcatttaaaatgtgccggagagacttggaatgttaggaagaaaacaaagtgggtgttgtggaagctggcagaagaccgtatttctagaagtaaatgggttttcagtttttgtaatgacatgaaaaactagtatctttaaatgccagtggattcttctacatgctaaccaccagttgtgccagcaccatttgttgaaaatgctgtcttttttccactggatggttttagctcccttgtcaaagatcaagtgaccatatgtatgtgggttcatttctgggtcttcaattctactccattgatctacctgcctgtttctgtaccaataacgcagtttttgtcactattgctctgtagtacaacttgagttcaagaagttatactccagagaatcaaacaaccctattagaaatggggtacagagctaaacaaagaattctcaactgaggaatggctgagaagcacctaaagaaatgttcaatagccgggtagtggtagaacacgcctttaatcccagcacttgggaggcagagacaggcggatctctgagttcaaggccagcctggtctacagagtgagtttcaagatcgccagggctccacagagaaacgctgtctcaaaaaacaaaacaaaagaaatgttcaatatccttagtcatcagggagatttaaatcaaaacaaccctgagattccacctcacacctgtcaagaatggctaagattaaaaactcaggtaatagcagacgctgacaaggatgtggagaaagaggaacactcctccactgttggtagaattgcaagctggtacaaccactctggaaatcagtttggtggttcctcagaaaattggacatagtgctacctaaggacctagctatacgactgctgggcatatacctagaagatgctccaacatgtaatagggacacatactccactatgttaatagcagccatatttataatagccagaagatggaaagaacccagatgtatttcaacagaggaattgttgtgatgataaaaagataaatatgtattaatatatgttttatgggggtatggtgaagtatgggggaggggtgcctcagcaggcccatgccaaggcatcccttccccctgagggaccagccacactatggtatagggtatagtatagaaaagagtttattcagggcatggggagaggagttaagagggtagtagaggcagagaaaggcagagaaagagaggtgggggagtagagaagtagaggccggccatgaccatctggagagggggggaagggaatggggagagagggggagcaagagggcaagaggcaagagaatagaggtaaaagtaagagagtaagagagaaataaaagagggcaagcaacccctcttattgttgaccaggcctacctcgctgttgccaggtaactgtggggaggagcataccccactattgccaggaaactgtggggtggagcttagacagaatcctaacaggaatggatacagaaaatgtggtacatttacacagtggagtactactcagctattaaaaacaatgaatttatgaaattcctaggcaaatggatggatctagaaaatatcattgtgagtgaggtaatccagtcacaaaggaacacacatggtatgcactcactaataagtggatattaacccaaaagctcagaatacccaagatacaattgacagaccacatgaagctcaagaaaaaggaagaccaaagcgtggatgcttcagtccttcttagaagggagaacaaaatacccatgggaggagttagagacaaagtgtggagcaaagactgaaggaaagaccatccagagactgccccacctggggatccatcccacatacagtcaccaaatccagacactattgtggatgtcaacaagtgcttgctgacagaagactgttatagctgtctcctgagaggttccaccagtgcctgacaaatacagaagtggatgcttgctgccaactattggactgagcacagaggccccaatggaggagttagagaaaggactgaaggagctgaaggggtttgcatccccataagaagaacaacagtatcaaccaaccagaccccccagatctcccagggactaagctaccaaccaaggagtacacatggaggaatccatggctccagctatatatgtagcagaggatggccttgtgggacctcaatgggaggagaggcccttggtcctgtgaaggcttgatgtcccagtgtgagggaatgctagggtggggatgcaggaatgggagggttggtgagcaggggaagggggatgggatagaggggtttccagaggagagacctggaaaggggatatcatttgaaatgtaaataaagaaattatccagtaaaagaaaagaaaaatgtcagtggaaatttaccagttgtcagggagcaattgagtggcaggaaccgggaagagcattaagtaaacaaaggaggacaccaaaagaggagaaagtgagatccagagcacagaagtgggatgacctctcaggaggaagtgccagttgccttcaagtgccagttgcctattcttttgctacaagagagaaggaagagaacatggttgaagaagtgggcatgttgtgatgggcttgtttggaatgcctattttgactgtgaagtaggagtgctatgattttactgcaagtgaggaagaaggtggtgggactggaggttggaggactatgctgccattcttatagctggctaccacaaaattagagggcagttagtcttttcataggtcacacatgcagaaacccatgagaatgaataatgctttccaaggcgaccgaactgattaggtgagaagggtttatagtggaattctttccacaaactaacttaatatctctctctctctctctctctctctccctccctccttccctccctctcttcttctcaccctccctcccttcttctcaccctccctccttttccatctgagatagggccttcatgtagtttgaattggtatgcagccacagatgaccttaaacttctgcctctgcctcctcaagtgctggtattgcaggtgtgtgccacaggtgtgtgccaccgcacccggtttaggtggtggtacggataaaacctatggcctcgtgcaagttataaaagtactctattaactgagctacatattcagttcttccataaactttcctgacaaattttaaatgattttatttttcgtatcttaaaacattaatacacctgatattattttagagtatacaacgttttgaatttgacttccagagagatagttactatgtaaaggccatttgctaaaatccaaaagtcctttttcattgaatggatatattgccttagccatatattgagtctttgcattgacttaattcttctagactgctttctgtttcactgatttaatttttaattttctattcatctcccaatgctttattattttgattataatggttttaaaaagtgaactgggcatgatggcacagacctataagtgttgcacgtgggaggctgaagcaggagtattatgacttcaatactacataatccagtccagccacacctacacagggaaagcgtgttacaaaacaaaccagaaaaaacaaagcatatcaacatctggtatctgttttcatatgaactttaaaatacttttatctatctataaaacatactcagcttaggttgtaattattatcttattatgattatatattcctttttggaagaaatatatttttatggtagggctttttatcaagaaatttgatgataatatagctatatatttttatttagttatattttattttgagatcatttttcatacacacagacccacacacatatatatgcatgtgtgtatatgtgtgtgtgtgtgtgtgtgtgtatgtatgagatactgtatccttttgttaaatcaagtcctaggtgtcttatagacctgctgagaatgtgttgcttttccattttcacttttaaaatgcagctggagaaagcttttgatttaatgtgttttcttactatacttataattttggatctatagtagagtcgtctcttgaattatctgagatgcttttatcttctttacaaaaatataccagttgcttcattttcttgcctcaaccaaacatcaagaagtgtgatgtcagatttctcttctttgttcttgattttactggaaagagccttcgcgtgttgccatttagtatgatattcgttatttgtttttagcatcttcaagcaacttttgttgtttttttaatttagagttttcatttggtttggctgctgaattttgtttaaaaatttttagaatatgttattataattccatatgttggtaaatttttaaatgttgagtcattcttttattactggaatgatttttattcctctgttgttctgttagaattcattttgaaatgtatttagaattgaatttataatttagaaatgtattcagaagtgaaacaatcctatagtcttattattcttcattatctttttaggctttgggtattgtatagtataatttgatatcatactagatttgccagatgcatttgaggtttttttaatctttatctgtgatcttaaatgaattaaataatatgggactaatctgttctttcaagaaactatagaactcatcactacaactatatggacctggaaaagatctttaagtacccttccaatcttgagtaaagttattagtctcttcattttttaaaaaattatttttggcaaaattaggtaatacttaaatgatttttcaacggtgtgtcataagtttatatgtagtattctctagtaaatatgttagtatttatccagtagtgtgttgcaattggcttgccaattcaatgcgatttcttcccattttgggcttagtggctggctacacactggtgcttaaaattcaccatggtgggaattttataccataaaacaagtgctacaaattatgaccaactcttgcatgtttaccatcccactatgtatagttcttagtatatctcctttccattgttagtattgcctgcctgcctgcctgcctgcctgcctgcctccctccctccttccttctcttccttcttttcttcatttttgagacaagatctcagatgtagtaatggctagcctgtaattttctgtgtaaagtaggctggtcttcaacacaaagatatctatctgcctctgggtttcttgttttctttttctttccattaatgagatttcaaagaaccacttttgattttagttgtgattatagttacctatggcaattttattccaaaagtgaatgtcctctccttacttagttttatttccttttctaaatgtttgaattaaatggttaatttatttctcattttatgataaaatgagtcaagcttcaagagtacccaatatatgtttggtactaagactgtgcccttgggctagactgtgtatgccctttcattgtttttgataggactaacaattttaattttgatttttttagagttatctaagagccagtttctctatttattagtggttaaggatttagatattcatatttttgtgatattatttctctttttcagaataaatattataaattccttactagtctaatgtaattttgttctttgtgattgtgaatgttcctgaatgtaagagaagaatgtaaaatttctgtaagctacaaaattctgtataggactattatattgatttttatagtattagtattagtatttaaactcttatttttgtgtgcatgtgtgcatggggacggaggctcaaggatgatgtaggtgtcctgctctttcactctgcgccttacccctttgagacagggtctctttctgaatttggaccttgccattgctcagcaaggctggatagccactgagctttgggcagccaactgtctctgaccccctccctagtgctagagctactagagctatattttgccaagcctatcttttatgtgggtgctaaggcttcaagctctagtccccttacttatgtggcaagtgctcttaactcttgagccatgtccccagccctcttattgttttgtaactcgatctgttttatactgtagccatatctttcacctcttgtcctttcttctgctctttgcaggcttggggtaaaactctgggtctcttgaatcctagtgtactatcacatacttgcggctctaggttttctcctatttgttaaatatttatttcctaataagtgaaactttcaatttagagttattgagttatattgtcaacaatctctgtttattgaggcaattcacactttcatgacaaaaatagaacaatacactggtggggctttctttcatattttcctttaccatgtcattgcagaacgatatcaagcccgtttggtcaactctctagtagaataatagataatgggtgtcagctaaagttgagaatagaaactaccacttggttagggtttatactgacaaatatgtgttatcccatggggctagtatcctgtcatttataaataagtcagctgaatattccagacttgagttactttaatacagaagaaaagcagtaaaataaatcgttttgatggaacattggaatgtcctcatgttcgactttactgttgcctttcctaatttctgccacctcttgatgttctttctgttcttccttgggatattcttttcttccgtccaatacttgctttgcaacttgttttctttcaatggcactgaaacttacaatgctctgcaaatgaatgaaataccattttacaaggggccttcatttttataaagggcaaggtaagtgttaccaccatggttctctttcctgcagtggactccagcatcttgagcttgtgtagttatggctggctttggtattgccgaatagcccaggttcaattgagacagagatttgcataacccagggcgatatggaactcacttttgggcaagtctgaccaaaattttgggatgacaggcgcaatccatcatgtcctaatcaaacttttcattttttaaagggtaatggaaagggtgcacagtaaaaatgaaagcttttttttttcactataaaatatagtcactattcatatgtgtgacctttgaaaaaacaatatcagattcttcttcaaataaatcaacagcaaggcacttctttatataactggtaaagttaaaatatggaacatgcattagattctggtattgagaaattatgtcaatcattatgtaataaaatatccttttcagatgtaaactaaagtgctggggagtaaaacaatttctttcattgagatactgagggagaaaggaaggagaacagatcagacagaaacattgacggcttttgaagcgaaaggatgagcacgttgggtttcatcatgctgtctagctttaaatagcgtagacaatttcataacaaaactacttaagatggcaataatgtttacactgcaaccagttaagaactgtcaaaatgcataaggaaagcattttaaagctttcattacccttttgttagtcatattccaaagagcttactttttgtctccaaagccatttttattaacgtcctatatgaccatcccagtaccagctcagtttttcccctatgcccattgtatcttcctttttgtccactgactggcactctcaattgaggagaatttggcaacagagaaatataggtacaagttaagccacattggctatctaaatctgatccaagggaaactgatagtcgcaagtgttttctttcctagactgcccatttggaatctagttctgaggacatgaaatgggaatttggcaaaaaaaaaatatatatcacagacatgtggtatcaccatttattcagatcaaagtaagtgagtaagttagtcacctagccaaataaaggcaacccagactttctgggtttaacttaataaatgggagaagactggtttatttgatgatttaaaaatatgtacacaatgtctaagtaataacttaaattttaaattatttagaaacatttcttcctgttcacccacatgactgtgtatgtgtgtgtctcccactgtgtgtatgtgtgtctccccctgctactccttgtgtgtgtatatatataagatagaggctcccagtgtgtgccaaagacctaccaaaagattatggaaggctaggacatggctcagtggctaaagtggtggctgtgcagctatgaaggttccgatgctcaggacccacagaacaggtgggaaattgtggtagccacttgcaatcccagaactgaggaggcaaagatagaggattcctggaataagatagctaagagaccttgtttcaataaacaacaacaacaacaaaaccaacccccccaccctcacacacaaacaaacaaaaagcatggagagcaattgaggaagacatccagtgtgaacttcacaactccacatgcactcacatgagcagcactcccctatgtgtgcctacagacatagaggaatgtacacacacatgtgaacatggacacacatacataacacagattttatttttatttttttggttattttatttatttacatttcaatgttatccccttccaggtttcccctttggaaattccctatcccatcccctctcctctgtgcctctatgagggtgttccccaacccacccatccactctcattctcccgccctggtattcccctacactggggcatcgaaccccctcaggcccaaggggctgctcctcccactgacatccaacaaggccattctctgtcgcatatgtggctggagccatggatccctccatgtgtactccttggttggtggtttagtccctgggagctttggcgggtctggcataacacagattttaaaaaagattatgagagtagtcattttaagtgatcatccaaaagctgaaatgtgagccaccctgtgttacagtaagacaagtaggatcatgaatcaaagcctgaatttcggcttggggcgaaagcagtgttgcctgttttcaatccagcacagcaggttggagtgggagagcaatggggaaggaaatccgtatttatttaactcctactgtgtacttggtactatgagatccctgtctctattagttcatttggttttcacaactacttctgagatagtgttatttctgttttacaggtcagaaagataagctcagagaaaagtgattagaatccagtcaagcctacttgacttccaatacagagctctttctacttgactgtgctgccttctggggtagaaaaaaaagtactaataaaacacagaaacagcacatgaaactcctcaaaagaaagaggggccagttttcccaaataatagttttagctacaaagagtgtgatcaaaaagcaggacgactttgatggttctaatggaacgtgggtgggctgaggatctagctctatcgctagagatacattgagccctcatgggttcaatgtccagcactgaatgaattcctagcacttgggagatagaggcaagagaatcaaaagtttaaggtaatccttagctatgtgtaccttgttaaaaagagagggagggagggagggagggagggagggagggagggaacatagataatctgtttcagagttggcagctcagcttacgttggaaccaacactaacaagcttgcttgattttttttttttattcctatggacctgttaatcattatccataaaatgcagacatcactctgatccatatacctcttgggttgctgtaaagatagatatagacatgaaatagcttacagagctctctttatgctaaaccatgatgactgtacagtactgttattctctccatggcctcactaggtagatatgggtgaatgaagttaacggtgtcactaagggcaaatttgtatgagaaagtggctctgtaaagttaggtttttttgtctagcaactattggggtggggaaaacaggcttacttgccttaccttaagagtagttgagagagttatgtaatataaaatttatgtaaaattacacacacacacacacacacacacacacacacatatatatatatatgaccacaaatacatacgtatatatgtacatatattttgtaacttacagaaacttttttctgttatattcacagaacattcacacacaagtatatgtgtgaatgtatatatgtatatgtatatgtatatgtatatgtatatgtatatgtatatgtatatgtatatgtatatgtatatataatggcttttcacagcaaggcaacactcattgagatctctgggtaagcctatttccttgtgactccagcagcacttgtataatgtcagagttgctgttattttaataactgactctctttcccaccccaatggcaggcaggcaggctaataggttgattccctgctatgctacatagaatggaaattgaatgagagaaagtagacatttgttagcaagtgttttaatgagcttcctgtatacagagattttactctgcttggagctcccagcacagaacagatggaaaactccctccagaagcactataaagaagacttaaatctgaatgcaattacagtgatatatttttataactaaatgaatatggtagttacctttctttcattgacacctatttcttttagattccagcgaatatcttttggccctcaaagcctggggattgtgttaattatggggtatcctagagcagaaaaacaagtttgggccagccaaattcttttctagctaaccatatgaaatgtgattggtgttttgtcaaaactcagtggttgactccctcctgccattgcccctttgctctgaatgatgatactaaataggtgatgatgtggttcctggtagggagagagtcaatccctctgggcactgaccttttcttctgaatactgatgggaagtgtgatagcgtggcaccaggaggatagtctgtcttccttttagagaggagctaaccctgtcctacagtgtggaggtcactgtgttctcgaatgggatcaagagctacagaaggaagagtaagggaaagggtaaaaatggtaaaaacaaatcatgcctggtccgggatgtcccacaaaacaaagcacatcacagttttaaaccaaagaaaagtatttcagatgataaaatgatacttgcttctttctgcagatgatgaaaaagttataggaggagtcacagttgccatagtcatagatgtcatggtgaaacaagacaaaaacaaaaggaaactgacattttatcacacattagaaagtgtataagatgattaaatgacactatctaataaacatatacaaaatcttctgagattagtatttctattatcctatatagagtagaggaaactgagcccacttgttgtaaaggaggcttgtctagcaatatattttgattttatgctcatttttttaaaaatccattttcaattttaatggaattttgttatggtgaagttaggctgtcatcccaggagttccagagaacttttcttcctttatattatccttaagaatttgtacttagaacatgttctgggtgatatgcgcgcgcgcgcgcgcgtgtgtgtgtgtgtgtgtgtgtgtgtgtgtgtgtgtgtgtgtgtgtagtgtaatatatgtggacagacaccaatatattaatatagatctgtttctctccttttcttaactcatccatcaagtgcactagtccttcttgccatatgacttagttgagacccatggaactatatcctcaagaaatacttgtcttttgtcacagagatgagactattctgagacttcctatcagttacgtgcgcaaacatgactcatcatgttcttttccgtagggctttttcctctggtgcctctctcctctcctcactcttgacctgacctgtcctgtccagctccgaggagtgcacttttctgctgtagctgattgcattcttctgctttgtttttttgttttgttttgttttgttttgttttgttttgttttgttttgttttgttttctagtggtcccctgccttttctgaacacggaccgaggattttctgttttgtcctcggaaatccactgcttctgaaagaagctcttctttctcagaataattcctttcctgtccttagatgttagacttggcatttctctggaccttccagtagagattgctggctctgaatgtgtgtagagaatatttgaatgctgtattcatcttcaagaaacgaaggtcttggggaagaatgcttatgacagacatgagtgccaagagggactaaattttccctgcatcccagtccaagaataaagaaggtataaactttccattacttgccctgtctttccctccttctgttattcagagaagcacaaccagggcagctttgaataaagctcatgtaatagtcagaaacttactttctgggactaccattgccacccacatggtacatgaacttaagcagagcatcatgtgggcacctctactatactgttgtactgaaatttcctgaccatacatatatcatgtgttaaactaacagcttcctgaaggcaggagtcatggctttgccatagtcatttagaaaactgctatgcctaatggttctttctgatccattctgtcaccaccctgcccctcaccatccaggttccatactatccaaaagtttgggctttctacaatgcaaatgcattatgccacttctctttcacaaagacttcagtgcttccccactgcatttaatgtaaaggtatgtaagacccaccatgatcaggactgtggttcccttcatagtctgttcttttagcatctgcatttcatgttttgttcaccaacttcacaaacacttatgttcatgtttacccttggccaggcacttgaggtacagtgatggacatagaccttgtctacgcaggagctaactggttttcttttcttctggctgactgtcctataaagcactgttgaagactcttcctccccaggaaagccatgacccatgttccatccatcttccttgcccttcttctacctagtttaggttcttccctttcctatgcccagagtacgccaatcatactttcacctctgcacttttgtgtattaattttttttctctccaccagacaaaactctaagagtaagatatcctgtaattgtattcattcttttcttgtgcagtacacccctacagcaacttcccatcatccttactcctccaagctccccctcccctgccttctcccctagatccattactcctacatttattttccttcaggaaagaacaggcctcccagggataccaactgtaaatacacaataagttacaataagactaggcacaaaccctcacatcaaggctggatgagacaactcagtaggaggaaaaggatcccaaataaaagcaaaagagccagagacacccccattcacattgtcaggagttcccccaaaacaccaagccaacaaccataacatatgtgcagaggacctagcacaattgcatgcaggctctgcaattaccatgtcagtctctgtgaataccccacccccaccccaacccccatgagtcgcatttattagttctctgggccttgctctcttagtgtctttgacccttctggctaccacaattctgcctccccatcttctgtgggggtccctgagctctagggggaggggcatgatggagacttccaacctagacactctgcctaatgtttggctgtgggtctctgtagcagttcccatcagtggctggaggtagcctcttttatgatgattgggctagacactgatctctgaatatcattatgaatgatttcctaattttttttttggccatgttcagttttaccctaggtttctgggctaccaatcctccagttcctgatcatccaggcattgtccagcatgggtttcctctaatggaatggccttgaattagaccagtcacttgtttggccactcttacaagttctgcactactattgcccagcacatcttgtaggcaggacagattgtaggtggaaggttttgtggctggattggtgtcccaccccaccacttggaagcctcgcctggctatagaagatggccagttcaagcttaggctccatatcccccattactaggagtcttcactagagtccccttcatagattccaggcagtttccacttcactcggtttctatgtcccccccccatatgccctccaattccagtcatctgtccctatactttatccctccatatctcttccaatttgatccttcctctttccatccatactatcccccagtccaccagcaaaatctattctgtttccctgtcccagggagatccatgcattcccctataagcctccttgttacctaagctctttgtgtctgtgggtcgcaatataattatcctttgctttataggcaatatccacttataaatgaatatgtaccatgtttgtgtttctgggttacctcactcgggatgattttttttttctagttgcatccatttgcctgcaaatttcatgtcattttttaaactgctgagtaatattccattgtgcaaatgtggagaaagaatttttttttaaccaactccacatctgatagaaggccaatatccaaaatatataaagaactcaagaaactagacataaaaggaaccccaaacaatctaatttaaaaatgtggtacacatctaaacagagaattctcaatggaggaatctcaaatggctgagaagcccttaaagaagtgttcaacgtccttagccatcagggaaatgcaaaccaaaactactttgagattccatcttaaacctgtcagagaagctaacataaataacacaagtgacatcttgttctggcgacgacgtagagcaagggaaacatttcctcattgctggtgggagtgcaaacttgtatagccactatacaagtgggatttgtatggtttacaaatgggattaatatggttgttctgtagaaaattgagaatctatctcaagacccacctctactacttttgggcatctagcaaatggatgctcccttctactgtaaagacgcttgcttaactatgttcatagtggcttcattcataattgccagaatctggaaacaatctagatgtccctctactgaaaactagataaataaaatggggtatataagcttcttttgttttatacccagcacatggcttggtactagcactgttaagaaaacgatgattaagtaaacagctccccctggtggctaggttttcgaagtatagtttttaatgccccagaagggtgaaccagttaccctggtaaggtaattttttctttcaacagtaagaaaggaagtattttaaaatatgtggtctcctaaaacctatgttgttatttagacatttctccgttttttcatatttcagcaaacaatattgagatgacaaaacagatcaaagaaaacaattttgagccatcttgtaaaaagaaaatataagcgctatttgtctcatgtagtgaaaaaaatgtaacacggcacagttctccttcagtatccatggaggattggctcagataccaaaattctcagatgctcaagtccctggcatagcaggatttagtatttgcatataatctaactatatccttgtatatactttaaatatttgcagattacttataatagcacagtgtagcggctatataaatagttgttgtactaaattgcttgggaataagaccaaatatctgtacatattcaatacggatgccaatttgttcagatatttcaattatgaagttgattaaatccacaggtacggaacttacagatgtgaaaagctatctgtataggctttgttcattatatcttgacttcagagtcaacacagtcattcttattcgttgactgattcaactgatacttgtagctttacctacagtatgtcaggcactaggctacatgttgtggattcagttgtgagcaaaacaatggccccaccattaaggagcttgcatccaagttaagaggcacaatttttttgtttgtttttgttttttgagacagggtttctctgtgtagccctggctgtcctgggctcactctgtagagcaggctggactcaaactcagaaatccacctgcctctgcctcccaagtgctgggattaaaggcgtgcaccaccactgcctggcaaacatttttaaaacatattcttattaagaattatgactggtataaaaataatgaaggatgcagaatgatatatgtgtggagggagaggcatagaacgagagacacagaggaagagattgagattatattggattcaactattttaccagacatttgtaattgttagagtttcagaaaactacagaaatgtctccctaggcatgcctaaaagcttataggaactctagagagtttccttttttgtttgtttacattttgacttgggaggaggcgtatattttgtcatgtatatgtattctcatgatcactactggaattaagtcattttgttatctccccttcaaaatcacatgtgctacctccttttaaaaattagatttaggtatttatttctactttatgtgtatgatgttttgcctgcattcatatctgtgcacagactgcatgtctggtgctcacagagaccagaagagactgttggaacccctagacccgacattacagatggttgtgaatcattggatgtgcatggtggaaactaaacctgcaagagcagccagtgctcttaaccactgagttgtttgttgaaccccatgtgctaccaatttgtagtatagtcacatctgtcttccttatagccactggtctgttcatcattataattttgtcatttctgtaatgttttgtaagtagaatcatatagtattcaaaataattatgattttctgtgtcacttataatgcctctgtgatccattcagcttgtatcaatagttttgttctatgattttatatggttgggagggcgttctgttatatgaatgttccattgtttgcttattcttgctctcagcagggaatatttcggttgtttccagctttggggctattatagtagttcatattagttgtgtgtgcacgcttgcataaatgttcttatttgtagagtaaatgcatagaggtacaagttagagacttgtatctccttgtgggtttgtaaccagttactgtgtagtagagaagtagtgagtgaaagaacaccagatgagcagtccaaacacagctccagagtggcgtttaatacgatgttggatgattctgtcctgtttccagaactcacaatttagcaatacagtgataaggttgaaatctatgaggtttttcagtctttttcaaatctaatctgttcatagttctgatgggatatgtatgtgtgtatgtatgtatgtatgtatgtatgtatatgtatgtatgtattgttttgttttgttttttgggtgttttgttttgggtttttgtttgtttgtttgtttgttttgttttgtttttttgagacagggtttctctgtgtacccctggctgtcctggaactcactctgtagaccaggctggcctcgaactcagaaatctgcctgcctctgcctcccaagtgctgggattaaaggcgtgcgccaccacttcctggctgcatgtatgtattcttacttattcactttacatcatgctcactgcctccatcccgatcacccctgcccatgacccttcccccattccccccacccttctcttctgagcccaggggctcatacttgttatcccacagaccctggcacatcaagtcgctgtgagactaggtgcatcctttcccattgaggccagacatggcagcctggatagaagaacatagcccatggataggcaacagcttttgggacagtcccccgtttcttccagtttgggacccacatgaagaccaagctacacatttgctgcatatgtgtagggagtcctaggtctagcccgtgtatgatctttggttggtgattcagtctgagagccccaagggtccaggttagctgactctgttggtcttcctgtggagttcttatcccctttggggccctcaatcctttctcttgttcttctataagagtccccaagctccttccactgtttggctgtgggtgtctacatctgtctgagacagctgcagggtggagcctctcagaagacagccatgcttctgtctgcaagcagaacagagtatcattaatagtgtcagagattgatgtttgcacataagatgggtctcaattcgggccagttatcagttggccattccctcagtctctactccattccccattcctgcatttcttgtagacgggataattttgtgtttgaaagttttgtgggtgggtttttgttcctatcgctctactggtgttcctgcctggcaacagaaggtggcctttgaggggtttttatttttaaagtaggtctctacctcatttcacaaagaaaatttaattgtgtacatacataaaacactagatgcaaagtctaggtcatacctttcctgctcttttctttcatgtcctgagcaattgccttgtataaaaagggcatattgatggaaacagatgcagcagcccacagccaaacattaggtggagcttgagaaattctgccaaagaaggggaggaaagattgtcaaagccaaaggggtcaaggacaccataagaacatggcctacagaatcaactaatctgggctcacacagactgaattgccaacaagggagcctgcatggaacagaccaaggcactctgcacatgtgtaacagttgtatagcttggtcttcttgtggaactcctcacagtgggaggaggggctggctctgaccctctatttatttatttatttatttatttatttatttatttatttacatattttcctcaattacatttacaatgctatcccaaaagtcccccataccctcccccccacttccctacccacttcttcccatttttttggccctggcgttcccctgtactggggcatatacagtttgcgtgtccaatgggcctctctttccagtgatggcagactaggccatcttttgatacatatgcagctagagtcaagagctccggggtactggttagttcataatgttgttccacctatagggttgcagatccctttagctccttgggtactttctcttggctctgaccctcttaactgcctttgtgacactttccttctactagtttgcctcacattgcgttaataggagaggaggtgcctagtcttcctgtaacttgatatgccatggctgtttgatatccatgagagacctgcccttttctgaagagacacagcggaggaatggatgggcaggggagagggtgagtgtgggaagattgggaggaagagagaagggaggagaagctggggtaggcttgtaaaacaaataagattattaaaggggtcacattgagggagacattagctaacttgaagactacaaaggtttcatggtctgattccgggaaagaaagttctccaaacccagcaccgaaattaccatattcaattgttctagaaaagccattcctaaggcaggtatgtggagcaaactggcccttccctatattgtcaaagatttttggtaggtaggcaagggtaaaataagcatgtgtacatcaattacattttccacatgtgggatgtattgtattttcctgtcaaataagaaaaatacacagtgcttacagcaattaattctagaaaatgtggttatcctgagagcaatcacttcacttaacacgcgcgcgcacgcgcgcgcgcacacacacacacacacacacacacacacacacacacacacacagtggttaaaatcagacatgtacagctgcctagtttaaaatcctgattttgactctagctgtatgaccttgtacagatgtctacaacctctgtgcttcttaatttctttttcagaaagaataatgatggtgccttccgcagagggctggtaggttaaccaaagcagctaaaatccacgaggtcattagaaaagtgacaagcagcacaaagtgttaagtattgtgtatctgtcccataagctgacaggaaatgtgtctcttagtcaatatctgtctggtgctcaactcattagcattcttacaccactggagatggcttagctcccattccccacttgcttggcttcaacaactatttcacatccatatcctaatgtctcatgtcacttccttgccaacaaacaaacaaacaaacaaaaaacaccaaaaaacaaagcaaacaaaaaaaccaccaaggacctatggctgttagaattgtataactttgcccaagtaacctttgcctctctcctagggtgtagttcccccaagggcggggagctaaagatcatattaataacttcatatatttcttagtttttaaggtggccaccttttcccaaatcaaaaggaaaacaccaggtatattggagaaagtcctgcttccttagttgtttttatgtaaatcttcactactgtctttgaaatgttgtggtgttttgaaaacaacataaaagatctctcttcttccctgtattcctttgaacctagcagctgtctgcggggaggtgctggcgctggccatgggggttgtgtatgtatgtccttaaagtgtgatctggcttaacaccttagctttgatgctaccacagtcagtactatgtctgcttcgtacatattgcattttcttgagggcatcattgtaaaaagcaataatgttttgcagctttgttcgatggcagagctgttcataacagcttcttggtaattcatcagctgcccaatttacctctccctttcccttctcagctcccttgcacagaaagcaactgaatgtgaatgacttccaacttaggctcttttgtctgatgttatggagtgtgagacgaaggagcaaaacagtaaccgacaaacaggaaatgggagtttgctgtgtcctctctcacttctttgggtcctgtgcctattttctctccctacatgctttgggtgttactataacaccaagatcctgattcaaaatggcagcacatatttccatagcatatctgcaaacttcatgggtttcttttgtgtatataagcatgtatatgttacatgtacatgtatgtacacatgtcggggtggagcaagaggctggtattggctgtctccatctactcctccttgccttattttttttaatggggtctctcacagactctggaacttatcagttcagcaggactagcaggccagtgagatccaggcagcttcatggttcttgttttttctcaacactagccctgagagtgcccaccaccatgcatggctttttatgcatgttctagggatccaaactggggtcctcattcttgcatggcaggcacattacccacaaaatcgtttccccagttccgtttctttctttaataaaacatagttttgctttattcctcatggtgcccttaatctcagaaacctcctgcctcagccttttgagagctccaagtataggtgcaagccactttgcccaatttgaaatctttttaaaacactgcctctgtgtgtgtggtgtgtgtgtgtgtgtgtgtgtgtgtgtgtgtgtgtgtgtgtgtgtgtgtgtacaggaacacatgcctgtatgcgtatgtgcctgtggaggctagcagaaaacatctgaatgacctttctagtttctctacaccttctgttttggagaccatggtcttattgctgaacctggaacttgctcttttggctagactagttgttggccagtgagctccagagacctctgtctgtcctttccctgctgtattgggatcacgggtgcttgtggatacacctgactttttgcatgtatgttagggatctgagctctggtcctcatgcttatgcaaaagcagtttactcaccagactagactgtctcccgatccctgcattgctgcttccaaacttacttcactctgttgcccgggcaatctgatctgcttcaccaggcacattctctcctgttcctccctatacctttactttctaaagaaagtaaagtaagtatctaagtattttctaaagaaagtatcatatcattctctgcctgggcttctctccctttaaccccacttctttttttttttccattttttattaggtatttaactcatttacatttccaatgctataccaaaagtcccccatatccacccacccccactcccctgcccacccactccccctttttggccctggtgctcccctgtactggggcatataaagtttgcaagtccaatgggcctctctttctagtgatggccaactaggccatcttttgatacatatgcagctagagtcaagagctccggggtactggttagttcataatgttgttccacctatagggttgcagatccctttagctccttggctactttctctagctcctccattgggagccctatgatccatccattagctgactgtgagcatccacttctgtttaaccccactttttcatgcccaactgttgccagatcagctacagaagacattttatgatcttctggcaaagctagatgcttcctggtgtgttctcatagggctttgatgtatttcattgtataacttgagcgttctttaaattctaattagttgtattcacacttcattctttctactaaacattaagtgccttgaaggcagaagctgtgtttttcatcattatattccactccttgtaaattgcaggcactcactttgcagaaacaaaaagttctccatgtgatctttaatgctgggattttagaaatgtctaggtggaaggtgatgatctatttgagaagacagtttcttagttggcattgacttgtcaagtggaagatactgagatggaagagccagaaagcagtctgggtatctgggataatttatcagtaaataggtattgttccacctgaaccagaattcttagtgccttctgaactcctgcccaactctctataggatgggtgatgtgaggatgaggaggaaggtgtgggtaaggacatttctcacagaggcagagagaaggcagacgcactttaaacacaggaataaaacaaagacttggagaatgagatttccccttaaaattgtccaatgcatttgcaatggcttattgatcattagttgagaggttttagaaacatcaaggagctaagcctctgggcatgcctgggagggattatctagattgagtttattaaggcgggaagatccactctaactgtgggagggatctatgtggagtcttacagtgaagaaaaaaggagagcgcccgcccgctgagtaccagcgcttcccattcttggtttctgattgcctatggaatgtagctagctgtctccaggtctatctgctgtcatcctcccacagtaatgtacactggaactttgagccaaagcaagctcttccttcctgaccttgcttttgtcgcttatgtggcagtagcaaaagaaaagtagttaatacaacatctctgaaaggagctaagggtctaggccacttacattccaatagagagtttaagcacttggccaaaataactatttacttcaaaaagatctttgtaacctatgacatttgtgaacaccccatgtatttgtttccttgcagtgactatcagtaaaaatcctctcaacaaaggagctgttgaaaggtaaacagttgacaagagtagatcttactttacagttagtcttggagctgagacagtctcagcagtagagtgtttgcttagcactatgaggtcttaggtttaatcctcaccactcaaaaaggaggcgtggtatatggctggaaaacaatatgcaagtcaagttcttgctgcaattgaaaagaaaattaaacaacatggaaccaataagacctggggcctggccagggccgcctgggtacctagaaaatagtgaggctaagatactttgtcttcagtatcatggaatgctccccaaaagctttctgacgtaggtaagttaacacaggtttgcagaattacctcagtggtatcttcaaggaggataaatgtttaaacacaaaatttagtgtaaatttatataaaatcatttagccaagcccactaactcgaaacaaagtccaaagaaagaactggaggcttccacacaccgactaatccgccaaagacatttaatgagacaacctgagtgacgttaaatgaagggttaaaatgtaactgaagtaaccttactgtatattcaaataaaactgcaaacaaaacactggcctttcaaatgccgtccaagcaatttgagttgttttattcacatcatgaagacagatttttccctggagtttttcctgttcagaaatcatttcaagaccttgctcttctgggctgcttcttgacatggaaacattttaatgtcattgctttagccttgatttggagttttgcctcttcagccaactttctgctctactagttgtgcttggtgtgtgtgtgtgttattgctgttgttttaatgaaatggctcccaatctgtccccatcctaggttccacacttcaacctaaattttctcaacaaaatatatttacgatggcataactacatacatacatacacacatatatgtatgtatgtatgtatgtatgtatgtatgtatgtatattactgggccaattctattagcaaatgttctgtaagtaatcattttgcacaaggcattgtgccaggcacagtggaaggaacaacgcagtggaaaaatctcttctcaaggagcttggtgtttaattgaagatttttgagcaaagagtatattagttatgtttcttgttactgtgacaaaatacctggcagaagcaatttaagtccaggaaggttgattgtggttggtggttggagagaagaaagggcagcaggaatgggacagctgctcacactatgtctgcagtcaagaagcagctcactgtgtcctttaattcaatctaagactccagaccatggcagggggctgcccaccctcatgtcatgttgacaatgaaggctatcatgagatgattcctcatgtttgacttgtcctcttcacttcctaacaagttccttaatcctccttaagtttgttattagcccatccgatccaatgctacttcttcattaaaaaaaaaagtcaactgaggacttccattatcttgctttcccttacccctcaagaacatttgatggagaggtggttcagtggttagtctagcgtgttgctctttcagaagactggagtttagtcttgagcatttatggtaggcagctcataaccacctgggaccagttccagaggttcttacactcacctctggcctctgtgtgtgtcccgccagtgtgcatggacagacacagtcacttatgcacacagaaagttcttgacatggactctcattcaatccttgtttgattttaaatttcttccttctttgaaatcgccaactccttcctttaatgtttaatagaaggctcatctcattctggtatgtttctcacttgctcactgagagtgccctgttttctttcaatttctgtgtttatagttggcgtgactcagttggtacttatgctaccttgatttgtttctctctctctctctctctctctctctctctctctctctctcacacacacacacacacacacacacaccatcctttctcatttagattactaagtatttgaagacaaggccttgcgtaatgcatcttacaaaaagatgcttaataaatgtatgatgaagaaggcaaagaaagagttttgggcctgcatggaaaagacttattttgagaacagagaattcagttaaagaggccttttgaaaaatgtgtaaagggtcataaaggaattaatgtattggcaacttggctcagatcctcattttattactagaggaactttagggagatccaaatgacaatagagaagggctttgggactattgagaatttacatggactattagggacaagtttgctgcgagactgtttttagtgatctcagatgctatataaagtcttaccaacatgactccccgaggtagatgagagagaagactatatggcctcaaccctacacgatgaagtacaggcaactaaggaactctgagattgggagaagtagtctttcccagggaagtacacatcagttgccaaattatcagccctgaaaatatacatacaaataacatactgattgagcatattgtatttaggaacacacacacacacacacacacacacacacacacacacacacaagcatataacaacaattaatgaaaaaagaggccatggatttgaaggcaagtagatgtatgagagaggtaggagggaagcaaagggaaggaggaaattatgtaattgtattaaaatatcaaaaataaaagaaagaaaaaagctttttttaaaaaaaatagttactaaatccaagtaactgtaataacattgttgataaaagtgagtaaatcagaagtggatagtagatatgaaggaaaaatggtttcattattagatatcatatacagaatttatactaacacagagaaccatttgcacatattaaaagagcagtaggagttgccgtttttaggattatcatttcgttcactccaacagatactgacataatgtctaggatgcatcgttcactattctggagatagacaaagcacaatctctgcctccagacttcccgtttaagtggaaaagactctaatacaattgcagtggtatgaaatagcaagcagtattactgaattatatggaaagtgttatgtaaatgtaagtaggcgagtgactgattgtgtagttaccaatgaggaaaaggtaaagaagagatgattgcagagtttgccttggaagataaatagaagtttgctcaatcactgaggaccctgccctgccaaataagaggataatctcaggaaaaagcatcgcacaggcaaaatcatggcattttagggaaacaataagacgtctaaaatgattaaggaaaaaaggatgtcagaataaagatgggcagtgcaaaaggcatggtgattatcagaaactaaacacagacgttgttacagtggacccgagaggaaggatgtgttaaaagtgcgctgtctgagtggatccctctggaactagtcttgtctctctcactcctaactgtgtaggcttcaacgagtcacttaatctctccgggctcatgttttcttatctgctgagtggaaacaatgataccttccataagagattgtttgggggattgaaaggtgataaatataatagattacactggtgcctggcataccacaagtgttctgcaaaggttagtccaaggactaaatgacaagtaacaaggcacggggctagtctctgctataccagtagctgcctgaaaaagaaatctaatggattatgtctatgtttccagatctctaagcaatgaccctgggagaactaggttgctcttttattctcagaggaatgagagttccttgagatgatatgatatctactttgggaaagtagagctaacttagggaaaagcagaggagtctgagaaaaaacaaccatggagaagggccaggggaactgttcatttagaataaataaaagctgtcattatcgcatccctcctggaaaggagtcataaagaaaagtaatgttgccattaagtggcagacattttgcttagataaattttataattggggctgtgtagatggttcagtggttaagagcactgtgtgtgtgcacttgcagagaactcttttcagttaccagatgctacatggtgactcatctagctccttgagttttgatgctctcaagaaaaccattgtctatttatcggctttctagagttctgctcaagtggtccttgaatagactcttgggatgattgttcttctctgggtcactgctccatgtgttgctgaaatggaggtgaacctcatttgacagttcctgctgacggtccttctcagctaaccttgggattcatttaactgacctcagtttgaaatatgccttttggtacttaattaagcattatgacaagttactcaaattctcaaagcctcagcttctgcatttgtgaagtgagaaaaattgcttctgtattaaaaagttacaatgatataatgatattttaatacattaactactgctactgtagtgcttggcatgtcgaggtcttcaaagatgttagctcctcatctcttctttcctccttatatcttgagaatcccatgatctcctgaattcattttagcatgtcctggggactttgtaccaaccaatattaccagttgaggaaaggaggtgaagaagtctgtccatggaaagacaatgaatagtggctttttattcaactcatcctgactttgtggcagagatatgctgatgtagagacagtatctcaaaataggaaaagtatttagatattggatagaattttttctctaagccaagaaatatgagtaaaacattatgacaactatgtgaaaaatatctacacattcatgtttaatgtaaaatctctctgcacattcacatatttaaaatcagaaaactgaaaaccttttaagacagaaatatgttattgcactgtaatcttaatatcattgtgcctttggaagaggctcttctttccttgagatacatgaatcttcttgccttctttttgaaagaaccacaggaggacaggttgatggagtacagggatttgcacagtgggaaaaacatgtccccatctcatctgtccttctgcccagccttccattaaccatcatgacctaccagaggcctggagagcttcctatctgtggtgcttcaatgcctttgcatcattaatatcatcatctctactcttcttctaggagtggatcttatcgagggaggtatggaagaagtgcatgtttagctgtcagtccgatccttttagagccagcaggggacaaaagcaataatcattgtgtaacactttggactttcttggcaggtgaatactgctatgcatgaggcaaaacttatggaagaatgtgacgagttggtagagatcatccagcagaggaaacaaatgattgctgtcaaaatcaaagagacaaaggtaaaccacagtgcttcagtgaagccaaggtgcagtgacttttcacaaaagtcagagttcattcctgatgattgcagtttggagttgaaaaataaaatcaaaaggaaataaggtcatagggagagataccaagaagtaatgtttggactttcctaagagtctgaaaaaaaatggtggcagctctgggtgatgcaaacattctatacctcgacctggatgctggttatgtacgtgtgtgtgtgtgtgtgtgtgtgtgtgtgtgtgtgtgtgtgtgtgatcatttacttagtatgtggatgatttactttagcatgctttaggttttttgtgtccattggtgttttgcctggatgtatgtctgtgcaccatgtgcatacagtgttcttggaaaccagaagaggctgttggatcccttgaggctggagttatagtcagttgtgagctggtatgtgggtgttcttgaaaagaaatcgttactcttaacaactgaactctgtctctagcttcttctctcctatattttaaggtaatgaaaacaaagaaatgatggtagaaacatgaatctggttttcagaagaaatatgaccaacttacaaaaagtgttgtgaaactattatgattctgtaaaaggatgcattctgatatagtagaggtatgcatggtagatcagaacatgatgacattgaagccaggaaagcttggagacctacagcgatttctggtatgagttatggaagatgtaagcctgactaatgatagaacatggaaaggaaaagcataataactgatagagagaaaatgatcttatccaacttattagctacaatagatgaaatagagccaagtcaaagaactgcagatttctctctctctctctctctctctctctctctctctctctctctctctctctctctctctctctttctctctctctctctctctctcatttgtttgcttgtttgtttgtttgttttttgaatcagggtttctctgtgtaatagccctggctgtcctggaactcgatttgtagaccaggctggactcaaactcacagagacctgcctctgcctctagagtgctgagattaaaggcgtgcattatcacccagctgaatggcagatttctaagcagggagctaaagagtaagagtcaaaggcatcaggtgaggccatgcagcttctagatgtgtctaggctgctggtaaatgataatgattataaggccatggtaaatgtgtaaagttatagggctcacttaatgatcagtactttgtgtcatactggatggttggaagtaacaatgagctgaagtttccaaaattacatcgtggtaggtatataggcacttagagaaatatatacatgtaaatatagctactcataaataaaaatgaggtacttttgttaaatatatgtaaaaatacattgccaataaaatgtaaacaataatgatctccaggtggtagaattgctttttacatttgtgtttaaatttttctataattaacatgcattgcttttacaatcaaaacaatgttattgaatctgtagataacagggtagatggctgaatgcaatgtaagtgaacaggttatactttggacaagagacttagcaggcagggtgagaaggtgaacagttgtttcggggctcatgggatattaattaccgttatttttagaatcactacggcagatctccttcatgttgttttattgtttttaattaagcgcagtatgttttatgtcatcttttctcctaccaattctcttaaggttatgaaactgagaaagttggcacagcaggttgctaattgccgccagtgtcttgagcggtcaacagtcctcatcaaccaagctgagcatatcctaaaggaaaatgaccaagcacggtttctgcagtctgcaaaaaacattgccgagaggtatgtgtgctcctgatgttcttttgaaatgcctgctcttgtgcaaaggggctggcataaagtcacttaattctcttcaggcattgtgtagtagctgccacctgaagatttttaccagctaggtaattattgagccttagtgacaaatcaccctgcagatttctggacccctttctctgtctttgctgcctgccagctcttttaatgcatagccaaacatagggctacctcctgccgttagcttcctgctaggtcttgagcaatctgtgatagttgtggtgtgtgggaagacaaactccgggctacactgataggatgtgcctttcctaagcctatgcatggttttacttttttgaaatcaatttcgcccccactatcttgcctccaattcctctcctatcccccatgctaattttttctccatacttcacgcgaccgacctccctccctctctctctctctttctctctctctctctctctctctttctttctttctttctaccaaacccattgagttcatttattgttgtctgtatgtgtgtggatgtatgtacagtttttgttgtttgcctttagctttttcttgcataaattccttagagaagtaattctttggcttttgcttaatctctttgtcctttgaaagttaatgtcatgaaccttgtatcagagaactcatgaatcattaataatcaacctattggcccagagtctatgctctaaagtaaatcattacccaattagtcaccaattattcaaggggctacagtaacccattagtccagatatggtcttctttacatattcccctctcattcattgaagacttgtttttaagctcatgatcttcccattggtactgccatcattttgagtgagttcacttggacagctaacctatgtaatatgcttacctagccattcaccttctctgacatcttctccagagacttccaactcaggtcactcacttcctaggcaatcatcatcattgtcatcgtcatcatcatcatcatcacttaaaatcacagccataagttaaagcatcacgttttctaaacacagcctctttttaaattcaaatacatcttttctttattaagttgtattatttcctatttttactagtgacctatttctactttgttctaagtttatttgggctttatgacttattactccagctattatattttcctaatcccctttcccattgcccttttactaatcaccctgacaaaatcctatacctgagtcagcccaaccatctctactctttttcatgcctatatttcactttcaaaactatggtaaagaaaatttgcacaaccaaggatgaatcacagtacttagtgcaaagtactgactagagtaagttggttgggttggttctataactaagacattgtgaatagtgctgtaataaacattaatgtataagaatgtctatgatatggtgacttggagtgttttagttgggtcataccaatttttacttcttgagtaacttccatgttgatttccatagtaatttactagtttacattcccactatcagtatataagggttttctcttatccacatcctggccagaatttattatttctttttaagtggatactattctgacttggataagatggaatcacagtgtagtttttatttgtactttttgatcgctagtgaagttgaacatttttcatgattattgctgcttgcatttcatctttctatttttgggattaatggtttgtatacatgtatgtattatgaaggtgaacatgtgttttcctactcataattgtatgtgtgtgcatgtggcaagaaggggacaaccttaggtgtcattcctgagtctccatccacttggtggttttgagacatggtctctcactggcctggaattcaccacgtaggttagggtatctgggtactgtgcctcagggatctaccagtctgcctttccagcactcgaatattaagtgtgtgctaccatacctagatggctttttttaaaatttgggctctgaagatattctagatattaaccctctgacagataaaaagtgagcaaagggttttatcctagtctgtctatctcttcactcatttaactatttcctttgctatacaagttccttttaattccatgagatcccatgtatccactgttcacattatttcctgaatgactggtcaagttgtactacagagccatattaattaaaataactaacatgattcctgactaaaaaaccagaaacataaattaatgaaattagaataaaaaattcaggtattaacctgtacaactgcagctacccgatgtttaacaaagacaccagaaatacatattggggcgaaaaagcagtcttttcaacaaatggtgagttgaaaactgggtgtccactgtagaagaatgaaactagacccacacctctcaccttgcttaaatcttatcttcaagacctgtgacagtgaaattgttagaggaaaaggcaggaaaaacatttccatacacgagcaaggatacgatattctgtgtctttgagacaggctctcagttttagccccttggcatggaacttactctctaccccaaactgtcatcaaatactggacaataatcctgcctcagccccctaagtgctacgattatgggtacgaactgccacccttggctttcttagttttctttctgtcttgctaataaaattaaacttttagcacttgcatttttatttccaagagtttcctttttaaaatcttctattgattctttgagaatttcatacagtatattttgatcatattcaccctctctccaaacttttctcatagtcacctccacctccttagctacccagctttgtgtttttttctttttgttaactgatcatgtacagtttgtgctacccagatagtcttgaatatgaggcctgccatgaaatggagttgatcgaccaggggttacactgttaaagaaacctgacaagccctttctcagcagctatcaaatgcaaatagctcctcagctggggctgggacttcatgcccatcttcccttttccattctgagatttttgtctgtactgagcttacacatgccttatgcatgatgttagaactgctctgacttcatttgtgcaggaggccctgttgtgcccagaaaacagtttgtttgaagtgcttcagtacttcagactcttaaaatttgtatgcttacatttccttgaagatccatgagccttgaggagaggaatatgatataggcatcccatttagggatgtgagtctctgtgttgattgcttgctgtctactgctagaaaacatcatatggaaacttactgtggtagcatatctgtctgtttgtctgtctaccaggtcagtgagatctcatagatccttcaggacattacagactcttgctgttacttttggttaccctccaaaacttggtggtaagaatttattgctgaagacaccacatacttgagtcgaggtacaataaggattgggctgtcaggatgtacctcctggtgcaatagtggcacaagttctgtggctataaccaatcactgtggtttgcatcaaaggcctgcttccggagatgggagccataactggaatcattaatgagaccaagaactggggtcaacaacctgtggttagttaagtcataatcccttggagagaatttactattgctgtgctaaataagatagtattataatgactcccagtgagttattgctatgcccatagaccaatgcatctctcagccctcatcagagcagaaacttcttgatctttgtttctttcttaacattctaatcttattttgtgcacataaactatttgcttgtttctttagaaatcctgttttctccaagtttattcctttgttaataggcatttagatccataaatatgcctcctttaaaaggaatttaggaagctgggcatggtggtgtacgcctttaatcccagcacttgggaggcagaggcaggtcgatttctgagtttgaggccagcctagtctacaaagtgagttccaggacagccagggctacaaagagaaaccctgtcttgaaaaacaaacaaacaaacaaacaaacaaacaaacaaaaaaagcatttaggagacaagttgttaataaatgaaaaataatttattgccagtttagctgaaccaaggaaagatttttagattctttgagtcttttctttctttttgttatttatttatgtatttatttatttttggtttttcgagacggggtttctctgtgtagccctggctgtcctggaactcaccatgtagaccagactggccttgaactcagaaatctgtcttcctctacctcccaagtgctgggattaaaggcatacaccaccactgcccagctttctttcagtcttttctattcaagtgtaataatgctatagcaaagatgaaacagaagtcaggaaatatacatagattaaggtatcagaactgtgtgaaatatttttctaggaggcaagttcctcctctgattgggatcctagtcccagcatgggattcctggggaaatgatacgtctttgcaagtccttatttcagtcctctgatagctgaagtgagaggcccaagtatctgtggaatagctcctctcctgccaggtccattacattacttgctgtacttccatgaatacctgctaaacttttgacttccttttacattttagcactgaaaggtgctgagaagctgtgagggggtgggggcaatttgttgcttggtgaacttcactgtagaattatcaaacggagtgccagttttttattgtgggctctcaactgtcagtactgtaggtgtttctttttgagtctctttttctaggaaggaatcctgcagtctcctgcttcgagtggggggtgtatatgcagggggcgggggaggagggacaagcatataagcacagctgtcagcattctaggagccaagcagggaagaagtctgagtctttccagatttttttttttttaaataagatgtcaagattctgccgaagtaaacctcacatctcctgccaggctgaggaaaaggcaggccgtttgagtggatctggggctctagctattcttcatgcaaactttcagctttgtgtcactaaatcagcttgatgttgttggcttctccatccagctttgtctgctctgttgttggttactgcacatctgtccttttctagcttccaaacatttgtggatagtctcttcattgttggcatctatttgtttctttctctttgtctttgtgggttaaggtcatttttattctttttctttccggtgggattttaggaaagcaaagatgaaatatatatttaaaccactatatttaactgtcctgagcctgcagcctctgaaatgttgtctcccatcttcacgttattgaatgtgttttttcaaggccaccagaagaagacctcattgctaaatataaaagatactcttttgtttcatctttccctttaatcttattgtatctcagtagcatgtgtccccattgaccacttttacttgcagtcttcctgttttgtgtcataaaaattcccattacctgtgtcctttactttgatttccttttccttttttctcactctctttctccctccctctcccatctctcttcccttctccccctacccaacttctctctctgccattgagagcaggtcttccatcatctatttccttaataatactgttcttccttattcagtattagggaagtctcctctctccccacacagctttccttacaaacccattagtgtttaaggcttcagttaccatttaattacaatcaactgctctgctgatgattccaaatctctatgtaaatcttttcatggattcaaatgcatggaatagatggatatctatgtgacaccacttgaaaatcccaatagaaacactttttctctgctctctcacagaatctgaaattcatcgccatccttattcattgtattgtattaaggtaccatcacttaagataaaatgaaattttaggtgggaaagaatagtatttaggaatatagaattgtaaaacacacacacacttatacaaatacacatacagacttcacaaatggaagataatgttgaatactctcttatagtttacattcaaaataatatatcacagaatttgtttttctgttcaaaactgaagcttttaattctcaaaaacatctaagcaaatgaagattcttggggccagggactgagttctgaccctcattacaaactgcctctaaactacacccccgttcagtttattcacttgcagagatgaggactcttgcatcctaggctggactggaactgtgtggctgaggatgccctccgtatcctgattttcttttttttttttcttttctttttttaaaaaatattttttattaggtattttcctcatttacatttccaatgctatcccaaaagtcccccataccctcccccccccacttccctacccacccattcccatttttttagtcctggcgttcccctgtactggggcatatacagtttgcttgtccaatgggcctctctttgcagtgatggccgactaggccatcttttgatacatatgcagctagagtcaagagctccggggtactggttagttcataatgttgttccacctatagggttgcagatccctttacttccttgggtactttctctagctcctccattgggagccctgtgatcaaacacatgaaactcaagaagaatgaagactgaagtgtggacactatgcccctccttagaattgggaacaaaacacccatggaaggagttacagagacaaagtttggagctgagacgaaaggatggaccatctagagaattttttatatcgttgaaaaactttatttttggtggcatatggaatttctcatacacacacacacacacacacacacacacacacacacacacacacacacacttgtttcagtctccagtgctagggaattagcttacatatggtatgctgagtgtatttatagttactacatgcatgtcacttacttgctttgcaagaattttatgaagggtccaatgagatcatgagatcatttggcagttaagagcacttgctgtgtaatcataaagattagagttcatatcccaccacccatacaagctaaatgctctacccctgcctgtaactccaactctgaggtgtatggatccagaaggattttttagattgtctggcttccagtaaacatttaaaaaaaaaaaagctccaggttttggtgacctagaatatcccttgtagtccatgctagcctcaaatttgtggaaatccagctgcttgagttctggaatgacaggtatgcaacacatctggcttgtttttgtgttgctgctgttgtcatttaatgtttacattatttatttattatttatctatgcgtctctcagtgggcatgtgtaaggtcagaaaaccacttctgagagccgatggtgtgctttcactttgtggggtctggagatcacactcaggcagggaggcaacaaacaccgtgactcattgcccatctcaaggcaccgttgtttccatgatttttgaatgaactttattcgtgtgtgtgtgtgtgtgtgtgtgtgtgtgtgtgtgtgtgtgtacagtaaatcagtggattcaacccggggatttgtgactgcttaataagtcctctactcctttttcacttttgattacactcttgtgccctgtcacagacagtgggattctggaaggagacaaggcactaggatgccaccagtagcaacctgagttcttttcagagacctgcactcaaatgaagccaaggttttcgactgcaagcagaatttcagatggagtcagtttgaagcagagttggagtttatcaggaagagtgtttgacacagatttgaccttgggggtgttaatagaaaagtgctcaggaaaaggatgaaatacacctgtgagcgtcagcctgagcttctcatgcgagaaacccccttgaatgccttagtggtagctcaatataagattttggaggtttttgaaattatatacatcaaggtgtttcaaagggaacaccactcctctgtctcttttcttcgttttaataaggagaagaatggaatggctctgtaggagccttgggtaagagtgcaacctgatcaggtaaaaccaggggtccgcaggttgtacaaggctgttaagatgtgccttttactagaaatgtggtggtgattgtgagattccttaacagttgacagcttcgagaagatagtccctcatgtccctgtcctactatcctgccgcattaccacctcacttactgcttattcataggtgacttaaaaagtccactgctaaggcattcaaggggaattctcgcgtgcgacgctcacactcacttcttccactacagctttaaaactctcgttaaaatatatttatgcacattattcctttacccaaattgctccagtggcccctattcttatttttaggttaaaggctcaagtgaaatacataacatataatattccacatgattcagcttcattctttaccctttaagcctttgttaattgatcatcatgtaggccatggcttaagagtagcttctagcctggcacagtggcgcacgactttaatctcagtactgaagagacagaggtaggtggatctctgagtttgaggccagggtggcctacagagttccaggagagctcgggcttcacagagaaaccctgtcttaaggaaacaaacaagcaaacaaacaagcatacaccaaaacccaaaccaaaaccccaaataaaactgaaactcgctctggggagatttgtctttgctcccatgtttctgttagatgacgtgtgttcccacaccctccttgcattgcccatttaaggtctctattccccatgacctgtgagctcattgaacacgtgcgtcacagcaaacttgtttccttgagtacctgtagaatggagcacactgcggggcaccttagttttgcttaataacttttgggtagatgcatggatggataagtagatgagtaaaagaagattgggaaggccaggaaaaaatttagaccagttttctgacttaacattaagattgttatttatcaaatactacaaaaatagatgttcaatgtgaaaccttaagattgttttgtgctgggctggagagacggctcagtggttaagagcactgactgctcttccagaggtcctgagttcaagtcctagcagccacaaccatctgtaatgagatctgatgccctcttctggtctgttttctgaagacagctacaatgtacttatataaaaataaataaatctttaaaaaaaaaaagattggtctgtgttggccatccagttgtacaactttaatctcagcactaaggaggtattagaagaggatcaaaggttcaaggtcaccctcagctacataggaaggtgaaggtcagcctaaagcacaccagattctgttaaaacaacaaaatgaaacaaagccaaaaataaaatccataacccccatttattttgactgtcatgcaatctattccagaaacatctacggtttcagaaatagtcaaaagctattgtttgtagatctgcaacagagcatatgtatttgcccagttgctcattgccttacaaatggctcagtataaaaattgccgttctgattttattctgtccactagaacctccgtagtgtttgcaaggtaacgtttccttctatcttgccctctgtctgcacaaaggacttcattgactctgcttcagaaggtctgatacaggactaaagcctgaatatttctgtaaaagcttcctcagataagccctattaatcattagatcataagaattgctgacgtacataaaatgtatagttaaaattaggaaaaacattcatagttatggaaatagaatttaagatcagacaagcatggcttcaattaaaatttgatttttactattatgtgtgatcttgacagcctacttagcttttaaatgtgcatgcttcctcatttagaaaatggaaataacttctactatataacactgtggtaaggagaaaaattagataatttatgtaaaaatttcatttttgtgcacagtgccttatatatactaagcattccataaatgttagtattatattgtttttgtaagtcattcagttactcattcaacatttttttattcactatgtgttcaacattcttttaggaaccatagaagaagagatgggaagtaaaataggagccctattgctgtgccttaaagttagttggccagttgaacctaaagatgtaactcacctagcagagtgtttgcctagcatacacagagccttagattgaatccacagcacctcctaaatgggacatggtggcacatgtccatctttctgacccccaggagataggagaaacaggatttcaaagtaatccttggctatgtagcaagttcaaggctagcctgggatatgtgaaaattattttaaataaatacataaataggaaagaaacacttagttggggacataattatcacagtattaatgcaattagagaacaaggcaatggaatataaatatttttaaatatcaaataatgaatgatattaatggggatatactaactcaacatgttggcttgttagttagcataaaaaaagagacatagaaaagcaatcttaaaactgctcttaccaagccagcagaggtctactttgatgctgcctgccagatggaaaatgatgcagaggggaaaaaatcctgtatttacttctcaaaattaagacaggatgggggagtgtgtttgagggatgaacatatgtgtataaatatggtataactcttaattggttccttacgattaaaatggaaactgtttccgttagaaaggcagagatatggtattttcacttacaagtgatttatttttacctcgttaaaccagaaatcaaacactagatgaaggttgcaagcctattttgatgtattgatgtctttttttttccttttcagggtcgctatggcaactgcatcttcgcaagttctgattccagacatcaattttaatgatgcctttgaaaactttgctttagatttttctagagaaaagaaactattggaggggctagactatttaacaggtgtggaagagctgtgctttcctccccattgtagttagtttttcccttctgtgccctttctgtctaaagtaaacagaaaagaaaaatgtttgccgtaattttaaaaaaataataagctttttctggtacacgtagttttccagacaagatcaagtatgtttgagctggtatagtgctcgatcatgtgtacctttagaaacaattttgttttagttcatgtaacatgaaagtggacttctggctgtggctcattagcagagatcttgaccagcagtcttcaatagctgcaaaaaagaagtgatttatttaaaaaaatcaaatttacttcttataatgcatcacatgattctcctgagctgttaggactcaggattagttttcacataacaaatagctgtcagaggtggcagcctacaattgttaaaatgaccgaaataaagactaataaatatccatgaagaaaaaaaaaagatagtaaagaataatgccagcttgttcagaatgctggttgttttcaggattaaaaaaacagtcacttcttgaaacaaatctatacacaataacttttttgtttgtagccatattgttattagatcaatgcagctattacttgtctgcttcattccatacactgtaaattgattttgtatcattattcctcataacaaatctataagggggctatcatgtccattttatggtgggaaattcttattaatttgcagcttaaatactgtcaaatgtttaggaaaaaattatcttgaaataaaaacaggttgaagtccatgtaatgagaaagcagtattttgctttgctatctatagatgcatttttacaagcattctaaatggaaactggggagatcattacaataacttagtcatatatatttgtcacaaatgcatttggggggagctgaagtctcagcacatagctgcagtctggtggttgttttctattaagaaaatttcttcagagttaaggatgtagctccatggtactgtgattgtctggcatggactcaatccccatgactgaaaaaaaatatgagaaacaaaaactcctactacttctgatgagacaaagtattttcttaccattttcttcacgtttccttttcagctccaaacccaccatctatccgagaagagctctgtactgcttcccatgacaccattacagtccactggatctcagacgacgaattcagcatcagctcctatgagcttcagtacaccatattcactggccaggctaacttcatcagtaagtcatggtgtagttggggcctgtggccagagataaggaaatgtaaggaagcagtaagctgctcaagattggccggtgcgccacgaggcaagtgtttgtaagacatgtgaggttgtttagtatagactttcatagacagtgcaagctccccaggggattgtaaaacattactgatggctgataagcaagttgtgtattttcttgctgggtagccactgggatcatccctaatggtttatgtaatccatagccgttcttcaatccataccactccattgacccaaagtgccactgcttaatatttgttcctgggtagctaagtcaccaccattccatgtgagtgaatctctctctctctctctctctctctctctctctctctctctctccctctctctctctctctctctctctctctctctccattatcatgctaaaataaaattccgttcaaagaccattgcttcctttattctacctatttgtgtctatgactatgtagatcagtcttctgccctgtcattcttctctttgctacttctttgtttccagaaataaatccagtacatataaaagcatgatggagccaggttcagtggctcatgctgataatcccaacatgcaggaagttgaggcaatagaattgtaatcaaggcctgtttcaaaagcaaacaaatgaacaaacaaacaaacaaacaaacaaaaagcagtatcagtgtgccacaaagttaaagatgtttaaaaggctgtatcaacctacatgtgaggatggtttcacctactatgaactggagcaagaccagacccagtaggagcttaactgattggctgcactcagtaggatttgagcagaaaggttcccctcacttcactgggggaaaggggaggcgatggaatccaagctgagtcaaaactgaatttgagcagttgcattggcaaagctgaaaaatattattttcttttactttgtgctttgcatttatgtctctcttcacagaccagcatgaatagacttttttaaataaaccctcctcatgggctttcttttcctaattggtgaaaattcttaggcagacttctgttttttgttttgctttttgtttttgttttgacactaccgggatggagagatgaggggacatttaggagtaaaaaaaaaaaaaaaaaaaaaaaaaaaccacttgcctcttgcagctccattctaagccccttggctcacttagccatcgtttctgggcatttcttcagattatgaagtcacaagctctaaggccttacttataagttttttcttacagtacactctgtacattctagaagccagtatcaaagagaggaactgtcctttaacttcatgatagaggaagaataaacatttcccagaagttgagaacaggttcaagatctgacaaacccgagagtcctttgtaatggaaggactaaaggagttgctactaatgacaaggttatatacatcttaaccttggaatggcccttagaagataactggtgtaatcttctctttactcacaagtaaatatctttgaatgttgctagtgaggaaatgttcattgtcatgaaagcagtccatttgatttctggaccgctataaatgatctccagtgcttccgtaagggaggcctgtttctctttgtaaataacaaggacagaagaaagctgtgtgttcattctgctttgccatttgcacagctattatcccatttagtcttcaagtgctctcagccttcagagattgtactgattccatttttatacgagaaattggtgctgatgttaagttagtttcccaaggacacagaactcaaataggatgggactgagatcagaacctgtaactgtcagccttcacgcttgagttttcttaattaagctttctgggcttcattaacgaacattccatgtttctcacataacagttgctcaagtattttaggtaactcatatggcactactaactttcctcatttttatgactcaacctttttagttcttccagttgttccccatacagtctgcttttcagggccgttatcaccatgagatttgtcttacgggcagtcttctgttggtcaaagtgcttttaaaacatgcatccatcgtgtcaaaagggaatatgagtacttggaatgtgtttcagattccccagaggatatctttttttgttcttctctgaggcaggctctcaagtagctcaggctggccttcaatttcctgtgtgagagtgaccttgaacttctgggtcttctgtcaccacagcctgagtgctgggattctaggcatgtaaggccatacccagctttatgtagtgctggagatgggatgtagggctttcttcatactaggtaagccctggactaactcaagtgcatcctcagtcaatgggttatatttcttatactgtaccttttttggaagccacattgatgactgaatgtttaccgagcctataattatctgagattcccatgtgtgataagttctgtctccacacggctcaaactcagcacttttgactttctgcttatgacattttgccttgtcaccttgattctgcatcaagtcatgcctggatcctccttagctggtttctatttttccttacatttgctttccctctcagcctgactgctgtgctttcaaacattgacagaaaagtttaataggctaggacaaacagcaaagccttgcagcaagattcagactacagcgaggaatttgttttagacgagtccttcctctggagccctaactggctgggaactcactgtgtggaccaaattggcccggaattcacagagattcccttgtctctgcgtcctgagtgctgggattaaaggcaacgggcaaccattttactagaaagaaatatcattccaagtcctggtctccccagctggtcaggtctgccgaggatggccgagcaccagcactgacagctactttctcttgacacagtttcacattgtcattatctagaacttactttttccctttgtcccttctttgctcccgcccctcctctccctctctctctccctctcccctccttccctctccctctccctctccctctctccctctccctctccctctccctctccctctccctctccctctccctctccctctcctctcctctcctctccctctccctttccctttccctctcccctccttccctctccctctccctctccctctctcttctatctcttcccccccctcctcttattttttccttttgttttcttttgttttgaggcagggttttgctatggaaccctggttcacctgtgactcatagtaatcttgcctccatctcccagagtacgggattaaaggcatatatcaccctacctggttacaagaggcagctctccctccccatccagacgtttccccctggattctgagtgttcctatcatctcttctcaattagaaatgatcacagtcaataaggttccaggccatatgcccttagctgaatgagaattccaacaggtccttttggttcagtgttttcctttgcattacaaaaatcattagacagaaagtttatctagtcaggcagtctgtagcatattgccacaaagatagaactttatcaatttatcttttcagtaatacattttttttgtttttgtttttttgagacagggtttctctgtatagctctggctgtcctggaattcattctgtagaccaggctggcctagaactcagaaatccacctgcctctgcctcccgagtgctgggattaaaggcgtgcgccaccacgcccggctcaatttatcttttcagtaatacatttgtctccatcacacacattcatcctgtctcttacatttccatattttgacattttttgttgactatgaagtgtatttttttttacattattcatgtgctggtcccatcgcaccaagtcttattgattcccacagaatcatattcaccattgcaatcttagaaactgagttcagtccccaggcttgctggccagacaacctagcccacttgattagttccacaccactgagagactctatatcagtaaaaaaataatagacagagcctgaagaatgacacccaggagtgacacacacacacacacagacacacacacacacacacatatacacacaaataaataagaatgattttgaaataaaaattccaatactagcacaaagaacactcttccctttttcatatatatttgtgcatccctggtgtttgtaaggccagaagaagatatgaaagcccctagaactgacaagccctgaactctgacaggcccgttcttatgcagattcagtggaagcttctacacctaccgtgagtcctgactacactgcctgaggcttgcccagaacacttggtcgccatcttctggctcttacattattcctgcttcctcttttccagtgtcccctaatcctttacacatctgtcaacttttagaaattcagtatcagaggcttgtggatctttgtgagttcaaggccagccagagctgcataatgggactcttgtctcaaaaagttaacaaccatataattctcttatatagcctcccatttgcattctaggtttgacagttagttcaataatattgattataatatataaagagtccatcattgacctttataatgtaggatgtaattatcatatatttggcttccttttagcccagtagacttcctcaatcattctttgtctttgatagtttttgacatataaaacaatgcccattttctagatgtagtggtacacatcactaattccagcacaagaagtttgatttaggagtattatagctcaagacttgcctgggctacataggaagaccctatctcttcttacaccttttcttaatttatctgatacttcctcacagttatattcaagtcatacgcattcattttatttgcatgcctagttggaatagtgcatatgtgatagagtataacagcaacagtatacttcttagaatgtcatatccagaggtatgtaatgtccatttatactatgttattgatgttaattttacatatcttattactatgttccctgacttttaaaattatgtacttctgtgtttttttcttttactaccagtaagcagtctgtatggtgatgctttaaaattatacaaaatatcctgcttcttcctccacgccatctcacccgactctttcccctaactgagcatctactcatgatcttgcttctctccagtctttagatgctgattgtgaaatgaagtttcccaccggaggactctctcccatacttacaaaatgtcactcgatattttgtgtagcaagagcctctctccctatttcatcttttttatttattcatcaggagagactcacagatgcattttcatcaatgatttagaattctttagtaccttcatttttcttgtgtaaatgtcccagatttagccagtgagagcctttcaagacatttctagaggttgtgccatattttcctgtcctttttgtgagcattttgtttgctttttggcctaacaaaaatattgcagactcattttaactttatcctgtccaaaccttcaaatcagctatattcccaggagccctggctatgtttagtaggacagtgatatgaaaaactaaaaccttagtagtatacacaaacacgcacacgtaatatattatcttgttacttctctactgttatgataatataccatggccaggcaacttacagatgaagagtttatttgggcttacagctccagtggcttacagtctgatggctaaagtatggcagcaggctaatagcaggctgatagcaggttgatagctcacatcatgaactataaacaggaagccaagagagtgacctctgaatggcacatagctttaaaaaaaagatttatttatttatttatttaatctaagtacactgtagctgtcttcagacacaccagaagagagcttcagatttcagtacagatggttgtgagccaccatgtggttgctgggatttgaactctggacctctgtaagagcagtcagtgctcttaacccctgagccatctctccagcccaagcacatagcttcttaaaagttccagtgacatacttcttccagcaagattatacctcctaaacctatccagacagtgacaccagccgggcgtggtggtgcacgcctttaatcccagcactcgggaggcagaggcaggcggatttctgagttcgaggccagcctggtctacaaagtgagctccaggacagccagggctatacagagaaaccctgtctcgaaaaaccaaagaaaaaacaacaaaaaaaaaaaacaaaaaaaaacccaaaaacaaaaacagacagtgacaccaactggggaccaagtattcaaacatctgagcctatagggacattctcattcaaaccaccacatatacttatgtgcattctctacatatgtttacatctatatgcaaatatgaaagcctgttagtattcatgtggaattggttacatgacctcctaaggataccagaatctgtaaatgctcagatccctacataaaatggtgtaatatttgcatacaacctatagccatcttccagtatatgttaagtcatttctagattatttatagtgtctagtaaaatataaattttgtaaatagttactatattgttaatgttgaaggattatgaattgaaggacagcctagcctatataggaaattttaggccagcctgggttatatgataaggtcctatctcaaatctttaaatctgtagttttgagggtctggagagatgtcttggtgattaagagtactagctctttttactgaggacccagattcatttcccagcattcacatggcagcttataactatctgtaactcaaattccaggggacttgacactctcttctagtctctgtgggtactccatacacttggtgcacatatatacatgtaagcaaaacacccacaaaacaaaaagaaatcttttttttaaaaacacattaaaatctgtagttggttgaatccttgaatgcagaatgcacagagaaaggtgggctaactgtacatattttagaagtcatacagtgctctgtgagcagcttttcttgagcaacagcactcaccaatacacacacacatacacaaacacacactatattcaccccagagagggaatgcacagtaggccaaagaaatgattgcaccaaagtccaacttgctgaaccaatgcatttttattgcagtaaataataagagtatgggtaaaaggttacttggaaaaacagggatggctcaaaaaagcaactgtatctcacccaagatagctcatggcttaggaaagttgcaagcctggagccctgagcacagcttgcaggcagttcctcagtggtctctcctgcacaccttggctgctctatgtctccttccccagtagttgtttactccttttatagaactgccaacgtgagggcgggaggctagagaatcttccattttcctagacatgtgatgttttgtttatctcctgggtcgcttgagctctggatttctcctggagggaaagtttgaaataggaggaaactgcagccagacagcatgcagacagatcaagaccacccacttctaactcatctccacaagttctttcttgccttcaccctttccatatgcatgttcttttctccgtagtaagaatttggggtctcaagaacatgaatacatatttgctcaacccggcaaatatgtctaaaatattttcagaactgatttgctcagggactgagtatatagttgcatggaagagtacttaaacagttcttccctcatctgtatgttccatggtcattattcctttaaaatgtagtggatttaatttgtttcagtttgcctttagtcccattccccccccactgttttgttgatttaattttaaccttttgaactgctatgtaatttttaaatgtgaaattataatttattgatagagttttagtttttgcacttattttaatgaaatttttcttaaaagggaaatatgcaaaaaagtatactcatgggaatttccttttttctggtatcccttttccctccaccctcatcctttgtaagtgaccaactttgttatcatcttggttattgttaccattgttatagtttttggaagtccaagaaaatgtaatatgatttattatttgcctttctccaaaaatactatagaatatgtatgatcttttgtagttagacttttccagttaacagtatttccctatcagctcatagagagcatcctcagtcttcttttacaactatatagtacttcacatgtagaaaatttgtagctgtttttgtttttaaaatttttgagagactggtttcttctttgtgataaaggttttcccgtgatttattgcccacactgtccagtggtgtccagtggtgtccagtggtgtccagttaaggaaaagttttgttctgatcctcatccttttttcacaagaagacaagagtcatttaatatctcaatcaattcttttttaatttacttacttgtgttttacgtgcattggtgtaaaggagtgagattccctggaactggagtgacaggcagttatgggaattaaacagccatctctccagcctcctctcaatcaatgctttgtcctatttctgtagtacatctttttgttccctcattatgatttttgtttgtttggttgttgtttgatcttttgagatagccttgcctgagcccagaagttgctctatagtcaaggctgacaatgaaagcctgaccctcctgcctctacctctgaggtgctgggattacaggtatgtaccaccatgctcaaatttatgtctcaattttttgtattaattttggccttttcagcataccttgaattaagtatgaatcacttgatcagctcccttgtaaaatattcacaatactatttctaatttttaatctcactcaattcttcattcgaactctataacaatgacttaaattggtcctcattttccatgccctttcctttccatcttcaagtagaattgtatttttaaaatgttaaaccaactgggaaacggataacagaagagagaagccaaagagaaaaaaagaagaacccatcagaatagagtatcagtattcattttaccaaaaactagccaaatacttttaattaaatatatttcatcctgtttaagtcactatatctataatctcaagattattttcaaaagcaaaagcattcttgaggtccttttccttgcttgggcagaaaaagaaaaccttttggataataatacaattctcgaccatgtgacccaaggagaatatgggatggggattgagtcaggaagaggtagaaaacaaaacaaaacaacaaacaaaaaagaaataaaaacaaaacaaaaagccaaacatcctatcagagcaagaagattctaccctacttagtcaagtcatcttggcttcttttgaagtctagcaaatttggaaaggaagggtgaagatgaggtggaaaggcagggtaatgtggctctgaaagtctcactgtcatacagggacaagggcacattgtcattcacacacacacacacacacacacacacacacacacacacacccgcagagatgcagtgcacacatcactgaaataggatgaaaagataaaagcttcatctatgaccacggacaagtcactttccttccattattgtttactctgaaagatgaaggggattcatgtctaggtgtcccttctgctctgaattttcatgatactgagttctgtacagggatgtttccatctatccaagaccagactcagttcacacagaaacagattttagtggtaaagatccagatagtccataactgtgaggattttactatttgtgttctttggcataaaaacaatataccctagcttttgtcagtggttgctagattccagaagcctggtacaactctttaagtgcgtggaaaatagtcattagtggactcataagtgccagttcatctcattatatctttcaaggctcaaaagaaaatgaattcacgtaggtggtttataattgattttcagtgtatttttttttttaaatcttgacttttttttttaacctgttggatgatacttttgtctttccctacttcacaggcctgtacaattcagtggatagctggatgattgtgcccaacattaagcagaaccattacacagttcatggactccagagtgggacacgctacatctttatcgtgaaagccataaatcaagcaggcagccggaacagcgaacccaccagactaaaaacgaacagtaagttgtggtgatttcaggagtaaagactccttttcctctctgtgtcaaggaggacacttagcctgaggggactcccagagtagtggcactgagtcaaggggacttattgttgtagtttgtgctttacttaaaggatttattggtgctcatgggtgtttgtggactaagagatgtatagtgtagctcgtggcttggaatgaggttaggaggttagggaagggttttctctgtcttccacccctgtctcccatgcttgggagaaaattgagttaaagagtattacttgtgatgatccagcaaagctctaccacagagaagccatagttttaggagtgctcttgagcaaaaccgacaagagtcctagcgagatttccaaggagtttaagtgaatagtggttttttgtttgtttgtctttttttttaacttcctgtcacacattgcaagaagtttgaaggcaacctgctcatggctaatatagcagctctgagatcccatgaaaggttgaagctcctttgtgtttacccaccaggccacaagatgtccagtgcaacctctgatgtcatatttcccttcaagacaggaagaagaagggaaaacgttggcaatctttttaatcaacgaaaaaggagcttgatcagaatgttcttccaatctgcttgactttagtttccttcctattaactattcctagcagcaagggtggctgggagactgagtgagagatggggaaagatgacgaatggatgcggaataaacacacagtgtttatcacagaggcatactgcacacactaaagctctttccatagccagcactcagggtcacgggacagtgttttagtcgcatggttataagagtctctgaactgaagcacatgctatctttcatcatcgatgatggaacagccactctaacaaagtgacctaattatatgtgcactccgatttcaagaaagcaaacgtctcccgttgctgagtttttctcacttcttttttcttttgtgagcagttgcctcattaagacagactttcttacctcaaacattgtaacactccttaaaaatttacctaaatcccaagccacttgggaaaagaaaacattcttttacattttttttcaggccaacagtttaaactagatcccaaaatgactcccaagaaggtgaagctcctcaatgatggatggaggatggaggatgagagctctctgaagctctcacatttgaggatgtgagacttcgagtggtcccttttaatatcataatacatgatgggaacactttctcctctgtgattggaatattacttccagcaaaatgagatacccacatttttcacagagagggaaaataatacatgaaggctattctatgggagggcgacatcttacttagttgcaacttgacactcttgcctgcttttgtaatatagttcaaactgcagccaacctagatcatcattggagatcctctgctaatgatggtcttggaggggaaaggtacagttcatcacaatgatgtttcatcatgggggttttcccctttctttcactttttttgtttcaggccaaccatttaaactagatcccaaaatgactcacaagaagttgaagatctccaatgatggattgcagatggagaaggatgagagctctctgaagaagagccacactccggagagatttagtggcacagggtgttatggggcagcaggaaatatattcatcgacagtggctgccactactgggaggtggtcatgggttcttcaacatggtaagtggagtttgttttctttctttctctcatcctctctgcttttaggctcttaggagattcaattgaacagctaaacaaaaatactaggaagtcaaggttaagagatatttgataagaagtaatcctagaaaattttgccagtttttagaagataaaattttggaaaatatactgggctaggagatgggaagtactgcatcactctagttgctggctttataggctctgattatcttagcattctgcatgcaagtataaatgctttaaggaagaagaagcacagagtgagtcactcctagaccctaaacaactcctatcgctaataaaagtttctgtcgtctccactgtcttaggtatgctattggtattgcctacaaatcagctccaaagaatgagtggattggcaagaatgcctcttcctgggtcttctctcgatgcaacagtaacttcgtggttcggcacaacaacaaggaaatgctggtggatgtgcccccacagttgaagcgtctaggtgtccttctggattatgacaacaacatgctgtctttctatgacccagctaactctctccatcttcatacttttgatgttaccttcattcttccagtttgtccaacattcacaatctggaacaaatccctaatgattctttctggcttgcctgcccctgattttattgattatcctgagcggcaggaatgcaactgcaggcctcaagaatccccttatgtgtcagggatgaaagcttgccattaagtgtcaagagagcatgtaagtcactggctctccggttcagcacttcccctcttaagcctccattagtgctccatatatgagatgcaaactaaagtccattggaagcactcgaaataactagatatcgtagatttaaatttttgtgcattaaaaatcatgtttgaattcatgtattgagttactcagaacaaattaatctgaatagtctgggtttgtgccaccagggaagaattctagagagtatctctgtcgtcattggagaatttaaaattcccagtgatttgggagtataaatgatactgttagcaattagcccttctagtaatggctagtttgaccaggtagaatttgcacagtgtcaaattatcatttattatatgtcactttttaataaactaataaaagaggggttttgagaacaacatatacgtgcatatataatatataaaatgactgaattcattttatgagcaaaatgacagataatttttatctattatgtatacacaataaaccttaatttgcccatttaaataagaaatatatggaaaaggaaaataaatgacactgtccattcctaactcttaggtaaaaccatcatggctagccagcatttctctctctttcccttacagccgttctttcctccctcttgcctcatgtacaaacacatgcaatcaagacacaggaagtgaaaagagctcttggttagatgaggagagatctggggacaagattgcacaagagatgctaatgctacatagaaattggattctggtagagaagtgtctcgtatagcctaatttcattgatactgcttaatggaggagattcatctgaattgttaaaaactatcatagactatttcaaagaaatatagttttgttattctcaaatacaaagttactagacttaggcttaagaatagagttgtataatggagtttcttcagaactcaccttacttgaacagtaagaatggagtgttacaggttcaacaactatatgtgtacaaatgtacttatattttcagacaaagcactgaaatgctgttttcctcgataggatcatactcattatttttggaattttgtttatactattcattcatttgcatcccctccacgacaaacaaaaacataaattccatcctcgtttttatcacagaagttgagcttcacagcctgtgatttcaccatttctgttgcggagattaattggaaatgccagagaaatagaaccttcttccaggagccaaatctacttcttggcacttgtaaaatgattactactgtttaattgttaaatgatagtagtagccattccctggattgtatgtagccttgatacagtgtcaaacgttagcccctcgttctactagcatggtggattcttatttattcatttgttcaatgatgccacattactgctgcaagaatgcacatattactagaatgcagaccttggtgtcaaatgtctcactcttatgcacaagagacaacatatctctgtaaatctcacctaatgatccttacagattgtttgcttatctaccacaaaaaaagcaagacctgtgccaatacaaaagaaagacttagatttacatgccaggtagcaaagtcaggttctctgccttcaaagattatatgtaccgtatagctcattaggaaatgagcaacttcagtaaaattcaacagtgctggtagttggcttgtggtatgataaaactcccagccttgtaattgaaatagccctagcttctctgccatttacctaacagtgtgacctcaggaacgcacttcttcaaacctgtttcctcttctgtaaaatgatccccagtttatgatgtaaagctgtaaaaaggttagtgtgtatcagttgccgagcacagcgcctggcattcactatgtgtgccaccaacgttcatctcttccccaacaccattcatttgtttttgtgttctttacgttttagtcctgggaacaaagctttagttccccgttctactatggactgcagcttagactacctttcctcatcccatcttctcagctaactagtgacctctggaattggcatttgtggctccctgtggcactcccctggcacactgagaccctccccacccagcaataatatggaagtgttttcagaatgccatcatgtaaagagccattttagaagtattgttagtgatttgttccttaaaacaattgattcttggcccctgcccctgatatacttaattaaactatatgaacataaggaaacttacatttgagacaagcttctcaggttgttctgaatcacacaaagtttaatgtagaataataatcttccctagaatgagactaccttggggtaagcactgtggcttttgttgttgtatttttaagacccagaacagtgtctggaacaaagtagttggctggctaatgtttgttgaaagaatgtatgaacgaagaaatgaataattctaattgctgtttgactgtgatgtccatttgtgatatttgttattcttgggggcaagttggttgctttagtctgtattgctattattttgtaaatgtaccagggcttatacatacaaatgaacattgttccagattggcagttatcatgaagaattgtctttggagcacgtggtatcattctaccagttacatttcatactttcatgaacttcaatgaacgttgttcttgaaggtagatttaagtttttattacaggcagagttaagcctactgaataaactgaaaaattaaatgaggtttgtgggaagcaataaagcttgactctgaaatgctagcttctgaggcacgtaatgccttccaagaaacaaaatggtggcaaatcactcagagggctatggtgagttccagatatttacttcagtaaacttaaaagactttcatagaacactggcaagggaccagagggtaactctagctaaagccagttgcaccaatggaacatgaccatttaacatcatcaagaaagatgattctataaacatggttgctgtcgctttactccatctaactattcagaactttttctcctagaaaattattttctgtctgcaatttatgcttgtttccactttttatattgtcttattaaagaaagcacaaactgaagctaagcttgttttgagactacaaaagaaattttaatgccacattgatgttcttgctacttataagagtaactgcatctggctgtgtttttatgatgtaattccattgtgtgtctttggatgcagtgaagttcatattgtaacaaaatcacttatatatacttttcagctcagacattctaggtgaattctcagtttacatatttgtatatgactacctggatggatcagttcatggatggacttttgaacaagcttagatgctggaaccccttctatcaaggaatggaaaatgtgaggcaggtagacatgaaccactcccacacttacttgtagctcctgaagccaattccagccttagagccattgggctgtatttggctgtgtattacaagttggccagatttattgccatcaggtcaggcaaaactgccttttatggtgtggtctgccagcttcagaaatatgctgtgttattgttattggctagaatatttattagactattgttgaactattttttatcaaatgctttaccccaggcttgtttgtactgggagctctggaccaatagtgtctctcctagtaacagaaatatgaacatctgtggattacacagtcttaccctctctaaagatcccaacccatccaaatgctatattatgaattaaataaatatatatgtattcatga

SEQ ID NO: 602 - DNA, 2791 bp, mus musculus
agctcttcccatgcccggcagtttgcggcatctggaggagctctctggagaatctccaacctcagagcgagccttctactaccgtaagtacctacaaatgagcgcatagttcagtggctgaagattaattactggccacaaaatcctaaacaaaaccccgaaagaccccctgctgtgattaatcgccgtaaatcaaactgctccccagtcgttccccccacccccttcattcctgcctctctccttctttccccggatccgagccccgcctcgatgagaacctctgggcaatgtggatatctcccctttcatttctcagtcttccctccaaaccctaagcagggcttgtacccagcaccccgcggagcccaatccttttgattgctgtagcccttaaagctatgaaaggggctacctttagatattttgtacatatcactctcaaaaacactgcggcgctgcctaatggtggggaaagtgcttggggtagagtgcaaggggaccattaaaaaaaaaagcctcaactgcctaagttgggggtggggtgaaagagcaaaatgggcgtggccaattttgaacatcgggttgttcccaagttccctgagcataagattcatcatcttggctgaaatgatatggtacaattatgttttgtttggtttggttttaatgattgaggagtggtcagccatgctgagcaattcagcttttctgactccactccagttaccaagaaacaagactcagatgtccatgtggtaaggctggatcaggctggatcctcagagggcattccctgggtgcaatcccaggttggactctttccttggcaaagaatctagtttcccccaatagatcctggcccagtgccccaaggggaaacagcaacagggtggtattcaagctttgacctggcactgagaaaattggggacaaggggttctaggaattgggatgggaagggtttcaatacggtcttatgccaaattataaccctgtttgaaaaaatgagacaaaatacacctgtttacaagaaacatacacagaatgcctggcactgtacactcattttccgtaatcgaaaacaacaataccagatacacatgaacagataaataaataaaaaaagttcagagactgtaagttaagcatccttcaacacaaaaagaaaaagaaaatcagggcccagctcttcttgaatcttctcggtgtcaacatgttgtctaaggccttttgaaaatgaagctttccacttgtccatctcactcactgttagtctgttagtgttagaccatactaggggctgcaagccggccataagtttagaaaaactaagtcattttcttatcctcttgtggttgctgcatctacctcactctactgagctaagatcaaatagctgaaggcaggtgggattttgtactacagtagaggtccccgtggagtttgtgctgtgaggacacaccttcccgaggcaaaaggttactttgtggtgagaggggagaagatccgccttgtgcatttggagtccatacggttccattttcttcagaggtagtgaacaaatctgcttagaagttaagggcaagttctaagagggatcattcagttatactttcattaactacgtggaagcagctgaattaactaacacatactcaaaagagggttttaagctttggagataagggataagggtgcattataagcactccttacaggaaacagtctttgtgatggactaggaggggtaacagaggatgaagaggggacaacgacagatgctggctctgggcacttgagccttggagtttaaattaaatgaactttactttttatttaatattttaactttcagcaaattatgtatcctccctaaactccaattgccccagcaacaaaatggcagcagtggtcacaaatgcccttttttattaaactattggatgactgagatgcgcgcgtgtgtgagtgcgtgtgtgtacatgctgtgtttgactagtgcagttgtgcacttgtctaattaaaaggcgactcttggcatggtccacttccccccactcagtaggatttcttcaggcttgtctaaggtcaccttctgtgcctttgaaatctcagggacaaataaacatttcaaccaaaaaataacatcttggatcgcaggaaaagatcttgagtagagagactgggaaaagtgacaagtggccttattagcatgctaggttcctgggagctcatggaatgaaggttgtagagagggatgcactgatcacacctcaactccagagagcagaactagaccctgagcaagaaaatgtcttcttttagattctactacgttttaagaagcaaagccttcaagacttggaatactacaccagagggcctccaggcctggacaggccacagcctaagccatgatgcttcggaccttcactcttttgctcctttgcatttgtaagttcaaggaagggatgagaagcaagtgagcctgatagagaagctcctgtgagcaggctcctggggaatctggggaactgtttgaggttggagagcaatgtagaaaagcagactttctcttctcagggctcaatccgggtatgacttcactgggtaagtgtcttcctatcagggattgtaaggtactggcctgtgtgtatagcggctgggctacttgggaatcaaatcctcttccattatgatttgatttcccaagaaatatgcagattcttatcttgctttagaaggcagtctacttccccctgctcagttggattccttgagcatatgt

SEQ ID NO: 603 - DNA, 8545 bp, mus musculus; identical to SEQ ID NO: 121

SEQ ID NO: 604 - DNA, 3070 bp, mus musculus
tatcagtccaaggacattactctggaggtgaagaggcttggactcgcgaagcgagcagtgaggttcgagcctgcttactgcaggctgcctgccctctggccacgttccgcctctgcttcttggtgcagttgctcctgaaagccgggacccgaggagcctctggccccgtggttccgcgctcttgagtagaggaggggtgtccgggacaggattgacaaaccccgccctccacttattattttgcttatttttctttgtgcgctcctgttagtttgttaagcagatttagtcctagagtcttttctcctcccttctcctccctcctcctctcccatcgccctccccccaatcctttttcttcccctcctccctcccgtccctctgcaggagactctcgcagcctaggaaagttgcagctccgggtagcgcctagggggtctccaggcagtgttcaaccgccgccatccctttccgactacggcccttcagggatctccttcgcctgcacccttgctcacttcggccggatcttctgtgtccagaacaccctacctatgacgatgctcctggacggaggcccgcagttccctgggttgggagtgggcagcttcggtgctccgcgccaccacgagatgcccaaccgcgagcctgcaggcatgggattgaatcccttcggggactcaacccacgctgcggccgccgccgctgccgccgctgccttcaagctgagcccagccaccgctcacgatctgtcttcgggccagagctcagcgttcacaccgcagggttcaggttatgccaatgccctgggccaccatcaccaccaccatcaccaccatcacgccagccaggtgcccacctacggcggcgctgcctccgccgctttcaactccacgcgcgactttctgttccgtcagcgcggttctgggctcagcgaggcagcctccgggggcgggcagcacgggcttttcgctggctcggcgagcagtcttcacgctccagctggtattcctgagcctcctagctacttgctctttcctgggcttcatgagcagggcgctgggcacccgtcgcccacagggcacgtggacaacaaccaggtccatctggggctgcgcggggagctatttggccgtgcagacccataccgccccgtggctagcccgcgcacggacccctacgcggccagtgcgcagttccctaactatagccccatgaacatgaacatgggcgtgaacgtggcggcccaccacgggccgggcgccttcttccgttacatgcggcagcccatcaagcaggagctgtcctgtaagtggatcgaggaggctcagctgagccggcccaagaagagctgcgaccggaccttcagcaccatgcatgagttggttacgcatgttaccatggagcatgtggggggcccggagcagaacaaccacgtctgctattgggaggaatgtccccgcgaaggcaagtccttcaaggcgaagtacaaactggtcaaccatatccgagtgcacactggcgagaaacccttcccgtgtcccttcccgggctgcgggaagatttttgcccgctctgagaacctcaagatccacaagaggacccatacaggtaagggggagcagacaggtgggcgcgggtctccccaggggcaccctgccaccaagcagactgaacagccagagagggagaggggtggaggccaagccgaggggcggcgccccgccgagacctttcagtaccaagcgctgtcacagcctctccacccctcaccccccaggaacctgcggcgcttttgccgagttctaagttcctgagcagactgctgtggtctcaggaactaattgggaccttctcgcgcccaggaaccaactggcgccacctctttttgtgttcttttctgggttactaagaagagactccgaatgtgttgggagtatattgcttacaagcgacttagctctctgaacacattcggggaaggcaaccatagaaatgctaatgaaaactaactttggttacttccgttcttttttacacttgattggcatatctcctaattaaatgactgatacttttgtcaaactatttttatttggagttccaggttgtttagttctttggaggaaagataaagtagagaaggcactggtttctgtggcttgctcagcatctcttgtaaaagtgtgtgtagtccccggatttatgtagtgttctctttttccgaaaattagtaagactaccaggcttagcaaaaccgctacatttgaaagaggcaaatgaaaagacacaaagaaggggacggataggactgtcccattcccggcccattgtcctacccagcttggttacactgctgaggtggtggtgttatgtgcccgcacattgggagccctggttctttggagtggaagcacaacttagggtaaacttctgacgaccccccccccagctttctgctcctgagagaacaaagggatggatgttcgggttctgggccggccctactctacccctgcctaagatcaccactccccaactcagtcagctcaatcaaagctatggtttttttttccccctccggggaaaacagatgctatgtccttccactgtccgcgcttcccctctgcagaaagaccaccggacttttcaatctcccgctcaccactctgagaagtttctgggtttaactatattctctccctccccctattttgcatttttgccttttgcaggtgagaaacctttcaaatgtgaattcgaaggctgtgacagacggtttgccaacagcagcgaccgcaagaagcacatgcatgtgcacacctcggacaagccctatatctgtaaagtgtgcgacaagtcctacacacacccgagctccctgcgcaaacacatgaaggtaattacctctttattagcggtcggcggtttgtaaacattcggcctgataccgggccgcagaacggaagcgcccgcgctgccaaccctctatccttcacgttaaatccgatttgctccagcactgacaccttgaaccccttttgaggatgggggtggaggggggtcgaga

SEQ ID NO: 605 - DNA, 3070 bp, mus musculus; identical to SEQ ID NO: 604

SEQ ID NO: 606 - DNA, 60417 bp, mus musculus
tccgggtcccggcccgcggggagagctgggtgctggttggagcaggaggcgggagctgcgcgacgggcgaggcggtgagggagcagcaacagcggcggcggctgtagcggcggaggcttcggcgacggcgacagcgacagcgacgggctctggtgacgacttctctgaggggtgagcggtccggggagtgggcagagtgaggaagcccgagcctgggaaggagggagggtgtgtccttcgcccacgagtggcggttctcacggtggcgggcgggaacgggactgcgggcggacttggcttctccggggacctcatcccttctccggttcacgctggggccagcgccttccctaagcggctgccgcccctcgaggctcaggctcccttggcgcgcccgcttggctctctgccctgagggggggtgggttctgaggctgtccccgccggtgctattcctgagccgccgccagctcgggcacctgcccgcccccccccccaacccccaggtctgcccgcccacggcggcgggcaggtggcggcgccaggctcctgccgcgtgggtccccggggaccagggagggggcggtgccgggaggctgaagcccgaggacgcggagccctccggagcggagcgatgctcccggctttgtccgccaaagatgctctggcctcgggagccgcatcctccgcggacaaggtcaaaggctagttagctagcgcagacctccctgggaggaattcagtcaactgggccaccggtcaggaccgccctagagaaacttagccctcgaaatatgcttttttttttttgtttgttttgtttttttttttttttttgagttacaccttgagtgactgcttctctggaacacattccaaacggccaggagaaaatagggccctcgaggcttccggtcaggctacctttttaacttttcttttcttttataagcctggaaagaaaagctaggcccttccccatggcaagcaagcactccaccgtagagctatgtaccttttgagatagagtctcactcaacacaggatgctgtttaactcattctattggtcaggctgggcagtcctcgaactttgtacccactctccatcctgagtagattataggcctgcgtggccaggcctggcatatttaaacttttctttttccctagatgtgaacaggtccaaaactttaaaaggcttgtttgttcatttatgttgaggctttctttttttcttccttttttttaaaaaaagggagtctttaaagaaaggatggtcttgaactcacagtgtagccaaggatagccttgagtttctgactcccggtctctggcccctaaatgccagggttgcaggtgcatgccagtcatgtttgttttattttcctcggttattgatagcagttcagcttcccagttactccgtgttctaaaaaaaataaaacaagttagtaagggtttttctaagtgaacaaagtttgaagttatgacttacttgaattatatctgattaccttgtccaaatcacttaactttttctaaggtatttcctcagcaatgaacaagggattataatgtgtgtcttaccttttagggtcatatgagacatttatgaaagtatatttcacatactttgtcttacttactgcaggttttactttcttgtaaaaatttcagagcacagaagcattttttttttgtttttttgagacagggtttctctgtgtagccctggctgtcctggaactcactctgtagaccaggctggcctcgaactcagaaatccacctgcctctgcctgtgcctcccttgtgctgggattaaaggcatgggccaccaacacccggcgcacagaagcatcttgaagcacaaaaattttaaatgtaaacttttggagctggggaaaatggcccagtcagtaatacttgctgtggaatcatgagaactggggttaagatcccttgtacctgaataaaaagccagcagcaaagtatttatctctaattccagctctcaagaaacagacaggagagtttctgaggctggctaaccattcagataagctgaaatggtgaacttcaggtggtataaaagattcctgtcttaaaaaaaagttacgtagagagctactgaaaaagatctatttctctgctcttcttgggcatacacacacacacacacacacacacacacacacacacacacacaaggacatacatatttctaaaaggtctagtttttgaaatctattctggggctaggtatggaatagcattggtagagtacttgtctagcatgtttgaagccatgatttgtattgccagaactcaaaaggtaaagacaaaaagattgcaaaatcatgtgtgaggtgtgtgtttcttgcagtgctgtgaattgagctcaggatttcctacatgccaggtaatcactttgtaccagtttagctgtatcactagccctcagtttttttgttttttgttttagttttttgtcaagcaggatgccactgcttagctcatgtttgcctcaggctcttgagtgtttggattacaggtatgtgggacaaagtttggttgagaagcagaagtttgaggccagtctaggcactattaagaccttgatttaatttttttttcaagacaggctttttctgtgtagttctggttatcctggaactcactctgtagaccaggttagcctcgaactcagaaatccacctgtctctaagaccctgttttaataggtgtagtgggccatgcctttaattccagcactaaggaatagacataggcagatagatctctctgtgagattgaggccatcctgatctacatagtgagctccagagctatagagtgagaccctgtcttgaaataacaacagcaaaacaaacaaacaaacaaacaaaccaaaaaaggactcattttcaaagactcttaagtgatactttttggccctacaccatactctttcatactcaagtttgaactttaagttgtttttcatagtgtatactgtgtacattgaacatagctccctttttgtttgttttttgacacagggtcttatttagatcaacttgacgcaaatttatagtccttttacctgaccctccttcgtgctggaattctgggattataggcatatgtcaccacacctaaatcacttttctttttttttaaagattaattaatttattatatgaaagtacactgtagctgtcttcagacacaccagaagagggcattggatcttgttacagatggttgtgagccaccatgtggttgctgggatttgaactccggacctctggaagagcagtcgggtgctctaacccactgagccatctcaccagcccctaaatcacttttctttcttcccttcattcttttcatgtgacaggatctcacttagtccagactggcctcaaactcagtgagcatcacctagatttttcatcatctgcctctatatcttaaatattgggattttaggcatgtgtacatcacacttggtttacaccagtgggtctcaaccttcctaatgctgtaaccctttactacagttccttatgttatggtgatccccccaacataaaattagtttccttgctaccccataactgtaattttgcaactgttaggaaacaaaatgtaaatatctgtgttttctgatggtcttaggggatctctgtgaaaaggtccattaaaggggttgtgactcacaggttgaaaactactgatttatatggtgctggggactgaatttatggcttcgtgaatgctagacaaacactgtactaattaagcagcgtcctgggccttcttcctttgttattttattttattttttgtttttttttgggggggggtttgtttgtttgtttgttttttgagacagggtttctctgtgtatatccctggctgtcctggaactcactctgtagaccaggctggcctcgaactcagagatccgcacctgcctctgcctcccaagtgctgggattaaaggcgtgcgccaccaccgcccgggatgttattttaattttttaatcttgtaactgaacacatatttattctttaacttttactgataaatatgtttaccacagtgagtgtgtatatgtgttgtatgtgtgtattcattcatgtcagtgttttccttggttgttgtctatcttatttttaaatgtttatgttttattattagagtgtgggagggtatgcacgtgtgtgtgctggaacacacgtggaggtcagaaagctttgtggaatcagttctctctgcctttacatggatctgagagatcaactcagtttccaggctcgtgtgccaagagtctatctgctgatctagctcattgtcctgtgccttgtttttgagacagcgtgtgttggattggctggccagcaaatgcctttccagcccaggggttacagttgtgctgctgtcttagcttgtttggagggaatagggatctgaactcagggcctcttgcatggtgaaggctttactgttgggtctgttccttcagcctcctacaaggagtatttgactggtcattgtttttaatgcatctcaaagaatttgattatttaggctttgtgtctgtacgcacacacacaagacagggttttactctatagccaggctgacttcagactaactgtaaagcctggcttaagattcatagctatcctccaccttccagcctccaaagtgctgggattctaggtgtaagctgctgcacttggcttaacttttacttacttttttttttttttttttacttttaaataaacagctctttagggctggagagatagatgacttggcaattaagaacatttgttttcttgtagaaaacctggattcagttctcagcacccacatgattgttcacaagtattgaaactccagttccaggatatctgatgatttttttttttggccttagtgggcaccacatgcacaaataatacaatacagaacatacatatagaccaatactcataaacataaagtaaaaaaataaataaaaagatgcactatttcacatgtattgtatgtgtgcatatatatatatatacatatatatatgtatgtatatatatgcatgttcatggcatagcatgtatgtggaagaaagaaagacttgtaggctctttaaaaaacacatgggttctagagatccaacttaagtcattgtgcttatatggcaagaagttttacctactgaggtatctccccagcctgtaagcacataagtatttttgttttagtggcctatctttgtatttggctctttctattgtgtttacttttcaaatactttaccccttgtgatcaaagtaagaatgataagcaaaagtggagtgctgtgtgcacttaatgactcttccttactgaagaactggtgagaaggtaacacacgctctgtgacaatgagaataatccatgcctggtctcctcacctctgcttgctttcccctttcttctgagctccttactgattgccctcttattcctgtgctcttttgctgcaaagggtttcctggggaatttttattctttgaatttgtaaatacttgatttgcatttagtgtggaatctttttgcataatgtacccatcttaagtgtagagttcagcatttttagtattttgatacaattgtgcaaacatgatcataagtctaattccagcacagttcttcccccccaaacgttctgttgggtgtggtgctagatgcctggaatcccaggattgggctatatatggagggagggtcaggagatgagggtcatcatcctcacagcctggtgtacagagtgagttccaggactacacagaaatgttgtctgaaaaaaagaaaaaaaaaaacaaaaacaaaccaaaaagccagctctgcattttacacagatcagttaattcatttgtcttttccactatccaccaaacagcttttagattagaattggtattttgcaatatcgtgctctaacatcatataagactattaataagatctttctttaactcagtactcaggaaaaaagtctgacttggaggcctcttttatttagtaggctcagagatgaggctttttactgctgcccaaagtggtctgtgctgtttcaggctgcctgcttaagggaaggctcctggtaggtacacacagttggggataaacacttgatgttgtacaggaaccttctgaatgcctaggagaaggtcctcccagctcaacttagactttgatggcttgctcctccatcctggccatgctgttttcaggtttagcctcatgaaggcctcaggtttgtgaatcttgctgtggacatacttcatctgggcaatttctttctttttttttttaattaggtattttcctcgtttacattttcaatgctatcccaaaggttccccatacccaccccccatctgggcaatttcaagtgaatatactgtacctctttattggccacatgggacaagtctccatgaatcgtgtccagggcctcagtctggcaggcaaacaggcctgtgctattgcagcaccagcatgttgcagcctcgtctgtcctttggtcctcagggggtctcccatattccagtgcacatgattgctgctgtagctccatgatatatgaccatatttccaactccagattggtatccagcagcctggccagtagaatggtggtgagcctccagccctctggctgatcatgacctgtttcagcagcttagcttcccttgttagaattcttcacagcataacatttcaagtttgatgaatcctaattaattttttcttttgttgtttttatttttagtgccatattttagaaactattgccctattcaaggtcgtaaggattatttatatgtgttttagattttgtgtatttagttcttgaatccattttgtttgtgtgtgcatgtgtccatgtgcatgacatttgggttgtaattgtatattggctgatataaattccttagttcacattttcctctttcattgaggctttcaagatactacctttatttttctttgtattgtgtgtgtgtattttgaaactctaattccatcatttctctcttccctttcctcccccaactcctcccatgtacccttattgctctcaaattcatggtctctttttctttaattgctgttacatgtatacatatatattcctaaatacataaatataatttgcctagccttttgaagaatttggttgtcatggagagctaggatagccccagggccatatggttccagaaagatgtgaaaattctgcagggttatgggaaggatctgatgaaaagggagttgctacagtctgctctgtcagctgaatcagggtgtgttctgctaaggctgtcatcagggttcttctcagcatcctcctgggagtaaatgaccctgctatctgggtgtttgtgttcagaggtagccagatgattcactgcttctggtcttttatgttttactctgaagcagtaatacaattgtatttatcatctgtttctgacatctcagtcaataccatattggttttagtctgttatttcttttaaagcttttttgtcccttttaatcaacattgctggcaaaagaaatgacatttaaataggataaatcttttctgcgaaggccagatagtaaatattttatactttgtatgctacgtgtgcatctctattgctgccacttcttttagcactaacaattcctcctttttgtggtaccagggttaggatctatcaatctctgttagtcaatcttccaggtaattttagtgcacactaagatttgagagtctcaactccaaggtgtgtgtgtttgtgtggaaatggtgagcttttgggtatgggcattttcaatattttggagtactttcatactgcttccaagctacttatatttcggtatattctagcagtgtattagggctccttttgtgccaaacatttgcctactcattaaagcaataaccactgttttgggtgtgaaatggttgggtttttatttgcatttcccaattactacttgatcatattcataggttacttgaattttggttttgggatacactagttagaaattttgccttttaaaaatactaacatgtaaataaataaaatatgttgaaataattactgaacaaacccagaatccccaaggaggaaggaattcagagtttttaaaaaaggaaattcaaggaagagcaccgacaatgatggtcagacaactcaggaaagctcaggtaaactgaggcaaggacattgaaataggaggagcagcatgaccagattagggaaaacaaggagttttatatggacgattagggtaagtagaggaggagaccagaaattaaaaaaaaaaatgtgtgtgtcatgtatttaatcattaatttatttattcactgttttgtgagacaggctttctcttactatcctggaactcagtttgaccatgttggtctttaactcacagagatcctcctgagtgctgggattaaaggcatatgccaccacacctgaatttaatatttcactaatagtgaaatgtttggattaatttggctcgggttttgctttgcttgttataaatatacattctcagtttttcccattttaaattatttaagacttattttatgtgtatgcatggatggttatgctacacatacatgccttggtgccagaagggggcgtttgttcctctggaactggagttacagctaggaatctaatgagggtcttttgcaagagcagccaaaggtattaactgctaaatgatcctgctgctattgtgggtcctgtcgtcattgctgctgctgctgctgctgctgctgccaccaccacctccactgctgctgccactgcctctgccaccgccaccacctccgctggggtgggggaagggggttgcttgaattatttccttgctgggctaaggcagactgacaggtggagtctggggcccgccagccagcctcgccagtctcgtgcaatccccaggtcccaaaaagaaacaaggtagcaaaaagaagcgggaaagcgcacaaacagctgaaggttggaggagactgggctctggcagagcaggacacataaaccgcggtaatttctgctgttcaggagccccttcttcgttcttccccgtccgcccccccattcttacgtttgtttgtttatttgtttatttgtttttttccattgttgtgagcgacggttaggggctgaaactcacgtctccagagaagggtaagacttgattttgatttctttctacctgctttctcccctcttccacaattcctttctgtcattttcccctcccagttgcgggtcttccgcattccccttggtggccactggttcatggtctcagcgcctgagtggtggtggagtaaaggcggcagcggacattttgtagatacgttcgcgcccttgccgagctctgcgcggcttttatagtcgagtccaaatgattacgtaacaggagctgcgcagcctggtgtgcggcttcttcccctctcctgcgccgatggtggtttgggaaatgtaaggtttctccctgcagaagaggcacacatactcatctcccaccctgcgaacttcacttgcagggttccaagacttcaatttggcttgtatttaagctagtttaatactatgtccaagccgggcgttggtggtgctcgcctttagtcccagcacttgggaggcagaggcaggaggatttctgagttctgaggccagcctggtctacaaagtgagctccatccaggacagccagggctacacagagaaaccctgtctcaaaaaacaaaacaaaacaaaaactatgtccaagaaaagtgcttggctgccgatagggaagaataactagttctatcttcatttttatttttaatttaattttgaatattttgtgagagtttcattttgtagcctttggctagccttaaatgcactatttataacaggctggccagggcagtggtggcccatgcctttatttccaggaggtagaggcaggaggatttctgagtttaaaaccagcctggtctacagagtgaattctaggacagccagggctacacagagaaaccctgtctcggaaaaccaaaaaaaaaaaaaaaaaaaaaaaaaaaaccaaacaaacaaacaaaaaaacaaacaaaaaaacccaacaacaacaaaaccaggctggccttgaaatcaagaacagtcttctttaccttcggagtgctggattaaaggcatgtagtactcttttttacttttgattttatgactggctagtcctgattggcctgaaactcctctttgtaaatcaatctggtctcaaactcatggagaaatgcctgcctgccctagcctcctaagtgctttggttaaaggcctgtacgttgtgtgtggccacaattccatattagaactgctgttccacaggctcaagtgaatctaaggggcagatgtattcttcggaaagtcagattcaaagacaaccttaaaagtttttgccttcccacaggggttgcatatatcagctaacctgaaaataagatatttagattacgattcataactagcaaaattagttataatatagcaatggaataattttatggttggaggtcatcacagcatgaggaaccctattaaagggtcatatcactaagaaggttgagaaccactgttctatcataaaacagaaaacaaagtaaatgttggaaaagaattaaataattcacttaattcaaaagaggtaataaagggggcacatcctgtaaaatgatgcctgaggttagcctctggtctttacatatgtacacatatatagaactctttaagccagatctaaagactagtaagaccagattaatatcttttttatagtttttgcttttttaaaggtttatttattatgtatacagccttctgcctgcatgtatgtgtacaggctagaagagggcaccagatctcattatagatggttatatgccaccatgtggttgctgggaattgaactctggacccctggaagaatagccagtactcttaatttctgagccatcactccagcccccaacatcttttttgtttgtttgttttttgttttgtttttgttttgttttgttttgttttcgagacagggtttctctgtgtagccctggctgtcctggaactcactctgtagaccagactggccttgaaccagctcccaatatcttaaaacattaatggtttccatacctgggttctatttttgtactgctgcagtgaattttttaatttattagatattttcttcatttacattttaaatgctatcccaaaagtcccctatcccccccccccgcctgctcccctacccacccactcccacttcttggccccagtgttcccctgtactggggcttataaagtttcctagaccaaggggcctctcttcccaatgatggccgactaggccatcttctgctacatatgcagctagagtcatgagctctgggggtactggttagttcatattgttgttccacctatagggttgcagaccccttcagctccttgggtgctttctctagctcctccattgggggccctgtgatccatccaatagctgactgtgaacaaccacttctgtatttgccaggccccagcatagcctcacatgagacagctatatcagggtcctttcagcaaaatcttgctgctgtatgctgcagtgaattttaaccttaagacttttttttttttttttttttggttttctgaaacagggcttctctgtgtagtcctggctgtcctggaactcactctgtagaccaggctggcctcgaactcagaaatctgcctctctctgcctcccgagtggtgggattaaaggcatgcgccaccattgcctggctaaccttaagaatgttaacttttagaaaatgttattttttatgtgtatgcgtgttttgtgtatgtatgtgactatgcaccacttgtgcagtgctggatgaagcccaaagagggcgtttgatctcctaaaactagaggtaaagaggatgctgagcatctatgtgggggctgggaactgaacccagctctgcggaaagagcaggcagtgttcttaatcactcaactatctctctagcccctgaacttgaaaaatttaacaaccttcaattatgtacatacatactatatttaaatttatccttcagaaaacgtctttccttgttgtcagttatgcttatttaattgtatagtaaattaatcatttcagtaatctttgtcagctgttatatccctttgcaaaaccctggtctctgaacttaaccctggaactttattccatcaattaggggtttccttgcagtacactttgaagttcttgggaagaaaatttaacccaacccatatttctttctgtccatttctgtcaaaaagtatagtgtactttaatgtatggccaaagtgaacatttcgagcagctcacttgatgctgcgcttcaggactttttctcataaaagcaagaagccagccaagtcttcttaccatcgagtcggccgagcacagaccgaacgactctgaactagagttaactctctagaaagcgttttctaacctaacttggacctttgtgatattctgaagctttcttggttttgtctttcacttttccttttctgttttggaaaaaaatatggtgttttttttcattattgttttttttttaaactaggactaaatcttgtttactgtataaaatcttttttttttgatactggttttcaagacaggatttttctgtgtagggctgttctgggactcactctgtagaccaggctagccttgaactttgtctctgcccgcctctccaagacctgagattaaagttgtacacaactatgcctgctataaaaccttaccctaaaatagtctttattttgtgtatgcatatgtgtatgcataggttatatgtgcacacatgtacatgtggaagccagaagatgagttactttaccgtatttttttgtgacatgatctttcactgaacttggagattgttatttcagctagactagtaagcaagcccctgaactttctctgtctcttgtctccagtgctgagattacagacttgcacagccgtacgtacctggcttttacataagggctggagatttcgagcacaagtcttcctggctgatgagcacgcatttcagctattcctcctcagcctcatttgtttttgagttggtttcttaagagcctggactgtgctaagtaggctagtggcctgcctatttctatctccttagcactgggattacaaatgtacaccatgggcctatctttacaaaccctttctgtgtttttgtttgttttccttggcaaaaatgcatggtcataactttcagatctgtttcttttccttacccgttcccttctatgttttctttctaaatttaacaaaatatttagtaatgaagatctaatcatgaaacagagcaacacaataagtttgtcagagtaccaaaaaggagttgaatacaaattatatttatgatatttatgatataatgaagattacttgtccacacattgttagaccacaggattcttacctggtacaagtcttagattttattgttacctgggttttaagtattaaaaaggttctttatacatttcttttaaaatttagtctcatgttagtttaagttatagaatgttaacatttcaggaatagttggccaaggtatgaaaacttcaaaatgacctctaatagggaaactatcttagtacaagcaagaaaggcagaaggaactgaagatagagtcaacagtctttctatgttaaccttgttatttcagtttgaaatataaaaggtttctggtcccctaaagtgctatgggacatgacctggggtttagagaaggagccagtggtgcagggacccagaattgctgttgcacctagcctgcttcacttttatttcaccacacagctatctaggagtagataacctgtagattagtgaagacgttaaggggagtcaagccttcacggcccctcgtttccttaacctgtgatagcccagtgtccattctgagcaagtctgtcttaagtagagtatagaagatcagagggagtgatagttgggttaattcgtggacaggcttggaggttatctccctcaggttctgggttccttggagggatttgtagtttttccaccattgtatattccatgtaactccagtggcctcctgtgaggactatagctagtgtcttaggattcagtttatagctcttacagaggccaaagttataccataaggttataagcttttgttcatgaagaagggaaggaaagtctgactggatacatggtcagtccgggaatggcttaaagataatctaacaactccatctacctatgtaaaatctcacaattttacaaaaaagccttggcgaatggctgagtgtttgacaattctcatgtcttcatcactagtcgaagaagtgaaataagaatgctggttagcggtagagaccacaaaggggtttgggttgtagataatggcagagataataggcaggaagactacaggctgtaagtgaatgattagaaggcggcagtatctgtggaagagactatgttttggatctgaagatctactgattaattaggcttaggctaaagcgcttgcttattattacttgagtttaggccctcccatctacataaaagccaggtataatgatacatgttaggaaaaccagaaatggggggaagataaccaagacatggatttcagcagctagatggctagtcagtctagatgaaaaggtgcactccaggacagttagagaccttactgtagaaagcgagagagagaagacatcacctgaggtcaggccctgactcattccacactcatacacacaaaaatggaattgatgtttaaatccatgctaacaaacaaggcaaaaataccctcagtgttactccagaatcacttttcctcaacaggtatctttaagatagtggtggcaggagagagtgaaagcctcggttggtccctgcactactcagatacagctgctttgaaaatgctgcagaaaggcaatttcaggacaagtcaggggtggatagcacggcttatagatttatagaccataaaatgttcataggggtgaggtgggcttttcacagctgcaaagatgttgtcagtctggagtagttttttcctgtttttttgtttgtttatatatactgttttattttttagtattggtgtgatagcaaaactagagatatgtacatatctcagaagtagcctaagagtataaataaaaacaaatctaaacaatgacaaacatactgggtgtgattaattctagcacttagtggtacaaaggcaagttgaacttacagaagaattaagctttctcttggcaatcaccacgttttaaagcatactacaggcactttttaaaaaataaacaaacaaacaaacatgctaatgctgtatttctttgcagtgtaaaaagtggatcaggcagctcatatgctaaaggatggcacggtcaagatccagatcccccaggtggaaacaaaggtgaggagtcccatgcttctcctagttagctcggatttagaaatcactgttactgctcaagcctccataagctcactggacctggctgctcatagtactcgattaatcatggtaatggtagtatttgtagatttgaggagctgataaatttgtttaattggggctagaattactttataataaaaaggaatgcagtgaccacatccagaatgagaaatgtctttgaggttacttttttaagctattaggaggtttacaacttttagtgtatgttttgtttaatttttttcaagaaatttaatcagaaaatgtttaatttttttcaagaaatttaatcagaaaataaagtatttcctagcttcttggcaaaaaatcagttttgaatagctcaattgtagttcaactctcatttgttttctttgctaggaggtatcagtactatagtttccataattagattagaatagttcaaccagtttattgtacattagatgcctcccagttctgggacaacaagagtgagtatcccatcttccatggccttagcaagcacacagactggctactctgatacagtggggaaagcgctgtgcttctgacaggggcaaagctctctgcatctctagggagagaattcattctgttttacaaccagtaaggttcagactgacataaaggactattattacatacaggaaagataaacgatggtttttatgttaatataacttgttccaataatagagtgaatcatcagtcagtaatttagttttcattttataaatgtcacaaaatcatgttcaatttgggagaagtttcaaaaagaaaagaaactgtaaagacaaaaagactatataacaaggaagataacacagagtgtgccttcttttagccttcttttagttttcttttttttccattttttattaggtatttagctcatttacattttatccttcttttagtatgactattagagtaatggcctcagagactctgccaatgcttagtgcctagttttctaattacttataggtttttggtttttttgttgttgttaagaactacaaagagtttggtactttgttcctacttagaagtcaatatactactttgctacaagacacttccatgttagagacattttctctaccttctaagaacccctgagggccagtgctctagagtggctctgggtagatgatgcaaatttgtcacaggttctggggttttgacacagctgaggaacttgagtcacttggagtaagcattatcttattattatgggcagcaaacaagtaagctctctctctctatccatgagggagacctgatctctgtttccaaggctgtttcctggggaaccaaagttgccagtgcccccactcataaggctagagaattatctcctaacctttaggagaattggaaatgctaataacctttataacaaatttttctggaagggagtactacataataagatataaaacaatgtcagcagttttaaatgtgaattaagggctaaagttagatcttgagtgtttcatcctgtctgggaaacttgtgcctctgactcccgggttctctgcttagcagtgaaaagagatgaaatcttcaggaattcctcagagacttgagttgtttcccccctgggatgagataaaccatgaagatggcagagtttctgcttctgataagtaatatttgccagtatgtctagcttggcaactctaggcgacaatattgccaaatccatgtaaatgtcctaatgggtactggagaagatagatgtgtttcctttttgtgtggaagacacacatttgtccttagaaaaaaagacttattcataattgaagcttcttagagcaggtaattttattttattttttcgagacagagtttctctgtatagccctggctgtcctggaactcactctgtagaccaggctgcccttgaactcagaaatccgcctgcctctgcctcccgagtgcagataaattttaaaatggccagggtattctttttttactgatttggagccattaagccctaaaggaggagatggaaaattggacaggtcacatgggggttcttactcagatgcaaaagtgagcttcttctttttctttttccctttgaggcagggtttcagtggctgacctggtatttagtatatagactacgctagattcaaactaagagatctgtctgcctgtgcctcacaagtaccaggaacaaaggtgcgagtcaccatagcccgccccttccttacttttaaggctgagtaactcagagagttttccatggatgtgggagtcttctcagtaggaatacaagtctacaatttggcgatattaagttacagaaacaatagatgcagaagagctatataatactgtcccctagagagcattatagttgcattaaaacatactttgactagagtcctaagttatttcaacagcacatatttcagttgatatgtaagggaggagattttggaaagaatagcagtttatgttagaagtatttatggagggataggcatagtagtgcacacttgtattcccagcattttattggtggaggcaaaaagattgtgttaagtataaggtcagacttgtcaacagatatattcccagacaaaccagtttgggttgtaaagtgggactctcttatttttcttagaaaaaaacccctgttgtatggaggcatagtatagaaattgatggcctatgtctctctcatttatttcttccctgcccatggtacctggtaagcgtctcctttggtaaagcctcgagggagagaacagtcagttggaagcactataaaaacatttttggagtttggattgtagcatcattgtcttaggatgtaatttcagaggtcatctttagttttcttcacactttcaacatatttttaaaatttatatatttacatcgattctgcccccctcacagagagcattctcccatcccctccccttgtgcatattttttctaactttactcatgcttgtttctcagttagctattgaacctgaggtgagcttttcttgattggcactttgaaggtactacatctccttttgctagaacttgctatcagtagtctttcaaaaacaaggttctgctttctacctggtctgctcctcctctaatatgatatgtatatttaacccattttgatgtgttcatagaatacatcagtaaggatgacaagagtatggttgtcaggtaggacaaaagaatcattaacccatctccctcacaccggtatacaattccaagtacatataaaacaaattcctagattaaccttgagtgggatagtagtagaattctagcaaagtattttaggtaggtcacactaaaacagttaattgtctcaaagtgaactaaacttctctctgcttgtttacataggtcattatcgccacaatctagaaattttgaataccatgaggaaagacatttccatgggcactatgaccctgaatatagacatgatcaacaaagaccctttacttggagaatggatgatgaaaaacatggacaaaataaaccaaggattccccctcgtgtgaattcgtatcatcggtcttatgtaaatagatcaccttctccaaatgtaaaacctgttgaaaaatttgatacatataagcctcaccaagaatattttcctggcagaggagatgatgacagacgatctcagtatatgcccacatacacagaaagtgcagcaacctacatggagcacgaaagggattgttatatccctacagtgcaaggaaggtatactcctgatgatcacagaggtagaggtagaggaagtgggagaggagagaagccacctcagatgtcactggggaagccacctaagatgtcactggggaagccacctcagatgtcactggcagattccttgagatttaaagagaaatggcatgaagatgaattgagacaccagagggtacaagaagaaagctaccctcagtcacccagaagaggctcagaagactttggcacaaggaacccttttcaaaagaggtacaggaaatcattaagtctggggaatttggcataaagcctccagtaataaagttacttttacgttgaatatcataattttttatctcaaaagataaaataatttatattttgagtaatttatgtggatagctagaatgtagttttgtttgtttgtttggttggttggttgttttttgagagggggtttttcctgtatagccctggctgtcctggaactcactctgtagaccaggctggccttgaacttagaaatatgtttgcctctgcctctggagtgctgggattaaaggtgtgctccagaatgtttttaaaagatgttgcttttaaatttccatgcccctcttaatgagttcacatgaggtggtcttgccgttgcatgatgtattttaaggccagtctgcccattattctagacatcaaaagttttacttctgtatattgcaaatgtaaacttcttttttaataaacaaagtttaatcatatttattaataacaagactttttttttaaatgtaagtataaattcaacttccatcatttcagttaacttcaaattattctttccaaattaaaacaatataccaaacaggacaagtgatatatttaaatccaagacttctattaagttataaatgagtaaatcatgaaataaaaaaaattttttttgtggtttttcgagacagggtttctctatagccctggctgtcctggaactcactttgtagaccaggttggcctcgaactcagaaatccacctgcctctgcctcccaagtgctgggattaaaggcgtgcgctaccacgcccggctacatggggtcttttatggtacaaactctgccacataagcttctttatgtcattacaggtatcccgaggatcatgatttcagaaagtatggctacacatcaaaaagacctacagatgcagcaaggtatgaaaatagagatccagccagaatcccaaagtggaagcctgagcattcttttctacctttccaagagaagaaagaagagtggagctttggagcccaaggtcacagatatactgagagagagtacccagagagaagctcgacaaccagagtatcctacgactaccgtcacaaacatcataagctctcagagagcgagcaggactttcctgatggcagatttcacaagcacttaaaggaagaagacagaaaatacagttctataaaagctcctgcaaatagagagttagattgtttcagtactacaagaggaagagaaattgagaatgagcaaatcaatggacctttttatctctacaacaaaaactctgtttcctataatcatacaaatataaaggatgctgatttggagccttgcaatgacaaatggaagaaaaaaattagtaaagaagattgcagaaaagagaatgcatcttttagtaaacagtttgatacaagcccaaaacctgaagagaaatgctattcacttatcaagaagaaaccactttctgtcaaagtagacagaaacaagacagacacatttaggtattagctttttaagaaatattaatagatttttacaccttaatttgcagcttccaagatgaagtttatattattggctagagtatattacatgttcaaaagattaccaataatttcttccaaagtcctggaatgaagataaattatgaagttagtaataggtggtgatcttgtgtcttctggttcccatatcttatctccaagtaattcttgggtatgggcatttcaaggaattggtaatctttaagaagttatatgtttttatactgccaggtttttgtttgtctttttaaatccagggatatactaaggagaattcagcttttgttgtttttttggtgttttgttttgtttcgttttgagatagggtctcactatgtagctctggctgtcccctatgtagaccaggctggcctcaaactcacaaagatccatctgctgctgcctcctgagtgctgggattagaggcatgagacactcaccaggccagcatctattttttatgcagcttctcaggctgtcctttgctgcttttgacattcatagactcttttagcaggaagagatcttagcaggttcttattctgtagagaaaagttaggtttgagaaacgaatagagctcaaatcctcatgccttcttggggtcccaggagacatgatttgatgtaatccctactgtgatttcagcatgactttagtttgactagattattcttcaagatagaaggaatgagactgtagtgtttctgtatttggctgatggaagaatgctagtgcacatgtgccatggcaggtatgtagcggtcagaggacctcttttgggggacaattttaggagttgttttctttccttccaccatgggttctaggaaccagacttgcattgcaggttctttcttgtacctgctaaactgtcttgctgttccacagttaatttctaaatagatttagtttcaaaacattattctaagcttctcattgcttttggtgagaattttttttaaagatttatttatttatttcatttatatgagtacactgtagctgattttagacacaccagaagaggctatcagatcccatttacagatggttgtgagccaccatgtggttgctgggaattgaactcaggtcctctggaagagcagtcagtgctcttaaccactgagccatctctccagcccttggtgaaaattttaatagttaaaattttaggtttcgtaatagcttttaaagtatggtggtatttcagagtggctgattaaaacgttttgacaataataaagtagaaaatagtctgattatttttttatattaggtgactttaatgccttatgtgtttgaaggtaaaattcacttagaattgtaattattgttatttgaaaagagctcagaaccatttatctatacttattttccatttgtggtttattagttttataacatgtaattttagtgcctaaattatggcagaataattaaatctttttaatatttagctatcttagcattaacaaattccttccttggcaaaatagcaaaaattacaaatttaattaaatatttgaaattattttaggtctacttctagatattctgcagagagacagatatcacatgatttggttgctattggcaaaacaagtgacaattttcatccagtatttcaacatcttgactcgactcagaatcctgaaaataaacctactgaagaatttgctcaggaaatcataacactaatccacaaagttaaaggttggtatgttttacacaaacattaagtatagcacaaaaataatgtaccaacttttcccaagatacaagtacctttaatgtagcttaattgtaattaatattccattttaagtaggtcataaattaggaaatctgttggagagagtaccagacattcactcaagactagtttttctttttatgtattttcaataacttcctgcttttaaatgctagtagattacaaaaaattagtcagaaaatgatcagactactccaaatgacagacattaaaaagcctaataaaggaggaagaagcaacaaaaacaggtatacgtcctagacactgcagaagtctaggttattttgtgacattagcaacacttccccaaggcctttctaggactttatgctataagcttgttcatgtataatcagttgatgattccattctttatgaaatcaaaaagctaaaggagggctttaaagagttgtattgcttctcataagtgtccattggaaaatcagtgatgtaaaacaactcttcctagtagtactgcataaattattataagcaagagattcttaagaatgtcaaatttttatttgctttaatttttaccttaataaaacatttttgattttttgagacagggtttctctgtatagtcatagctattgtgcaacttcctctgtagaacaggctggcttggaactcagaacgtagagatctgcctacctctgcctcctaagttctggaattaaaggtatgcatcaccaccacctgactatgaaacatatttttaaaataatgatttgggctgaagagatggctcagcagttaagagtactggccctagattccgttcccagtacctccatggctgcttacagacttctgtagctccagctctagaccgcttttggacactttgggcacaagtcacacacttagtgcacacacaaaacacttatgcacataagtaacatacattgaaaaataattactttctctcctatcccttaagtgaagggaaccaggtagatgggagctaaaggtttagttcaatattaaagctcttttccaagaatgggtaaggccctgagtttgatcccctaaaccttaattttgaatatgaaaaaatacagtttgtcagaaaccgtttaccctctcaactctacctctttttatccaaagagtatagttttcagaaagtatggtggtagtacagaaaaacaagagagtgtcccaaaatgggactagtgaaataggagagaagattgcttgtataacattttgatgtattctttctgtactactattaagagcttgtagcatagctgattttagaatgtctttatgagctgaagttaatgcaaaaatgacgtggtgttggaatgtactctgtggtatttaagcataacttaattcaacattcattcagagattagtgtgattaaattgttaattgatttaattttcactgttgaactatagagtatcttccaaacttcctagagtatggccttaccatgaagaagaatgattctcactttaacaatttcttctagataagaaagcaaatgtggcagataggaagaaaatccttgaattcataagtcaactcttgtttgggtttggggaggcatgtgagcattataagttaatatacaaagagtgtgggccatatttcttttcaaaggagaacagtttggattattttgatggtcccttcttgatgttgagttttatagaatcttttaagggcattcagtttcacattgacatggaactatttgtttccttttttagcagatagttttgtaacacctgatattactctaaatgaacgtttctcaagaataaaaaacagacaggatgcagatttcaatcaaacgaaatcaaattcagatccagaatttcacaggtaatgattaattactgtcttttcacttacctcagaagaatagtccagctttctgagctcgctttccttctgagcttggtatagaacctagaagtgcactttgtacgtaccaaaagcagtctgagcagctgctggacccatacacagtgctaacttaccactgtttgaaaagaaagattcacttgctctcattctgctatgtctgtagtagctgtctactgaagggaatgctggaaaaggtcagccattgaaatcagggcttactttaagtggtcacaaatgattgttctgaggtctgatgaaaacatgcatgccttctgtcggtacttgtctgagcagagggtgcaccctgtatgcagtactgagatgaatcaatgttataattttatccatcaccaaaattgagtttgaggtcacactagtgattggagaaccaccaagacttccctacaatacacccatagggtatgtatggcttagtagactgccatgtaggtgaaagcctatcatggcgtggtggcacacggcattagtcccagcacttgggaaacaggcaggcagatacctgaatttaagggagtgagtttcaaaacagccagggctacattagaaagaccctatcttaaaagacaaaagaaatgaaaagctacctgacagcaggttgttttggctttttctaagacctactggtttatttctaattctatcctgtagtaaaagaatcagtgtataacacaattagcataattatttaattatgtgcctttattattttaggcgaatagatatgtctttggatgattttcagaataaatatacgatggtatatgaaccagataaggtaagtgagtacaattattattgctatagtagtgggaaaggagttaaaggtctataaagaaaggatgacattcaggaatataaattgaaaaagttctccaagtgactgatggcagtccaggatggagtgagatgctgaaaaggacaaactttttctttgggaggcatggttagtaagcataacaactttgaaaagttgatttaaaattacattgaatactcatccccaaacttctcagagtaaagcttatagaaaatatggttgatagccagccattttgcaaatctggcatgtgggatatacttttaattgtatgtggaagcaatgcaaaggaactgtggcatttggtgctgcctatctgtttgctgtagaatttaggaaagattctgtggaataaaaactagcaaaataatgaagctaatactaaatttttttcattatcattatatatgttttctacccaatacttcccctcccactctctatttctttcctgactagaaagacttctatgactgatcaggttagaaaacaagtctttaaaagcatgtcaacttctaaatgtatcattaatttttcctttgagaatttttctgtagtgaagagattttaatttatttctgatagactatataaataatttttatttatgaaataaagattcgataaatataggtagcttagtttattgaataatgcttttgtaacatttctagttatagttgatctccaggaaatttgaagacttaaaaaaattcataatcccagtttggcatggtacattttaacagtctttcagatgcaattcagtataccaataatccatagcatttcttttatgtaaaagttctaaattctccccatggtcctttataattgatgtttttaagttttaaaatttttagtaaatgtttttctatattgacttcataatttattaatttttatggctgtatagttttgtttgacttatttgccataacatcctgcatcattcttttttccccttaaattattttcacatttaagttgtttcattttttgttattttcagtatttttaaagaggcaactttttgggataaaatcttggaagtaggattcttggattagtataagagcttttctgattctgaaccatggtggcccacacccttaaccctatagttgggaggcagaagctgacaaatttctgtggttcaagactagcctggtctacatagttatggccagggtagccaaagctacacatagaaaaaccctgtctccaaaaacaaacaaaatagaacttcagttgtgtctcaaaatacttttatcagtttatactaccattagctgcatgggtataaaataattaaggactttaagtttctttttagaaattgtctttgtgctactaacaataatgtgaataatttgtcttctgtcaaaattcctcagactctggtcaaagtaatagaaccaaatgatctacgacatgacattgagagaaggagaaaagagcgattacagaatgaagatgagaatatttttcacatggctagtcctacagagaggtaatcagtaaatgaaaaacatcctgctatctgggagcttttggttttaggagcttttacattttttgtgcttaatttttgcccgattgttcgatctgttttgtgtgtttttaaaatgtttcagttattcagtggtcattacaggaagcttgttctacacattaaaaatggagtgggtgaatatttgaggtcttttaattctagaagtgaagaatatccaactgtttgactattagcaggagctatgaccagcaacccttatgggctatttgaatccagcagtttgaaacgaataggtttagacccttagattctgacttaggagtacaacattttttgatgtcagtacagttctctttgggaattcttgggtctatgaagtagacagttgcagtagaacaagtggaaggtatggtggcacacacctttaatcctagtactgtagagggagaggcaggtagatctgtgtagtgagaccctgtctcaaaaacaagacaagacaaaaaacagaaaagaaacagcggagggagacctcaatttggatctcattgactctgcccatttacaaactgtcaataaattttacgaatctttagaattttctccatagtatagtgataagaccatcttattatacaggggcagctatactcttaagtcactggcatcttagcagaagttataaagatatcattgtcatatcattgttaaattcaacctcataactctttccaggggtctttagtcatctagattgaccctagtctacctctagttctaagaactagtaggacctatgacgattgtgtgaccccaaaggattatggggaataactgaatgagacagactgtctagtttgggcaagggttctttgtgtccctcagaaacaggactatgaataggaagggatagtgctaattgttcttctataacctttagtatcaactttttaaaacattttaagtatttgactagataattttaagtcaactccaaacttgattaaccttacccaaaatacatggagcttgttttaactggaatttattttgacagtaggtttgggattgattaaaagatagtgaagttgtgttttgcatataaaacaattggaaaatgcaaaatttttgtcttttcctgggtaaaagtcaccaatttcctaatattatatgcttaacacatggtgtcactgtgttcagtgacaagatgtctaatatgtttttcttagttgagaaagcttttgaaacacagtataccaagaaacaggatttttttcaatatttacaatgataactgtaaatgtcccagggcagatccttgccctttgagatgatagatcttgaatgctggcacactacttgggtttgatgcccagctctaagaatcctagctatgtggatgacttggggtaggttacctagcctgtttcctcatctgtgaaataggactgcttacatcatactgctgatcaggattaagtatagtagagctggttagcattaagtttaggaatgctagctttgaggatggtattacagcatgaaacatgagaattttaaacctttttcagtattctttgccatcaaattcacactttgtaagtaagcaattgagttgtttttactatattcacagagttgtataagaaccacttatcccaaaaatatttagtcactccagaagaaaacagtgtacccagctgtgaccccccccccatttttctttttcccttccctggcaaccactgttatacattttgtttctatggattgcctgtttttgacactttatataaatgcaataatacaatgtttggctttttgtgacgggatttcttattttacgtagcatgtattaaaagcttattcatgctagaaatcgaggatttcttttatgactaaataatgctccactgtatggatgtgtcatatattgtttatccatttatcagttgatggacttttggttgtttccactttttggttattgtgaataaatagtgctgtgaacatttgtgtgcaagtttttgtgtggtcatatcttcatttttattaagtatatacttaatgtagaattgatgagataggtggttattgccaaactgttttccaacatgactacatcattttatcctatcagcaatgtgtgagaggttcaggtccatatctttaccaacacctgtggggttctttctgttttttttttttgttgttgttgttgtttttgctttttgttttttaaaatgataccagggctggggagatagctcagtgggtaaaggtgcctgctgtcaagcctgacaacttgaacttgagttcattttgtggaacctatctggaagaagagagctgaatctcacatgcagttctctgactttcacctgttcatcttgacagggacatccacacatttgcacatctatgcaaatatacactctttaaataaaaatgaaatttagaaattttaaacgatgtagaactgttccatctttgactcagttcaatttccttattaaagtttacccttttatcttagaaatgaagtttgccaaattgatctcgtttttacataagtaaatttcagcatgtagtttctagagaaattcagataaagcataatgtcacaaatcataggatttagtgatttccttttatgggattgccattaaaatgtaagttatttgaaggctatctgtgtttgctcagtgctatattccagtatcttgaattcagtccatatttgttgaatgtgtgacgactttacagagccgcagatggggcagatgatactttagctataatgcatttctatttgggttactattcctttttgttttgggatctttgccagcaagcttaattcttaggcattccatccaatgtctaaggcagttctctattagctcctcattgcgatcaggatcttaccttgatttctcccaagtcttatgctgtttacaaagactattctttcttctaaccagtgttactaagtcccctacaatataattgaaatgtgttttatatatatatatgggctgtgtataatttaaaagcttaaaaattttatcagtgaccttaaaaaggacattaaactaccaaaaatttatcagtagggaatttagggaaaagatagtttttcttataccaaacgaagttgaacttcatagagttcttttcatatataacagataagtatgtgtttattttctttttgtaaagctgcagttctatgcattggagatacagtgaaaaactacacaaagctcttgacgtcttagcacttaggatttaatggtaggagaaagaaaatgttggtgtagtaatggttaaaaactaaggtagaagtggaaattcagcaggaagagtgacttgtgtgatagggttttacgattttagtgggcatgtgaattcactgaaggagtcagccaactacattatctgagcgtatatacagtacagcgaaccaactgcaaagatcttaagcagaaacatgttttcttcttgaacttctaaggactataattagatctagtgggtatcccagtggtataaaggggagatggctcagtgggcagagcgcttgctgaacaagcctgtactagattaggtccccagaataatcctgttatagtcctttttggagattggaaggcagagacaatctaacaactggaggctatggactagcctagacaatataacaactggaggcttgtggactagcctgacagacatagcagtggacaaacaagagacctggtttttaacaagggggaaagtgaagaatgacatcctaagttgtcatctgactttcatatgtgccctgtggcacatgtgtgtctatacctagatgtagacaggcaagagtacataacatatacaaaaggagaaaagtttgtagatgaggccaaatcatgaaggatatgaaaacaattttacagtgagtagaattaggaacatttgaggttctaaccaaagaaaagtcataatctttgaattttaaaaggattagcatggccacagggactgtaagagttacagaaaaaagccactgttttcattgtatggcctatttcactttaataatggttttaatttcatccatgttgtgccatatgtcagtgtttatttcctgaaaaagagctttgaggctggatagactacattgtttttacctggttttatgtggatgtttgtgagttttccaccttttgctttttataagtggtgttattaggaacaaggagtgtgactttttttttattgtagcctttttattctactgagtataagataacattacattgtggttttgatttgtatttccctaatgactaaagatgaacatttttttcatatgcttattggctatatatatatgtctgtgtgttttatgtggataaatttttgttcaaatccttttttcattttataatcaagttaatgtttttactgctaaggtatgagaatttgggagttttgtttttgttttgagacagggttccattatatagccttgactggcctagaactcaccaaactgaagaaatctgtttacgtttgactctgaagtgcttagtatgaggcctgaggcgccacatctagataatattgattttactatttaggccagtgagctggttcagtgggtaaaggcacttgcaccaaacctgacagcctgagttgaattcctgggacccacatgctagaaggaaaatcctgactccagcatattttctcctgaattttatatttgtgctttggctccatataataaataaaatataataacatgttaagagttttttatgtattgtagatactacaggctgagcgttactgggaatttttgtgaccagagttaactcagattttagattatttggaatgcttgcatagatataatgagctattgggaggatgggccggccccagaactaaacgtgaaattcatttatcttattcatacacagaaggaaattttataaaatatttaagtgtatctgttttgactgacttgtatgatcaggtgtagaatttttctttattttttttaagaatttttctttatatttgtgcttagaagactttagattttggaacatgtcacatttcagattttcatattagagacgcttaacctgtattcctttattagatgtgttttgcaaagcaaattttaaaaacataagacatttgtaattttgctagatagaaatgatcgcttttaatatttaatctattttttactttatcttttttataggcatctatgtgtacttttaagtactgaaattatcttcaatgcatagtattacagttgtaccttgctgttttgacttaatatcacatcacaaaacattttgatggggcagtaggtttttgaacattttataaacgctgaactctcagtctgtatcaggttttggggccacaaataaggcaactacagtggaattcaaaacatattccattaaaacacagaggtataagtagtagttacaaatagacatagggcttaggacttctaaatgctgtatatgtcacagtagggctatctattcagataagtttaggaaaatttttggacaaggtacaaatggagccgaactttgaagttaatctaaatggaaggaaatgaccacaggaggaattgcaggtacaaagttgtggaatcaggaaagatcatggtatgtgctgggaactatatgtacgcagttaactatctaaggttcaatgtatgtgtttggggatattgggagaaaacaggtagtaaagccataaaataaagagctagggcaagaaggacacgggaaaccatcagcaatatggattttatcccgtacaaaatacctgggaagggctgaagcatagcagttggctcactatggaacagggcctacaaaagactagaagaggtcttaattgcattgtggggagatatgacaaggaaagaattgccaaggcctatagaaatgagccttccaggatgttcctcgccagcagacctaattgtcagagactcttgctgtcattgtcaggagctaggagcctgtcctttgcagtatcagagcccataactttgccagtgaggtgaccatgttttaccttccctcttataaatgagataggtcaggagtcactgatagatacttctgccaagtagaatctcaggaattgggcgggggcaggcagtgatgcttttacttgagggggaaaaacttccatgtatcagccaggaatcctgtcattgaacctcagattgagaccccctagtacaaggaatatcgctttctctactgatagtttccagcttagttaaataatatttgttgaaaatgtcagtcttaatgactatcctttatcattttcgtagtgacagagcattgaggttttactggtgtgcggtatgtttgaagactttgctttttaactgattaaagtaacaagattcttttttccttttgttaggaatcatcagtctcccagtttttcaaaggtgaagactattcgtgctgatggatttcaaaagcctccacattttataaaatcaaattttagaaaatttattcagaaaccttacatagtaagattggagtttcaagtttttcatttttgtatattctttataaatatatctatacttttcaaagtgcttgtaacttcattatgtgttataagagcattgaggcttaaagatttttatgacataatataactcatctcttgatttagttgaagttcaatttattatagtactgattttcttaagctgttttggtaacaacttaattaagatataatttatatactctaaagttaactcatttcaggtgtataatttggtgagttttagtaattctccaagatgtgttagagtcatcaccatagtccagttgttggacttgagacaggatttcactttgttgctcaggctaagcaggggaactcaccatatatcccaggctagcctcaaatttgcagctctcctgccttcaccttctatgtgctaagatgacaagcatgtggcaccatatctgagtaggatattgtcattacccagtaaacattctcatgccttatatttaattattccatgttccaaccgcccaccaaaccactaattgctctattttaaagatttgcttatagaatggatcatgatataatagccagccggcagctcttctgtaagtgatgactaaatgatggaagccaaagttagtttgttaccttatgctagaagtaatatcccattacttaaccatatggttattacaagaagcaagctactagatcatacccacaaagagaaggatcattgatggagataattaggagccatgtcagcagctgcctagtacaatcttccctctggccagactccacagaaatggattaagtagaaggtaataagattgttggttttagaaataggaaactggagaatgggtaccatcttaattgtttctgctagaggatttgggttctctgtagttagaatgctaatatagctatttttttttctttttttgggccttcccaagctattgtaagaatattaccttcgatcaattaaagtcgatgtgttgggctaacatgcctactggcagtgtggaaagttggtggggtttttttgggcagtagaaaccctttaccaagtcctgctggcaatgggtttctttctttccaagatacatacatgagtaaatgctagatttatagtccactttctaaaagtcaaccatggtgttatacagagtgtttgtttttacacttctcacaggcatgaatgaaacgggcccctcacaaactagcatgggtcatatgagagaagaagtatgtaagctccatgctccctggtttggggtcttaatcttcaaaaatatgtcttaaatggtgagactagtttataaagtaacccttaaggtatattaacccataataatactttctgttcagaactatactatgcagagaaaagatgccattgatcagaagatatttagagttgaggaaaatcatcagaacagaagaggctctaaaggatcttttaaggtattgagtgttgtttttctgtttatatctgactatgggcttatatattggaaataattgtgtcagtacattaaaagttatttttgtagtcttttaaaaagttataaactagtgtttctagtttctataaatacttctagaatttatatttaatagttaccagtttaatactgccatgtttcttcaggatttgactttgaatttcatttttactagtggaaccctgttttcaaatagtaatgcacttgcttctagaaattacaaaggatttaagacttagagtagaggtagattccatctataaacatgtgggctggctcacttctcaaactgttctaggcggttgcttgaaaatgcaactagccacaagtgtatgaagagtgaatgaggaaggtttatagaattgtttggaaaggcttacataagatttgtgtatgtctgacaaaactaaacattcctcccacctccagcatacaatgacaagatcaaaaccataaatatgtacagtccttttatgcttcctataggacagaatctagttttcatcattcatacaattaatatttgctatttcatggtaagaaaagatgaaggaactggcaggaataattttattttatttaagcatctgtgagtatatgtacatatgtacggtgttatagtgaatacttaatcagtttcgtctatcctaacttttatcgttcagttctctgataaaagacacacaacctttatatttataagctttaagtagcactagagctgagcaggtaactaccctctatgctattagaatctactttcccatcagtaatgttgagttagaatttaccatgtcccatctgggctgctccaattccctagccctcatggctatattttcctgatccacctacctaccccatggcagtgtcgtcttttttccacctccctcctctctgcctctttcctcctcattcacctcaggcctcagcctggggccttaaccctcgcctatgtcttttccgccagctattggctgtcaccctctctttttaaacagtaggggagggtacttgaggggtgaggttacataccgtcatttaccatttttgtaagtgcacattctcatgcagattctcttgggggggagggtaaccatgccttgggggccagtgtttagcattacaatacaagcaaaaatcaaaacaaaaacaaacaaacaaaaaacccaaacctcaacagtgtgggcacccatggagaccagaaaagagtcttggataacctggaattgaagttgcaggcagttgtgagcaactcactttagatgctaggagctgaacgtggttcctctgaaagagcggcaagtcccatcttctcagtctcaggaataaagtttacaccttgattgtaggtatttttactcttttccccatcactggcacttatatagtcactgtgaattagaaaaataaagttagctatttagaacataggaagattattttttcaatatgatgaatgtcaagaattcatttcaagttatttttatcttctttccaaatgtgtatgtgtttattcatgaagataaagcatgtatgtgcacatacatgtgcagaccagaggttgacattggatgtcttcctcagctgttttccaccttctttttcttttattgataattttttctttgacagcttcttacatgtgttagaatacattctggttacttttgctgtcaccatgtcctctttttctcctacttgtcttctccctactttatgacattttgtcctgtgttccacagggtttaactaggtttgtatgtatgtcctggggtttgaaactgtccattagaacttgataggttcatcagtggcaaaacagctggatattatgcgtcccctgtttccagaatctgttagtttcagtagttctacagtgtgtgatagggccttaagtcatctttaccacctgtagctgactagtagatgtgctagttcatgattgccttattcccccaggcctatatagtaccatctagcattgtgaaaactatccagcagaaagcattcagctcaattccaacttgctttctctgtatctgtctacttctatagacaaccaagatgaatggtaatagccctgtattattttggaacctctggaacattcctgatggagccttaaccactatgggagtgtcccatacctggcactaggtgttttgtttagtgacccttacctaacttgcttttctgttgctgtgaaaaagcactgaccaaaatcaccttttggaggaaaggtttacaggttacagtcattaagggcagccaaagtaggaaccttggaggcaggaccaaaacagacaaaggaggaatgtcactaactggcttgctttccatagctttctgagcttgctttcttaaacagtctaggaccacctgcccagggagggcattgtacagggagatgtaccctcccacatcaaactttaattaagaaaactcccactgactcaccatactcccatctgatggatatagtttttcaactaaggtttatcctttcagatgacctcagtctgtgccaggttgacaaaaaaccaccagtacacatttgtccttttgtcagctcttcacacaaacacatcaatcactattaaactacgatctttcctttcttatctttaagatctcatgttaatagcacaatgtaaaatacactcaagtttaaaagtcctttaagtgtaaaagtttcaagttgtctttgaaaatctagtctcttaactatgagactcccgtgaaatcaaagttagttaaatgcttcttatttttttaagtacttcttattccaaaagggaataaaaaagtacaaaaagttcactggccagcatttgaaccttgtcactgccaacacagaactattacatctaaggctggcattgtctagccttgtgaagtatctgtcttcaaattcttttatatatatatgtgtcaattggggtaccacataataggtgttcaggtgactttttcatacctccgttttcatgagcatccctgtcacctcaactctccatactctcaccccctccctgtttgaagtttattcctagtatccccctctccactcttaattttgcctgtattctgctgtctccattcccttaaggcaacattgcccactgtctactctctgttttcccggattccacaggtattccaagttaaacacctaaaactaaagagttgaggccaggatctgcacagaagagagatcatggattgttagcctttctgaccctggtttaccttgaatatatttttctagtttcatccatttccctgtgtattccattgcacaccatgataatgggggtgcaaatgcctctgtagtgagattttttttttttttggagtggtatgactaggtcatatggtagtctgtttcttatttatttatttatttattattagatattttctttatatacatttgaaatgctatcccgaaagttccctatccccgcaccctgctcccctacccacccactcccacttcttggccctggtgttcccatgtattggggcatataaagtttgcaagaccaaggggcctctcttctgtttctaatttttttgagaaaattccagagtgatttctaaagtgtatataccaatttacctgtctactagtgggtctctttacctactacaaccatactagtatttgttgtcttttgtatctttgatgatggcctgtctcagtggagtgaggtgaagtcttaaaaatatcagtttttaaaaattttatgtatctagacacttgctgcatgtatgtcaatagaccatttacatacagtgcttatggaagccagaaggtggtgtccaattccctggaactagagttatagacagttgtaagctgttgtatggatgctgggaatcaaacccttgtcttctggaagaatagccagtgctttttaactctaatccatctttccagtccttaaaatagttttaaattacattttattgatgactaagtatgttgaccattttttaagtgttttctagccattcccgcttgttcttttaagaacgctctgtttagtcccttagcccatttgggatgtttgctttcatggagtttagagttttgaatctccttatacattctagttaataatcctctatcacatatgtagctgagagatattttctctcattctgtgtgcagcctctttattcagttaatggtttctcatgctatacagagtctcatgagattctacttatcagttgttggccgtattgcctgtgctattggagttctatttagaaagacctgtatacctatatgttgaaaatccttatggctatatgttaaagtataatctttactttttcattgagcagattcagggttccaggtcttttatttgtaatctattggagttgacttttgtgcagggtgagagatagtatagggctaagtgcctgcatcaaaaaaattgagagatcacaaataatgcagcttaaggccttggggcgggggaacagagcaaactgattaaagaagtagaagaaaagaaataattaagatcagggtggaagtaatgaaacaaaaccaaacaaaaatgcaaagaagcagtaaaacaaagaatttgttttttgaaaaaatagaattgataaacccttaaccagatttaactcaaaggaagagaacaccaatttataaaactagttatgaaaagtgagacatgaaaatagttatcaatgaaacaaaagctataaggatataccttaaaaacctatattctattaaaaggaatggatgaatttctagatgcatctaacctaccaaaattagaccaagatgaaataaataagttaaagtgacaaaccaataagattgatacaataaaatttctcataagcaaaaatctccagtgccaggtgatttaattgaagaattctattagaccttcaaaaaaacctaccaccagtgcattcaaattattttacaaagtagaaaagaaccaatgtgcttctaagcaattttgtataaagccgatattgtgctgataccaaagtggacaaagtcaacaacaaccaatgaagggaggaaggaaggaaaaaaagaaggctcaatttgtctgatggacatagatgtaaaagttctcaatacttgcatattgaattctgtcttaaatcaaaaatgttcttgtcatggtcatgttgccttcattctagggatactgggatagttcaataaatataattcattgcataaatgaatacaaagatagaaatcacatgatcatctccatagatgttagaatagccatagggaaaatctaaaatcccttcatggtaaaaatcatggggattgggggtgtgtgttgctgaagagatagcttagcaaagatcactccttccttttggagaggaggtcttgtttggtttccagcacctagtagtttacagccatccatagctccagttacagaggattctgttctggcctctgagtgtactgtatgtatgtaatgcatatacatactggcaaacataacataaataaatctaaagaaaaataagtaatgaagagattagagatagaaggaatgtacttaatcatgataaaagcattatgtctcaaacctagccagcatcatactaaatggaaaaaactcaaagcattcccactaagattagaacaaagcgagggtggccactctttactgctactttggattatgcttgaaatctctgataaagcaataagacaagaaaaggaaaataaaagggatacaactaagaaaagtcaaagtattccttcttgaaatgatatgattagagaccctggataaatctcagaactgagaaaacactttagtgtggtggcagagtgtaaaattagtatgcaaaagttagtagtcttcttatataccaattacaagcatactaaaaaaagaaatcagtaaatctaattcagagcagccacacaaaaaatacctgacaataaacttaaccaaggagacagaagacttcactgtgaatgttttaagacaatgaaggaagagagtgaggaagatactagaggatggaaagagttgatatgctcatggatcatgttcaatactggaaaatcgacagtccttccaaaagcagtctacagattctagggacattcttcataactatggaaaaaacagtcttaagatgtatctagaggcacaaaagacctaaggataactaaaacagttttgaacaaaaagaatagtgcaggaggtatcaacatatgtaattttaggctatactacagagcccgaaaatagtaataaaaagagcatgatacttgtaaaaaatagacacagatcaatgggatagaggacctggatataagttcacgctacctgaatttttattaagatactagaaataaatactgtagaaaaatagtatcttccaacaaatggatctgggagacttaaacatcaacatgtagaagaataaaacttaatcgactttgatttttgagacagtgtctcattgagccaggaattcaacaatttggataggctggcttaccaatgaactccaggggtctgcttatcactacctccctatcccaacacttatcattggtattgtcaggtagatgaaatctaaactcaagtccttattcttgcttagcaggcacattactgactaagccatctttctagctccattactagcaattaaaaagaactattttctatatagcaaaaatttaaaatataatacagaaaagtatactttagtgcaggtattaaggcctttttaaaatacacatggtgcctagaatcaagggctattttgaatattattctcctgcctgttacagaatagatttggaaattgtatttttaacatttgattctctttggatcctttacagaactttttgggtggcagattccagcctcattataaatcacacctggtacagaagagcatgtatattcaggctaaataccagcgcttacggtttgctggaccaagaggatttattaccaataaattcagaaacagatttctgaggaaaaaaaaggtaatacttttaaaaatgctgaataactttaaatgtttgctagatatttggggttttcatctagtttaagaaacaacctgctggaccagaaagaaagaaagaaagaaagaaagaaagaaagaaagaaaggaagaaaggcctagattttaaaaattattgtatgattattgaatgaaaacttcaagagtaatgttgatagaatgttgttgtaaaactatttaagcttaatttttttttttttgccattttacctgaaacaatttgaacatgccagcttgtagtataataaaacttaacttttccttgggagacacaacacacacaccctacccacctcggatgaggaacccataacagaacaaaatacagataccactaaagtttcacttagggggccagtgaattttattggggttacttatgggatcagaaatgactcaaatatagctgcatcaccaaaacctacccagcatgggtgacagctcacaaagctggaaatgtggagcactgcacagtctgcaggaagctcaacaggttggataatatttttccagatgtctaagttagtcaaaacctccaggcaggtaggctggtttcttccagttagtggatctggtctcagaatctttgaagctcttctcctcttaccttgtctgagtcatggcagcacagctcccatctaagagccatttttgcaactcagctttcttccatctgagagggacttattgtttaccctgacaggaagaggcctggtgcttctggtcagtttcagggacttcctgaaacagtagtgaattgtttacctcctgctcaaggagcttccatgaaggatggaatatatttttttgttgttgttttgttttgttttgttttttgagacagggtagctctgtatagccctggctgtcctggaactcactctgtagactaggctggccttaaacttagaaatccacctgcctctgcctcccaagagctgggattaaaggcctgtgccactaccacccagctggatggaatatcttgacctcagagaaaactataatacagcatagctctttaaaagttgtattttaacatttttgttgtgtagttaatctttaaaatgaacatttaaggaaaggctctgaatggcctataatataacagttttacagctagaggccagagcaatgtggtgtctgtttcctgttgtctttcatggttattctgacactgtagatggcatccaagtacactggagtttgaagagtcaggatcagctctgggcattatggcccttcagcatggggaatgcagaggcaggaaacttaccacaagttgaggccaaaagcttgctctgacattctttccacacactcttccagcattgcttgtgccttagaggggttggcataaattaatgtcctgtttttgaatactcacccatctttttgaaacatcttttctatcattctctgtgcagaaaagcatctctgatcaaagctgggagtatcatttgtctataagtataaacacatatagacttcagtatagtgccatgttaattttaactaaacaacagtagtaaggcctgtcccaggacttaggaccttcccagccataggtttttgatgtggtttatagtactagacttgtattctggcctatggagtggtctttaaatccagcccaagaacacttatttttaccttataacaattgtactcctattataccagtggacacatcttaccttgccaatttacattgcagcatacagaatccaaagagagagaggcttctctggccaacaattagtaaggacatttcccatacctggcactgggatttttttttttgataataagtgacttttagaagcagtattatacagctatagataatacccttccactattaacatttttttgtttggttggtttttcgagacagggtttctctgtatagctctggctatcctggaactcactttgtagaccaggctggcctggaactcagaaatccgcctgcctctgcctcccacatgctgggatcaaaggtgtgcgccaccacacctggcttcactgctaatatttttaattggcttacaaagcaaagatttccatatgtttttataaactaaactctaattcctgtttcttagtattatatgtgtgctgatttttgtctcttagtctggctactgactgtgcctgtgagcaagattgagataggcttttatagttttatttaagcaaagtccaactcttgagtgtagcatgaaattagatgccctactattatatagcatgctccataacaattgaactccattttcttaacctttggggaaaggaatgagatatggcagctaatatctttgccaggtttgaactaagacctttaggttatccctctagcatgtgctactttgaaactacagcccatgtgggaaaatggatgactggtcccatcaatctattttacctcagtttttattccctaaaaagaatgaagtctagaatcatttgtttctgctaatagtgactcccattttctttaaggacacttttgctcaaatggggctactgagtgcagggtaccattcatatcattttgtgatattggagataaaactctggaacttacgtatgctgagcaagtactctaccattgagccacacctgtagcctgcagttatatcgtttaatgtcccaagttttggcatcagagggaacttcaaaattctgccctagagacgccttaatctgactaacatcttgtactggtttgaatgaaagtggtccccatgggttttgaggtttcaaaagcccacaccaggcacggtgtctttttctgtctgctgcctattaatcaggatgtaaggctctcagctcctgctctaactccatgtctgtctgcttcccaccgtaataataataatggactaaccatttaaaatgtaagcaggcctcaattgcttacttttatactttcttttataagagttggcttggtcgtggtatctctttgcagcaatagaaccgtagctaagatatacctcacattttaactttctgcagtgttagaaaagccattcttttagcagttagtagactaccacgtggattaattaattgatgcatgattaactaaatagggtaggtgtcataaaattagagctagaattacttattaccatatacctggtctataagaagtatttttaaattaattatgttatttatttacatcccaaatgttgtcctctcccagttcctcctgccagaattcttttccgcatcctccatccctttacctctgagacagtgccccccccaattccccaccctgggccatcacatctctacaggattaggctcatcctctctcactaatgccacacaaggcagccctctgctacgtgtgtgccattgacctcttaccagcccatgtgtgctctttggttggtggctcagtctctaggagcttccaggggtcctcgttagttgacacttgtttttcctatggggttgccatcctctttagttccttcaatcctttccctagctcttccagagggcccctgacctctgtccaatgcttagctgtgagtatctgcatctgtctcaactgatggtagaacattcctaaggacagacatgctaggcttctgtctacaagtacagcatagcatcagtaatagtgttagggattagttcccacccatgggatggatcccaagttgggctagtcactggtaggccattcctttagactctgctccatttttgtccctatatttcttttagtcaggaacaatattgggtcagaagttttataagtgggttagtgtttccatccctccactgggggtcctgtccaaatactggaggtgatctcttcaggttttatatccccacagttgggcattttggctaaggtcacctacattgagtcctaggagcctcccccatctgaggtctctggaacattctagaggctctgctaaccctggcagatgaatatttccattcattctcctgggcctctctcctatctccccacaccatatgtgctcctgcccctcttttcccctctcccttcatcctcctacccaggttcctccttccccctgcctcctatgattattctattcccccttcaaagtgggatttaagcatcctcacttgggccttcttgtttaatttcttacagtctgtggcatgtatcatgggtattctgaactttttggctaatatccacttattaatgagtacatactatgcatgtccttttgggtctggattacctcactcaggatggtattttctagttccatccacttacctccaaaattcatgatgtccttgtttttaatagctgagtagtattccattgtgtaaatgaaccacatttttgtattcattcttccgttgggtgacatctgggttgtttccagcttctggctattacaaataaagctgctatgaacatagtggagtacatgtccttgtgatatagtggagcatctgggctttgaggtaatactatttacagttttctgaggaactgccagattgaatttcagagtggttgtacaagtttacactcccaccagcaatagagggatgttcccctttctccacatccctaccagcgtttgctgtcacctgagtttttgatcttagccattctgattgctgtaacgtgcaatctcagggttgttttgatttgcatttccctgatcactaaggactttgaacatttctttaagtgcctcttgaccgttcgagattcctctggagaagtctctgtttagctctgtaccctattttttaattgggttatttggggttttaaagtctgttttcttgaaatttttttatatattttagatattagccctttatatattttagatattagttctttatatatttgggtgtagggttaatgaagatcttttcccaatctgtaggttgccattttgtcctattgacagaagatttgcattccagaagattttcaatttcattaggtcccatttatcattttttgatcttagagcctgagctgttggtgttctgttcaggaaattttctcctgtgtcaaggcattcaaggctatttccctttttctcttctattagattcagtgtatcttgctttatgttgtggtccttgatccacttggacttgagcttgtacagggaaataagaatggatcaatttgcatttttgtacatgcatgctgccagtcagaccagcaccatttgttgaagatgcttttcctttttccactgtatagttttggctttattgtcaaaaatcaagtttctgtaggttaggtttgcgggtttatttctaggtctttgattctattccagtgttcaacctatttatctctgtaccaataccaagtggtttttatcactattgttctgaagtacagtttgagttcagggatagtgattcctgcagaagttcttttattgctcagagttgttttggctatccttgtttgtttgtttgtttgtttgtttgtttgttttcatatgaaggtgaaaattgctcttacaagtacccaaggagctaaaggggtctgcaaccctataggtggaacaacaatatgaactaaccagtactcccagagctgtgtctctagctgcatatgtagcagaagatggcctagtcggccatcattgggaagagaggccccttggtcttgcaaactttatatgccccagtacaggggaatgccagggccaagaagtagggggagtgcataggggactttggggatagcatttgaaatgtaaatgaaaggcgggtggtggtagcacttgggaggcagagacaggtggatttctgagttagaggccagcctagtctacaaagtgagttccaggacagccagggctatacagagaaaccctgtctcaaacccctcctccccaaaaaagaaatgtaaatgaagaaaatatctaataaaaacttaaaaacagaaaattgctcttaaaaggtctttaaaaaattgtgttggaattttgatgagaattgcattgaatctgtaaattgcttttggtaagatggccattttcactatgttaatccaacacatccatgacatggaagatctttccatcttctgatatcttatttgatttctttctacagggacttgaagttcttatcatatagaactttagtttgcttggttagagttacatcaagatattttatattatttatagctattgcaatgggcgtttccccccaatttctctttcaacccatttatcatttgtataaaggagggctactaatttctttgagttagttttatatccagccactttgctgaagttgtttatcagctgtagaatttctctggtggaattttgggtatcatctacaaatagtgactttcttcctttccaatttgtatccccttgatctcatttgttgtcttactgctctgactagaacctcaggtactatattgaataggtagggagagaatgggctgccttgtccaagattttagtgggattgttgcaagtttctctctatttaatgtgatattggctaatggtttgctttatattattgcttttattgtgtttaggtatgtgccttgaatacttggtctctccaatacttagaacatgaaggagtgtaggagtttttcaaaggcttttttagcatctaaagagatgatcggggctggagagatggctcagtggttaagagcactgactgctcttccagaggttctgagttcaattcccagcaaccacatgatggatcacaaccatctgtaatgggatgggatgccctcttctggtgtgtctgaaaacagcaacagtgtactcacatacattaaataaataaataaataaataaatatttttaaaaaaagaaacactctggtattaaacacacaaattaaaaaaaaaaaagatgatcgtgtgatttttttttttaacccccttagagtttgcttatatagtggattgtattgatggattttcatatattgaaccatccctgcatccctgggatgaatcctatttgatcatggtgaatgattgttttgatgtgttcttggatttcacttgtgagaattgtatttttgaccatttttgcattgatattcataagagaaatcaatctgaagttttctttgttgagcctttggttttgttatcagggtgactgtggcttcatagaatgaggttggcagtgttccttctggttctgttttgtggagtacttttaggtgtattggtattagctctttttttttttttttttaaagatctgattgaattctgcactaaaataatctggccctgggccctgttttggatggtttttaatgactgcttctatttccttagggattatgggaactgtttacatagtttacctgatcttgatttaactttggtacatggtatctctctagaaaatcatccttttcatctagattttccagttttgtcaactattcacttttgtggtaagatctgatgcttttttttttttttaatttcctcagtttctgttgtgtctcccttttcatttctgatttgttaatttgagtactgtctctaagccttttagttagtttggctaagggtttgtctatctttctgattttctcaaaaagccagatcttggttttgttgattccttgtattgttctctttgtttcagccctaagtttgactatttattgggacagtttgcttggaaaacttttttcctagccctttactctgaggtcgtgtctatctttgttgctgaggtatatttcttgtatgcagcagagtgatggatcctatttacatatctagtctgttagcctatgtctttttattggggaatcgagtccattgatgttgaggcatattagtgaccaatgattgttagttcttgttattgtactgtgatgctggtattatgtgtgagtgtgtgatctcttcttttgggtttgttttgagataattaatttctcgtgttttcttgggtgtagttgcataccttgttggagttttccttctagtatcctctgtagaactgaattagtagaaagatatgttgtttaaatttggttttctcatggaatatcttggtttctccatctatggtgattgagagttttgttgggtatagtagcctgggttggcatttgtgttctcttaggctctctatgacatctgtccaggatcttctggcttttagagtctgtgttgagaagtcaggtgtaattctgataggcctgcctttatatgttacttgacctttttttttttttttttttttttttttttaaagatttatttattgattattgtaagtacactgtagctgtcttcagacactccagaagagggagtcagatctcattacggatggttgtgagccaccatgtggttgctgggatttgaactctggaccttcggaagagcagtcgggtgctcttacccactgagccatctcgccagcccgttacttgaccttttacccttactgcttttaatattctttctttgttctgtacatttagtgttttgattattatgagatgggaggaattttctggtccaatctatttggtgttctgtaggcttcttgtatatttatggccatctctttctttaggttagggacattttcttctatgattttgttgaagacattttctgaccttttgaactggaaagcttcaccacctcttatttttattattcttaggtttggtctttttttgtgtgtcccaaatttcctgggtgttttaggttaggaactttttattacacttggcattttctttgactgatgtatcaatatcttctatgatatcttctgcacctgagattctctcttctatctcttgtattctgttggtgatgcttgcatctatgactcctgttctctttccaagattttctatctccagggttgtctcccttatggtttctttattgtttccattttcatttttaggtctttaaccattttatccaatttctttacctgtttgattgtattttcctgtatttcttttagggctttgtctcctctttaataggggcttctacctgtttgactgtgttttcctgtatttctttagggaattattgtatcctctttaaagacttgtatcattttcatgagatggggtttaaggtcacagtcttgctcttcatgtatgttaagatatccagagcttgctgtaggagaagagttttgttttgatggtgccaaattgcattgacttctgttcattatattcttttttttttccctcagaacaggtttattgaccataatgaagttctatatacaaagtgacctaaaccttagtgataaatgctataattccaggatgtaggtatttaaagcaggaagaccataaatttgaagtcagcctgggctacatagttctaggccatgatgggctgtgatcctggactacagtgactgtcaccaaagagcagagtgatgaaagcccaaacaatgctcctctctaactgatgtcttggtaactggctgtcatataaataagggagtccacattggacattaagtgaatggcttgtttctggaactttaatagttttacaaatgagctgagacaggcatgactgaatcccagtgagaggccactggagagctggcatcagatgtcaagaggccattttgtgcacagccactgtgatgccatcgtgtttctggatcataatgttcccattatctgattctaaacataccacagggatgtcggtggggtcagaggttagcttagctgcctgctgggctagaacagttatcactccagcatgctcatcggacagggtaccacggcagcccagattaagtccttgtgaatctgtgcataggactccaacaatggatggattcttcattgtgtcctccaaatgctgctccaaagttgcctccatcccacaggctgtctgccccgggccaggaccccgcagcaaaacacttcctccttcctgttcattatattcgtatggttgcctttcaccatctagttgtctcagttgttaactggcctgggtggtttggattggagcaggcctccccagaagcagctggagctgtgtatccggatttaaagcaggcctccctggaggcaggctatggggtgtctctgattagaacagacttcttgggaaacaggcagagctgttgggtgggaatggggttggtgcccctatcatccagggagtgtgggacagggcaggacagatcccatgtcgactgggctctgtggggtcccagatggcatgggcattggggcgggattctcacctgtgtccttggttggagcagtcctcctgggaaacaggcaggactgtggcgttagggagtgggcatgccaatctgccatgggtgcaggtggaggtgcggattggaagcaagaagtatttttaaataaactttattatttaaaaacttgccaagtaaattagaactcctacagttaatgaacttatataaagttagaaatgacatttaaaatggaagttcttaaacttttctccagggttgcccccatttgggatttcttcattgtctaaagcattgtattaaattttacattttcagtattgaatacattttatacacttacccaccgctaaatcaaaaaattcatagcagagatagaactataaaagcaattagctttatattctcttctgtaacttgtattcattacctgcattcacttcttcttctccaccccttatattttaacctttcattttttttttcatgttgtactatacctgtatgtgcatgtgtttatttatatacatatattattggctagatcctgcatatgagagagaatgtgttattttatttattccttacattgtataactttacacttcaggtaaggggctagtatccagaattaacaaagaattgcagaaataaaataccaagggaattaaactgccagtcatcaaatgggcaattaattgaataggcagttttcaaacaaagacatacaagtgagcaataactatttttaaaagtgttcagtgtccctagccatcagggagatgcaaactaaaaccactttgagatattgtttcaccatagtcaaaatagtagccatcaacaaatctgacaatggatgttagagaggttgtaaaaagagggaaatccatatttattgtttgtaggagtacagattaatatggtactatagaaatcagtttggagttttctcagaaacttaaaaatagaactaccatatgatccagctttctcactcttggccatatacccagagaactccatatcctaccataaagatatttacacacatgctcatgtttcttactactttattcacaagagcaaagaattggaatcaatctagtggccagtgaacggatttttggataataaaaatttgctatgtatgaaaatggatactacttacctctaaagaaaaaggaagttgaaaatttgcaggataacagatagacttaggttttctgcaatttgtgaatcctggatattagcctgttgtctatagtatagctggtaaaaattgtctcccattccgtgtgcactcttagctctgcttgttgttttccttgctatacagaaacttttttcatgtagtcacattattttgattttagggctagtgctgtgctcttgttgttttattttaaaagttcttatctactccaatatcctgaaggatagcccctgagttttcttcaaaagctttcagtatttcaggttataaatgtaggtctttgatccgttctgaactgttttttttttttccccagagataaggtttctctgtgtagccctggctgtcctggaactcactctgtagaccaggctggcctggaacccagaaatccgcctgcctctgcctcccaagtgctgggattaaaggtgtgcgccaccacgcccgacctgaactgatttttgtaaagggtgagagatagatataaatttagtttcgcttttctttggctagaaattcagttttgctgccacatttttttgaatggtctctttttttccatagtatgtttcttcctcaaggaggaacagaagagtccagagttggagtaccatttgggagtctgggcttttacgtattcttagacacacatgcacaggcacacacatacacacaatgtgaatcaaagttacatccatttttctcctcaaattggactgagcaagatgcactttgtgagttgggtcactttaaataatagcagggacctgattggatgagacaagggtggggacttgagaaattcccacaaaggaacaaaagcccagtagtggaaataaatctgactaaagagggtttctttcagacaagatcctggaatcaggccatcttggaccaaagagaaagtgatctgagaacaacctaatctgatccagggtcctagtccttagctggggaattaatactgtcttcacttataatgggtttctttcttcttgaattttgtatttgaactggaagatgaaggagggacatatgttcattacttcctggaaaagggcttgttttgaatgtcctagcactcagaagtatctctcataacagcttgtgcttctcacaggaagtttttagaaagcttgacggacagctgctatggtggctcaggtgtgtaatctcaggctaatatgaaaggtcatgtattcaaggcaagcttggggatatatggtaagttccaggaggatcagggacacagagtaagaacctcccacccccccaaaaaaaaactttttggggtttttttttttttttttggtttttcgagacagggtttctctgtatagccctggctgtcctggagctcactttgtagaccaggctggcctcgaactcagaaatccgcctgcctctgcctcccgagtgctgggattaaaggcgtgcgccaccacgcccggctgaaaaaaaaactttttatgatctaattatatgtcaaaatacgacccagacctagtaaatacagggtcaaaagggggaaaagatggcaattatattttaatttcaaaaaataaaaaatataagtggtaagatgatagctactgaaaacccataagcagttatgcatttggtcaggaaggcacaaagttccttagaaccatccatccttcagtccccatatgctatgtgcctattaaaactgacagtagagtcacgtgtgagccagagatggagctcaggcgaccctagcaaaggttgcagtagacttgggtacgggaggaccttggcaagcatgggcggctgggggtggggggaccataagctgcggtcattctgctgagcggtccaagatggaaagtcataaaccaagtactagcaaagatatcatatccagaaaaattaaacaacttccagaatcagacaagaatctgcttaaatatggatcagcatatattggacttaatgctgctttgggggggggggctaatagcgaatcttgaatgtgacacacgctcgattagcttctaccttaccaatggctatgatcccatttttgacagcaaacctgttctaccaaagtcttgtaagtttacctttgagtacaggtgatttgaactgtgaaacctataccacaacacagggtgcactagttggtttggttatgggtggtctgtaccctatccttctggctgtacccatcaataggggccttgatgccaggtatgaatcaagtcccctaccacagaggggaaacatcttcaattactggattacagtttctaagtctgtttttagaaaaatgttatttcctactttacttcagactgtgtttgcatcctatgttgggtctagacaatataaactcttcataaaggcctttcagttacctgaacctgacttagaaattcattgatttgaagcaaatatgtacaacaaaaataaaatggtgaaaataaaaaaaaaaactgaccataactagaaaaggcataaataacatatggaaagaaattagaaactgggatttgtggccttgggattgcaagaaaggttcaaagttgtgcagcacaaagagaaagaaccatccgggtgtggtggcgcacgcctttaatcccagcactcgggaggcagaggcaggcggatttctgagttcgaggccagcctggtctacagagtgagttccaggacagccagggctacacagagaaaccctgtctcgaaaaaaccaaaaacaaaaaaaaaacaaacaaacaattttttgaggcaatattctactatatagttcagtttggctttgagttcatgaccatccaacctcaactactcaagtattaggatcatgacatgtacactgagtttctttcatatatttttcaaaaaggtaagcatattattctatataggtatattgacataaatattctaccatatgggtatattaattatttcagcttcccaagtccttttacttatatactcaataactaattttcatttagaagatacacgagtgggactggagagattgctcaaaggttaaaagcttgtgctgctcttacagagtacctgggtttatgttcagcatccacatggtgtctaacaactgcccataactagttctagaggatccagctccctctttagagagagacagacagacagagacagagagagaaacacatagagagagacaaagagagtgtgtgtctatctaaatatataaaccaggctagcatggaactcactatatagatgatactggactgaaactagagatcgatttgcttgcctctgcttgccaagtgttaggattaaaggaatgtgccatcatgacctggcaaaaaccaattttttgtttgccttaagacaagtactgcatggtactggctggtctatgtatgtcaggcttgccttaaattcacacagatccatgtggctgtgcctccagagtactaggactaaaggccaacatttcccattctttgttcactttcttgacaccatcacttataattcagagtgttccatgctgtgggtgcctcccccaggtaaaacaaaataatagattcaaggagcctgtacagatggctcagtaagagtataagtgcatacctgaatttcagtcccacagtctccataaatccagaaaaagcagtgtgcatctgcaatcctagcatccaccaagataggggagatatgagaatccctggaagcttggcagggtggcttgtgaccagtactgaacaataagatcctgtctccaatggtagtgtgttctagtgacctaaggtgctgtgtaattaaaggaagctcatgactttgaaggagcatggtaaaaataaaagggagagcttggaaggggagatgggagaaaatgagaaaagagaaaaagagaagggaagagatgatgtcattataatctcaaaacattttaaaaagataagaaatagattcaatcctaacacttggctttgtgtagagtaagggaaggtagaggcttaggacagccactttggataaaagtgggtagcagggtcccagggaattaaaatgagacgtagcatgacagcatttgtagtgatcctgtgttgttaagaaaacctagatgaggagggcagtggtggcacagatgcctttcatcccattagaactggggaaacagaggcagggacatctctgagtacgaggccaacctggtctatgaattagttccatgacagtcaggtctacccagagaaaaccctgttttgaaaaacaaaaacaaaaaacatagataaaacagttcagtattacacttaaaaatatctttcaaatcagtggaagagtgggagatcagttggagagatgataaactatgtcaagatgaaagtaattcaaaaattacatgcttctataagattttcagtggaaatttttttttagaattactgtacatagaatttcttttcatttcaccaatatgttggtgacatgttatttgaagatacacttatatggttttatattgtgcaattaataataaaatacagtgccacctaccaggtttttttttcatgtaccagttttagataaatgacgttgaaaaagtatgtgcatgtgtttgttaagcaagatagaagaaataagatttttctgccagcattgtttttatttggaattaaacaattaaaaaatctaatattaatgctaaaaaataaatacacttttgcatttctttcagttttaatgtaagagcctagttaaaaggtaaggatatatttgcataaatttttattttcagtgtctctgaaatacatgccattctaccattttttagttttaatatttgtatagttttatatcaagtttgtagttggtaatttagtggttttgtaccatactacaatataaaacccacatcttttacttttatcataatcttcctgttcttgtgagttttttcctcatatttattgaagccttatgtctttatgttgacaaccatctgaaagtgaggaaagtttttcaaaagctttctttgcaattatcagtcattacaagagttgatatagttttggaataagaattcatggatgtgatggaaagaataatatgcttgtacacaggtgtctctgttgtatcaggctggggactggagaggcaaaatttgaggccagagtgctttctttccctgaaaatcccccaaggagtacaatgcagctttctccatgtgctaataatacaagtgccctctagtggggtttcttgtcctacctatttactgggttttggctgttttgatgtgctctatgtttaaatgatatcttcagggttaaacgttagctttgtgtgaattgtgagttgcaagttagcactatacagattaatttgagaactgcaccatggcccaaactttagttcagatgttggaaactgactcttccatggaaatccatatttctcttgttttctcttgataggaatacccagtattgccaaggacaaacaacctggaattgttgcaagtggagccaaccctatatgaagacttaactgagcatctcatttttgtcaggaattggaattgacactaatactgtaactttcttgataaaatatctttatttttcagtagtggaatgctgcaacttttttacagtattcaatttcagaagttgtatttaactacaagctcttttgcaaaaactctcagcagaagcatttgaggggcactctttgttgatgcatctttctctcagcatggtttcactgagagaatttaattaaattacatgtaaacatttatatgttgaaagctttctgttataagaacaggtgtcagaattatttagtgtctgtacatgaaagaacttttaaacagtggccttacagtatcaaattttatactggcttttctttttctgatgacattttggcttctaacttgaagttttctgaagtttctgaagatcaaggcctgtatgtgtcatccattttgtaatacaatataagaagcttaaagaagaggtgcatcttctccatcgggtcgtgtgtatcttgggttttcccatgaccatttgctcttttctagtttcaaatgctattgtggaaaatatgtaaggattttataatctctattccatcttcttttccctcagggcaagcttatgcatattatatttttaaaggcttttaaaatctgacagacaaaactgcatatttgaacattgtactttactactacggtattagacattttgcagacacatcttacagacagcatatctttggttcagttgatagatatttcatatctactatgtgtaagataggatccatgggatcgtaaatacagtctataggtccaaaaacttctttgttttctttcttctgcttaaaagtacatatacattcccagtcaaatttttgtgacatgtttatttgtaagaaaataaaatattgttctttctgcttgaagctgttacctggca

SEQ ID NO: 607 - DNA, 60417 bp, mus musculus; identical to SEQ ID NO: 606

SEQ ID NO: 608 - DNA, 7169 bp, mus musculus
catatctgccgccgccgcagctgtgagtgcagcatctgcgcttagctgcctccgcgccgctaaggttcgcgtcgctcgcccgtggcccgtggctgttcctgccttactaccaccggtagaaccctctcctcctgacctgcctacctcgctccttctccgccgcaccccggctgctcacaccatggatctcggcagcagcagcgactcggctcccgactgctgggatcaggtggacatggaagccccgggttcggctccgagcggggatggaatcgcccccgcagccatggcagcggctgaggccgcggaagccgaggcccagcgcaagcatctcagcttggccttcagcagtcagctcaacatccacgccaaacctttcgtgcctagcgtaagcgcagcggagttcgtgccgtccttcctgcctggatcggcccagccgcccgcccccacagcctccagctgcgacgaaacctgcatcggtggcgccggggagcctgaaggtaaacggatggaatggggagcacctgtagaaccttccaaagatggccctttagtgtcgtgggagggttccagttcagttgttaccatggaactttcagaacctgttgtagaaaatggagaggtggagatggccctagaagaatcttgggagcttaaagaagtgagtgaagcaaagcctgaggcttctttgggagatgcagggcccccagaagaaagtgtcaaggaagtgatggaggagaaagaggaagtaaggaaatcaaaatctgtgtccataccatcaggtgcacctaagaaagaacacgtaaatgtggtcttcattgggcatgtggatgctggcaagtcaaccattggaggacaaataatgtttttgacaggaatggttgacagaaggacacttgagaaatacgaacgagaagctaaggagaagaatagagagacctggtacttgtcctgggccttagatacaaaccaggaagaacgagacaagggtaaaacagtggaagtgggccgtgcgtattttgaaacggaaaagaagcatttcacaatcctagatgcccctggccacaagagttttgtcccaaatatgattggcggtgcctctcaagccgatttagctgtgctggtgatctctgccaggaaaggggaatttgagactggatttgaaaaaggtggacagacaagagaacatgcaatgctggccaaaacagcaggggtaaaatacttaatagtgcttattaataagatggatgaccccacagtagattggagcagtgagcgatatgaagaatgtaaagaaaaactggtgccctttttgaaaaaagttggtttcagtccaaaaaaggacattcactttatgccctgctcaggactgactggagcaaatattaaagagcaatctgatttctgtccttggtacaccggattaccatttattccgtatttggatagtttgccaaacttcaacagatcaattgatgggccaattaggttgccaattgtggataagtacaaggatatgggcactgtggtcctgggtaagctggaatcaggatccatttttaaaggccagcagcttgtgatgatgccaaacaagcacagtgtggaagttctaggaatcgtttctgatgatgccgagactgattttgtagctccaggtgaaaacctcaaaatcagactgaaagggattgaagaggaagagattcttccaggcttcatactttgtgaacccagtaatctttgccattccggacgcacatttgatgttcagatagtgatcattgagcacaagtctatcatctgcccaggttataatgcggtgcttcacattcatacttgtattgaggaggttgaaataacagccttgatctccttagtagacaaaaagtcaggagaaaaaagcaagacacggccccgctttgtgaagcaagaccaagtgtgcattgcccggttaaggacagcaggaactatctgcctggagacatttaaagattttcctcagatgggtcgttttactttaagagatgagggtaaaacaatcgccattggaaaagttctgaagctggtcccagagaaggactaagcaatctcttttgatgcctctgcaccataatgtgtgaaagattgaccgcaacctactgcccattgacaaacttgtgcccatattttgcagagaaatttcacagcaaaaatccacgtgttgtcagctttctcatgttgagacttcagtcgtgtcactcctgaatgcatactccagtttcctccctctatagcactctgcttccttggacaaatcagtaatagctttgtaagtgatgtgtgtgtaattgcctacagtcctaaaaagaatatattttaaagttttcatttccgtttgggatatctagacatcctttgttctgtggggaacagtcagtgttggtgtgtgtatatgttgaagataactaacatgtaaataaaacgttgcgtttgaaacttcagcatttgaaatgtgtttgaataatgcttaaattgggatggagtactgtttcattagattattttctcaagtaattaactatacttattacctgggctgagaaaaaggtccattcatagttggaaatgagggatttgtcgaaaccacacaggtttgtactaaaggaaaactacgcgggtaggatgggatgcagtgggggtgggatggaacctatcttagtgcccttcccaggtatgttttctgtgtctaagtaatattagtaaaggagtttttctacttacccagttattatctgaaaatgattatcctatttgtcttccattaggtcccataactttcagctcagctaaatcacatatatacttaaggtttcagtcaaatagactcgtctctgcaatctgtcatttttagcatgctttgctgtttttcactgaaatttggggagcaagacactgtgggtacaattactgaaaaggtaaattgttgcactatgtgtcatttatgaaaaccaaggacttgacatgaggaatctgtttctcagggtttacggttcattcccatctattctccacaaattcttaaggaaaacaccagttgtcgattctaaggtagttagatttattgctggaaggatgactttatggcccttggaactatcaacagcgggagaattttctgtcttggtaagtgggtagtgatttagtgtaagcggttgcctggtagtgtgcagaaccagtttctcttaggcatagctctctacttggagcaagaaacttctttcctaatgactatgagcaagccggtagatgtagacactgcctgccacatacctgggcctgtgctcaggtcatggcagtgtcttttccatggtcttttcctttgcgtgctcatagaactcttgacttcatgtatcaggtcgttactgactgatcttgtcagagttccaacagtatggctcctatgtgcatcatccacatcagagcacccacttgagaaaaagattttaagtggttgtgcatcagctaccttaatccagaaggggcctcatactgtgatgggcacagtcatttaatcatgagtgtggatagcatgagtattgtttaatctttagtcataaagagttcctcctcttggtcgtgttaaactttgtatagcaagccggccagtctagaacttgataaaaattctaccttagcagtcacttattgaggatttccctgtagcccatgttggctccactgtgtaccctaggttggcttgaagcttgtgactgtcctccttcagtatcctgggagttaaaattcgagatggaagccactacactaagctcttggcagtcacttaacaaagttgttttaatgctgcattagtgtcatagtaatttaccaacatatgtgtgtattatgtacaagtatcacacgtacaacacacacacacacctatcagttggctaaaagaaaagccaggacagaactgtttccattcaatctgggcaattttcaaagactagtttctaaatggttgtgtgtgagagacacataaattccagagaaaaatgtcacaatctttaaaagttattttagaaattagttcgttgcaattcagtgaggatcatattatgcaggaagttggggacaccagagtctagcccttttaagatagtagatccgagcctggcattgtggcacactggcttgcaggctaagtaagtatttggaaagctcagtcaagaagatatgtgttcaaggccacccttggctacactgtgagcttgagaacagccatggttgcatagtgacagcctgtcacagagaaccaccagtagatctaaacatccagtaatatttctgtataacttctaggtattttatagttattaatatttaatatttttcagtatttcaaactaggaccatttaccactacagcactagtttgcctagtatggtgaactatttataaagctataacaaggggggtgccctttgacagagtttctgctgtctccaattaatgttaaattaacttttttttttttttttgagacagggtttctctgtgtagcagccctggctgtcctggaactcactttgtagaccaggctggccttgaactcagaaatttgcctgcctctacctctgcctcccaagtgctgggattaaaggcatgtgccactagtgccccccaccccccaaattaacttttaactctctgatggtttaaataagaaaatccctcatagactcatatatttgaacacttggttctcagttggtgatgtgggttgggggaggtttaggaggtgtggccttgctggaggtagcatgccacaaggggtgggctctgattgtttatagtctcatcccacctccaggtgctctctctgcttcctgctttcagttgaggatgtgagctctcagcttcctgctccagttgccatgcctgctgtttgctgccatgcttccctgccatgatgatcgcttatctctctggaactgtgagcctaaataaacccttcattctgtaagttgcttctggtcatggtgttttagcacagcaacagaaaagtaaccagtggttggaaaccagagagtaggctgttgctgtgtagaccatgaccatatttcttttttagaggaatatggaagaccgagactttggattagaaaagtggttggatgctttaagcagacagtcggagcatggaagattagttcggagagtaatgcagaatgcagttgtctggctcacaaggtttcagaagggaacaatattagcagttggactagagcccatttctgtgctattttggcaaagaaactgggtgtcttctgcccttttcctaagaattcacatatggctaaaattgaaaaactagagcgggaattctagccaggaaactgttgcatgtgtctagaccttgacccccttctgacatgtttttcttgagcattttcagatctctgattaaggcattggatctattttctgttgattctgctacagagagaaggcttcgtgtttcattctatatcatgtgagttgataccgtgttggttttttttttgccatctttttaagggtcagttggttataaatgcatatagttattcctctattacactgctctttgtttttatatgccaatatcatgctttataggtacttccattttgaatatgcaatagcatgatgcttacaaactttgttctttttttccctcaagatattctgggacatttgtatgtccatattaattttaggattttctttctagttctgtggacaatgccactagtattttgacaggaattgccttgaatctataaattattttgtatactatgggtattttaacaatatttttttctagtttgtgagaactgtggagtcatttctttggcacaggaaattacagtgctgcataatgctgtgtttgtggcatgattattgataatgcttttgcgagtctatgataaagaaaatgggaaaaaagaaattcaaaatgtacagattgcagagataaagattggctagaagagggactgtaattgttaaggaggttaacaccattaaggagaggcctgctctgcacttgaataagtggaggggtcccttcaggacaagactccacccagctaagcttcggacttgggaaagagagtctcagatggtttctgttcctggaatgcaacagcaaacataagctgctgctagtggggatcaggggagtgtggagccatcccaagtttgcagcccaatttgacagtgtcgttcatgtggtggtggcttcagagggatgaaaaatgaaagaatgaaggggctgtagagccatagcagatttcagagagccagtgaggctaagcagtgtgtgtgtctgcatgatagctctgtttgtttgtgaaaatgaacccccaagttgttagtgatgttagagctgttagacctctgcctacgagagctatataaatgaagcaaatccagtctaattagatttatgtttcaggtagcaaaactgaaaggacagagccatctaaatcatttgacatgggacatagagctacaagatttagtgttgtgcccttctgggttgtcttcctttgccccatttttcctttctatgctccatttcctccattttggaattttatgctttgccattgtatgttgcaaatgtgtaatttgctttttttttttttaatttacagggagctacaattaagagattgccttgagtctcataagagactttggatggtggacttttaagcagtgttggggccattaaagactggggacatttttaagcttgactggatgcagttcgaatgatgatctaaccatgagcctgtggaggccatgaagtggaatgtgatggcttgaataaagaatgactcctctaggctcatgcctttgaccactcgattcccaggtggtggtgctggtagggacgattaggaggcgtggccttcttggagaaagcacgccactgggagcaggctttgagggtttatagtcttacctcatgtccagtttgctttctctgcttcatacttgtagtagagtgtgtgagctatcagcttctgcatccagttgccctgcttgccttttgctgttgggcttctctgtcatcattcatgatggacttttatccctctggaaccattagccaaaataaactcatttttttctg

SEQ ID NO: 609 - DNA, 7169 bp, mus musculus; identical to SEQ ID NO: 608

SEQ ID NO: 610 - DNA, 123694 bp, mus musculus
tggctctttcgatctgagacaccccctcccggagacatcaccccctcctcccagccaggcgcggagtgaaatcttagaagccgaggctgctgggtttgaacggaatgccggagtcggtggaactcggagctagtcccccccgaaggtcagagagttgttttgagttctcgtacccggaagggggggggggcagggaggagaggacgccagggcccgagagaccccgcgtcagagcagaaattgtgctccggaacaggcagctcagcggaagccgcgacgggggcgggtcacgtgcggcggtggccgtgcagctgcccggggagccgggctaagacaagggcccggcggggcgagggtggcgcggggcggcggctttcacagcccaaggtggaagcccggtagtcggagctccgggaacgtggggaacccggagctcgagccccggaggcgagcgcgttatgcagggggtggtgtgggagtcagggcgctccgagctccgcgtggtgcggcgcgggcgagaggaggacgatggcgggggggggcagttggggggcagagggacgccagcggggctccctcctagcaagagcttgatccacgcggagattgcgggagtggctgagacccgaacagggaggcgccgctcttgcagtcatcggccttgttttcttctctgaggcaaatcccggaacggctggaacagccatccttgcctgagtcccaggggcgcccccactacgcttgggggagggtgcatcctgcagggtaccccagtccgagggcgacagaggtggcttagcaagatgtgagtcagtggcgcgcacgaattcacacccttccccgggggggggggggggagagagagagagagagagagagagagagagagagagagagagagagagcgagctagccactttgggcctcctcgggagtgttatgggggttgatgggggatactggagagaaaccacctgcaccactgaagcctgtgatggcttcgcggccgggtggattgggccgtacacgtgcacaaagtggcgcgtaatactcttgcgtgggagggttagggacacaaacttggtcacctgccaagaacccttaggaactttggtgtcgctctcagcctccagtgccctggaatatactcctctttctaggggagtccacgatgctcagatctgaggcttggaaagagtgtagtagtgtgggctagcctgggacgagaaagccacccccgttcctctcacgaaggcacagaacagttgtcttgcaaagtttcctgtactcctccccacacagcccagttgaggaagggtggctcttccggaggtgagggaggagggaatagtctcgaagctaggactggtgcattagttcctttaactatgaccctggagcgcgagggacacccgggtccccgcgtgttggtgttccttccagacactacacctcaggccactgtagcgtctgtttatggttgcgacagcgggtgctgagcaatgtctgggacaacaagagacgccatttgcatcccccccccgcacccctgcaggttggcaggggcgggggtgtcgccctgcacggaagcgcatttctggcagtgacactgattagatgccgtgccgctacgtgcacggaatcggggtgggccttcatcactcctgttcgccactcactcttctggtgggaaagttgtgggttcccccccacccttccctctcgccgcacagctgctgtctccgggggcggaattaggagaccgtgttagctcagccaggagagagaggatctcgccggcctcggaaagccgccgggcccgggcctcgaaaatccagccctggctttgcgtcgagctgccgagtgcggcgcttacgcgcccggccagccgaggcctggtttccatctgcccccttcgcctccgtgttaagttcgccggggaaaacccaacgatccgtgcaaagcccctcggaagagcgctacccccaccccagcctgatcctgaccgatggaaaaaatgacagtataggtcagaacaggctgcccgggagtattaatgtggctgtctctgttcccggtgctaggggaggatgggcgcctcgccaggaaaccgccgggggaggagccatgagggccgcctgcccctcttgaggctagaaaacgtggattctcacagggaccaaacaaatgtggttagacagctacgggaacttatcccagttaaatatggatccatcgtgtgtatttcaagcgacattccctcccccacaatcaaatacactgattcagttaaaaataagacgaaaacaggttagtctgtagatgcgaaccttgctgtctacttatcatgagacatgtcttctggaggttctgacctgaacccaatcatcttggtacaatgtgtcctaaggtaaaagagtccccgttacgctgcaccttcgagaaatctttgattaatagaactcgaagagactattttagttgtagtttctacttgatgctgcttactcttccttgcacactcctgcaaggttgtttgtacttagctcttacaacccacgtttctctcttgcctttcttttcctgagtacgtgccgggtgcgggcaggaggaggccacagaactatgctgctgccaaggccgccgccctcggactctcacttgcgcaccacgcggcctccgaggaggggagatgtgaactctccgggtggcgctcgagaactggaattctgctttgagtctgaggaatttgtttcagaggcagatcagtcacagcttggagggggcgggggtagatagagactgtacagggcaagctccagaggtgacccaggctctaaggagcgaaccgtagaagcgtctgtgttctttgtctttcgcggggctggcagcctggcattcacagctcagataaggatctactaagagccacagcccatcgccagcacatttaagtgattagtctaccgccggtagccacttaggagaaatgtcttgtctttgagaaagaaaaaaaaaaagcggcctcatgttatgagttgtattggacccttcagacccttctttgctgcctgcacacatctccctaccgtgccagacagtaaggagagcctttcctagataggaatctgaccaatcctgttcacatgaacattatttatatttgggtgtcagtaaaatgtagtccactaatggcagaggactttcctttcacccagcctcaccaagaacgaggtagcttggaatcgcgtcttgaaaaatcaccttgaacaaaggtgggctaggagagtatttctgaaagacccctgctgtgtccttcaagaccgcggggagagtgtaaagatgcggtgtctgatccctgcctggaacttgacagtaatccaaacgaaatgaatgccagcagagagcccagtccccaggcttggctagctcttccttacagttctagcactcgggaaactgaagcagaggattgccttaaagcccaggcccacctgggatccagcgtgagactgtaagggctgggggaagctactctttcacaccaccaagtcaggcctttaaggttaaggagtcaagagatagtttgaggccatttttgctttaactatcttgtggacaaaaacagtgaacgtactctccactttgcccaaacatgcctcccgagagacctggggtaactttaacttcgggggagagtgccccccccccctttacccataggaagggaatacaataataccctagcaagcatatgtggcactggcgtggtctacacacaggaagcctattctcctctgaccaactctattatgaggtggacactaagactgctttccttgccttaattgtgtcgcccctggggtccagaactgttaagcagcttgcccaaagccctaagagggccgtgtggcctctcccacgctgtagcctgtgtgatttaagggttttccccccctaagggaaaaaacctccctcccaaccctcccaaaattttgtggcttaagatgcccaacatctttggctgcccccccccccccgccggcgcaaggaaaactccagacttaggtaacagaatctactgtgactcgtgactctgcagcacagaaagggccaagggagacagtgcaaaggcccctagcccacctagccgcatagcatccggcagtcacgtccgccggaggtgactagggcctgggggtagccgattgctcaggaactccttatcgcctatcttcagtggtcctgtgaggcttaggtaaacggccacccgcggtggtgactggttcgtgcaggtcccccgtctccaggcgcgcccctaggctcctccggtgggtctggctagatgcccagtggcgcctccagaagctccggtcttctctccacttgaggcgccagccctgagctaagctcccctgcttggagctggagagcccagttgggacggctggatccggttgtttgccctcaatccagcccgattaccaccagctccctattcccccgagcgcgcgcacaaacacgctttccaagcgcgctccaggcctccactttcccttcctcttcctggctcgctctggtgcttcgaaagctcgcggcgattgtttgcttcgaagagtccaggtggggaaggctgtgcccctcccccccccccccagcccgcataagtgcacacgctgttaaagcctggggcgcacagccaggcctatggactcccttgtcccccgagaagtggcagctgctagagaggatcgattctacccgtgcttccgagagacacaggagtaaaaataggagaccttagcctgtgtctgaatttggggacgggagagtaaatcctatctcccaagaggactagtaggtttgcaccgcacagcttatgtggaccacagtgtgacatccctacgtgttctggagaggctgagcggcctaggcgcacttgggggcttagtggtttggggaccctgggagagactgtcagagggggggcggagcaggagtcctcactcctcaaggcagaacaccttttttggaaccttgaaacccaggggagccgctgccatcttccagtcgcgagtcgctcctgaatgtttctttaaggctccttcccgggtcgcggctctctcgctttccacaggctagaaagataaagtcagggccgggggttggggtgggggactggctcacacaactgtgctctcgactttgcctaccaagttcactgtggtcccagagtgtacccctcctccccaggccacacctcgatgggggcctgtcctgtttccttcctcgttggttcaaatctcgagtttcatggagagagggcacattatattgccaaagtcactaagtgtccccccccccccaaagtcccataaggataacctaaacacaggattcccacaccccgggctgatccttcctcgcctcctgggattaactggactcacaggtccataaaacacttccggcggggccagagggtctgtctgcagaaacactttaaaatagccctccgtggccgggagtcggaattgacacagacaattcctgtttttttttttttttaggctatgaagggaaatcgtctgaagcggggggggggggggggtagggtaggcagcttccagaaaacaaaccaaaccaaaacaaaaacgatgcaccattttaaccaaatgacactgattcagggtagcatgggtattcaacgggagcagacaggttgcacctggcttctgaccacacttcaatgatgaacacaaacactttgaaacttgggggctagtagaggcagcctccccctctgtgagagttaacactacctctgccctccttaagtagattgaagaggctggaagtattaaagtgctttgcaaaggcagcttggcccgtccatttcgctgtggtcagggtctctcccacacatggaaggcaccagagctttgttaattaagaagtagaactaagaccaccccccccccatccctgcaaggctatggaagatacagtcaagcccaaagcacgttcagaccaggaatccccacccctttcttttacatcacttcgaattaagtttctgaagaatgggcgaatctttggaatgctctaagaaaaattcaccattaaaattcgaggttaatgagaacgaaaatagtcctttaaaatggattaaaccacattttaagacaagaaccggaagaatataaattcaaagtagcttcttggccttgtccccctaatgtaggtctggagagcagatgctggtagatagcccacccaccacacacacacacacacacacacacacacacacacatacacacacacaatctgggaccgggaagtaggacttgacagatttgaacagcaaggtgatgtaggtctgctgggcgaagaccaggaagctaggcaacgacttggcttaaaatgaatatgaaaagaaagacttaggcctgctggtgtttcctggaggcctagaactactcagaatggggaggtgaggggtgctctgtaatcttccctgaaggattcaagcaatcctactggcctggggtggtggccaggtgcaaaagggataaaggcctaggcagagctttaacccaacctctctaatttggcgcggggtggggttagaggtgatgtagtggagagtctctgcttgagctccacgggcctccctctcacttccttggctacgcgcggcctctggctaggactaaccagcctccagctcactgtcctaaaccctaagcccttcccgcctggatgcccaagctggatcctcaggcttccccgtgcctggcagcctcggctcttcccctttgtgatttaaccgaggttcagaaagcttgtttacctcggcagccttgggcgactcggtctgcggaaaaagcccctaggccagcgccgaccagtagggggggattgtcttatagattatttttcctcctggtttttgttttgttttgtgttttttaaaccagaaggcgaggttggagagggggcggggtggcgtgttgctgctgttttcgagagcactgtatttgaaagagaaacaaaagccgtttgggaggtagcaaggctgtttttacatataaaaaaagtgcaatgaatacctagggcccccagcagtgataaactaaacgctcggcggatttcgactattagcagttaatctgttatctgcggtcaccaaacaagttctagggctcggaggatgccgaattcctgttccaattgagccgggatctgttgggcacatccaatgcccatagtttcttccagtgcaaatccagttttggagaactgggtttcccagatggggcactgatttgaggtctcattagactctcttaggcagtcaaagatctgcttgcatcgccgctcgaactcacgtcctgcctgtgattcagaagtgtgtttaaaatggttacacacacacacacccttagtttctcaggcctgtcaattttgcacgtagtaggcctccaaaaatattagcaatgtacgatagaaactaaagtgaatctctgggcctggaagacagactgatacacagcctcgtcctgggaagactattggggtgcccagatcttcccttgggccgctgcagcctgcgttcatcttcggcctccgcgggccagggcgggcggggtaggccagaaggcactaagcgcctggagcctgcacgatgataaatattgcgcagacagcccataaataatttgcattatgttcagctgacaacgcagggcgattaattttaatagctacatatttgcctgggctgctgctttcgtaggcccggtaatgaaaggcgagaggccgccctggctccgtgctcatggtcccggaaggcagccgggaggaatgggaagaaggcccgatgcggtttctcctccaggcagtccccagggatcccgggttcctgcccctctccccccccccccaccccggccctctcctcagtgtagaagtggggtgcgtgtgaagcccaagtaaccccgaggcctcaagcaacaggagccaccataatgacgctgcaatttgtctgggttgggatagccacttgtggaagggagatcctgcggggggcggggggacatgctctccacccagaccaaaccccgagtgaattcaggggtgtagggggtcacagtccgctttggtcctggggaagtgctggtattttccaatgcgcctgcctatttgccagtagatctttagcttggcgagggctttgccgacctcagggcaggagcaaggggcaaaacaaagccgtggggtccgcgtatcctgacctctttttgggttcagagtcctctctgcccatcccgcacccggagggaacccccacccccatattactggccgcaaaggcccatggaaaggatggaaagaaagggtcccgagcagctctttaaaagagggggcggggaggagaacgcggtgagccaggccacaacagggcagccgccgcagtcccgcggtggcccggtgcgtgcgtgtgcgtgtcgatgtgtgcgtgtcgatgacaaagccccgctgccgtcagcaagctcccggctgctcgagcgtgggtgggggaggggaagagaaagtagtagggggtggaaccctcgctcacgtaggtagctgaagcttctctggagaaagagttcattcatgagccacaggagtctccccggcccggccaggtggagctggctaaagctagcacctgttttatttatttgcctttttggaaacaagcaagtgcatcgatcattaccatattttaattgcctttctcaaaggtcatctctaattatgggttacgagaagggctggctaaggggtctgcaacccctgtgtgtgtgtgtgtgtgtgtgtgtgtgtgtgtgtcctctgagacaatgctcctagctcagatcgaaatgccattccgagggtgtccgcgagcgcctgcaagactgtcacgacgtgctggatccacgcagaccctgctgcgtgcacaataaaagccgagcaggcggcagagggccgtgcagacccacgggttttctttttagaaacggtggtgcgaagagacttgacaataataacacgcagcaggattaaaccagggcgggaagaagaaaatgcattttcgtttctaggactgagagggtgtttaacccatccgatcccccaagagctttttttatgcacacacagagacaggtgcgggacacacggtggcttgggacaacctatttttcatattaatctcgtcccttctttaagaatggttgttcattacagtgtgagcgaacgtttgtaatgtttattcttttgttttatggaaaattataccagactagctgaaaagaaaaaaaaccggttgaggtgaggtttttttttttttttttcttttcaaaagtgcgtttttaggatgcttcctcctcgcccccttcattttaaatcattttcagaaactcttgaggcaaaaggctgtactcagagggagcagggcagagggggtctcaggttcttgggacaggattgaagcgggtagaaatcaggaaagagctgttgggtagaggtgggcacccgccaccccagcttggctttctcagaagagcctggcatttgtgagtcaccagcctgtttctgggaatgccgcttgctagagccagggcctgggtcaggcgtcttggagagtcggagggtcttgactgcctctgcttcctgcctgcccccacacctggcctcctggcctcaccagcagccagctctgctgggaggaggaaggcagagccagatgactggtccaaagccccagagaccgcctggctttctcctcccctgtaatcataaccagatgcacttaaacgcctttcatcagaggaagcccaaagccctttaacaggcagcaatgaaaaccttgcaagggcctctcagcatgtgtgccggggggcccctgagcccatttctcaaccaagtcagcctgaggttgccagagtctaagctttcttctcctgtacctcggacctcggaggcctaataagttacccaatcaggtcagttgggggggggggtgaggaggccagggctgctgttaggtgtgtgggtacagaccccatagaaagagaggcatacagggcagccagcagctagcactgaggctgtgagtggccatgtaaggtgaggtgttcaggacatttccagaggtactcgaactatctctctatgccactgctccctgctaagctctacagagtttaatacttgcaagagcagcaactattttatttgtctgtagacctggcacaaagtaagccattcaaatgtttgggcgatcacagctgtggtgggaaagcaagatatatttaggtttgacataagagctctgccccaaacagtgtttaatctcccgggacctcggtttcctcatctgtaaaatgggcatgagaatgtctatgttcacaaggttaggaaaatatcagatgaagaaattgcacaggaagttctaggaaggtcataataaactctcagtatctaccctggctttgtcctgtaaggatagtgaggactgggtgtctggaatgcagccctggggaaggggcagggattgtagcccttggctgagtctgagtcttgctggcttggagtttgaattagaagaaaggattgcatataggactggtggtttagtaatgggtgctttggggcccacttattggtttgggggtgtgctttagctaggaccaccagaaaaggaggaaagagaggggaaaggaggaagaattgtttccaaatgtgcatccatcaagtatggtggcttatggtgtaatccccacactacatgagctaacctgggttatatagtgagcgccaggtacagtgtgagactatctcaaagctcctgaaagtgtacattagaggcacaggcaggctgtcccaaagctgtgaacaattggagggagcctttccagcctttggtcttagtttctacacaggggactaagactcctgccctgaggccaggctgccagagaagaatggccagcagttgtggtctaagagatgtcccttcagtcctgacccttgcttgtctagcatggttgtatttaatcaatgacaagtctatcccctagaattaggcagggaaagggttgagttctgcctggttcttgtcatggttgttcggaattctggcttgttctagagctccccagttcttagcttccccaaccctgtcctcaccagacacccacaattcagccatatctctctcctcgttgtaggtcgtattacttgtgacactggagatcaaacccagagcctttatgaatgtctgacaagagcctcctcacacacattttcttgtgtttgttattcactgagcagcagatatggctagtctcaaaagccagcttgcttcatctcctccctaggaagctagaattacaggtgggccttcacacctactggattctgaggatctgaactctagtcctgagcacttgactggtgagagctttaaccttgaaccatcctcctggtatccacccttcatccccaatgaaaagaccttccttccttcctccctccctcccttccttccttctttttttttttttttttaagatttatttatttaatgtaaattcctgctgaatcaccccaaggggagcctactcctggaccattccccagtttctaggcaacttgggttgcctagaaaagtcttttctgggtgctaaagtgatggctcagtggttaagagcactgactgctccttcagaggccctgagttcaaatcccagcaaccacatggtggctcacaaccatctgtaatgggatccaatgccctcttctggtgtgtctgaagacagctacagtgtctcttagaccacaactgctggccattcttctctggcagcctggcctcagggcaggagtcttagtcccctgtatagaaactaagaccaaaggctggaaaggctccctccaattgttcacagctttgggacagcctgcctgtgcctctaatgtacactttttaatgtacactgtagctgtcttcagacacaccagaagagggcattggatcccattacagatggttgtgagccaccatgtggttgctaggatttgaactcagggcctctgaaggagcagtcagtgctcttaaccactgagccatcactttagcacccagaaaagacttttctaggcaacccaagttgcttttgaactcctggcatcaagggatcctcctgcctcagcctccttgttcttgctcctgctccttagccaatgcttgtggtatttggggggggggcagagaagaccttctctttagtcttccacattctgtgtcttgcaatctctcccaggaggccagcctgaagactaaggtcagtttgcctgcctggggaatggtccaggagtaggctccccttggggtgattcagcaggaaggcccagccctgtgaatgaaaactcacttgactcgggtgtggcacaagttggactgtctgggtcagggagtaaaaaagtatgggtttctaaaggaacgaggaaggaaatatcataagctgggtttacctgcctttcctttgaatctgtgaaccacagagacaggtatcttcatcctacaggagacaagagaaatgtgggagaagaaaagaataggcggagaaacaaaaccagcggctggaaggacctgctctctctgctgcttgcctggacagctgctgtaggtcacagagggaacagcagggtcttcagtgtcgctccttcccggagagaggaagtgtgaaatctactctcaggaaggcataggtcactgtgctatgggggttctgtgaagattacaatgctgtgagatacacatgcctgtaatctgagtacttgggaagcataagcaggaatttcagtatatagtctaggctacatatggagaccatctcaaaacaagcaaaagaataatgatgataaagaccccataattttaaaacaaagcatttgtatgtgaatgaggttttgtctacatgtatgtctgtgtaccaactgagtgcttgctgtcatcgtaagggcagaagaaagtgtcagatggcctggaactagagatgcagactgctatgagctaccctgtgggtgttgggaatcaaacttggatcttctgaaagagcagtcagtgcttttaacttctgagccatctctgtctttctctgtctctgtctctgtctgtctgtctgtctgtctctacacacacacacacacacacacacacacacttactttggtggggtggtgaaagtgatattgagacagtttctctgtgtagccctggctgtcctggaactcactctgtagaccaggctggcctggaactcatagttccacctgcctctgcctcccaagtgctgggattaaaggtgtgcactgaactatctattattgacagtggaggatttgcgatctcagatgtcccaccctccctcctttttagatctgttcctccctcatctcttttacagtgctagagatagaaactgggcctttgcgcgtgctcatgcgtgtgcctgcatacatgcagaggtcagaggacagcctgctgggagttgttttttctcctactatggtcaagagaatggaatttgggtcctcagattagatggcaggcacctttaccctatagatgagctatttagcagaccccccccacacacacacacacacacttttatttttaacctatctgccctttctgcatggatttagcaaggctctgtgcaaatggttctctcctgccgcatgtcagttgcagggaaggaaaagggtagctttcagggctggaatcatgtaggggtatctttgggcttccttttgtctgtctgttggctgggccctgagctatatacaccatagcaaaaactcaaggctccccttgaggcctgagcttcctcgcagtatggtgagcaaagtggtaggacagaattcctgagcagtgccttgcataccaagaacaagtactccagcaaataaggctgaaacttgacctagccttggaagtcatgctgtgtcactcctgtcatagccactagttgcctttggggtcatagcccatgaaaattcaaggggaaaggacatataccacacccctcaggaacagtggcaaagaacttgtgatcatgggggaaggagaaacatctaggcaggcactctttttttttttttttttttcctttacgatctagccgttgccccctcccccagtcctccttcccacaattcctcatctcatttctccttctccctgcctctgagggccagaccaggcagatctctgctatctatctatctatctatctatctatctatctatctatctatctactggggtcctcggagtagcctgtgtatgctgcctggttgatgagtcagtgtctgggagttccgtggggtctgggctagttgagattgctggttttcctatggggtcactatccccttcagcttgttcaatccttcccttaattcaaccctaggggtctctgacctcagtccagtgcttggctgtaagtatcttcatctgtctcagtcagctgctggttgggcctctcagaggacagccatgctgggctcctgtctgtaagcacatcgtagcatcagtaatagtgtcaggccttggtgtgccaccacccccacccctggccccatgagatggatcccaagttgggctggtcattggactgcctttccttcagtctcttctccattttttgtccctgcagttcttttagaaaggcactcttgagagctaggcttaattagcagtggctctaaacagaatagtctacgctctaatagatacttataccctctagaggcctcataaattatacggggggcagggggaagcagagagctaaaattaggccaggggaaaaagaaatacagctataaggcaaatatggattttatgaaaaatagaaaatatccaaagatagctctctgtgagcttgtcaagtgtgggaaggatggaggaaggcttgggtggtgggtcagacagctttttggcatctcagcattgaaagggaactaggtaatggatgagactgcccatgtctgctgttctcttccacctggcatttggggtacagtgtgaagcagcagccctctattgttccaggcaatgtcgtcgagatggccttacaaataatcccacagccccatatacagagatctttatggtccaaagctaggaatgtcgtcagcacatttcctaaagtaagtgtgtgtgtgggggggggagaaatgacttgaatacttgctgtttgtgcccccaccttcgatgtggttttaaatactcagcacggatcgcgttgtgactggaggggttgggtacatctccagggccccaggtttccattatccttgtctctaacccctgaatggagagtttgacttctaatttcatgctaggggtttcagaggcagcagaattgtatttgcctctgcctttgatctgctgtttcattgtggctctgactaggagacagagataaaaatgtgctggaaaaacatgattttgtctggctttggaatttgtggttattattttctcgggctcccttaagatgacacaccttccttaaatttcaaatcagaatcatttcccccatttttgaatatgcaaaagttctctctgggctgttgtccctttccctagtaaagatataattaaaaaatatgtatatgggtattttgtctgcatgtatgtttatataccacgtgcatggtgcacctgcatagcccataagagggggttggagcccctgaaactggagatacaaatggccatgagcagccatgtgggtgctgggatttgaacccaggccttctgaagaagcaaccaatgctcttaactacagagccatctctctcaccctgataaagataacattttcagcaagggtttggggtgcaccttttgctgctcatgttttaaatctgagtggaagctaaagtccccactgagtagaagagccataggtgagccctgatctctctttgctctccctgccagcacttgccactatgtagctggttttccacagctcccttaaggtgaccaggctctgctggcctagttcttacagtggaaacaaacgaaactcagacttagtaggaaccttgtgggtcagagctaagtgacacttggctgtagcccctgaagtagctggcttctcaggcaggagtcatcttatcaggttgtgtagtttgtgtgctacacaatgatccccagtcaagccagagaatgtgggctgggattcacgggtactgttttctaattcttacaaagttaacaaataggctagggatgctgagcaaaaggagacccctaccctgcctctgatcaagaagaagaagaagaagaagaaaaggtgacataaggcaggatggaagggaaaagatgtcttgggagcacagtacagtaacctaaggttacaagccagtgtgaccagctccttggaactgcattggctttcttttcttttcttttcttttcttttcttttcttttcttttcttttctcttctcttcttttctttttctcttttcttttctttttcttttttctctcttttttcttttcttttcttttctcttcttttctttttcttttttctctctttttttcttttcttttcttttcttttcttttcttttcttttcttttctttttttcatctctcatctacaggctctggtgtttttaccttactggaaccactctgctctgggttagagaggagaaagggtagttttgaaagtaaggtggggccccacagtgatggcacacaactttatgcctttaatcccagcacttgggaggcagaagcagaggcaggcagatttctgagttcgaggccagcctggtctacagagtgagttccaggacagccagggctacacagagaaacagagtttctttggttttgaacatgtggcctctaagatatgctgacgaggacaggcctttgtgtacttggtctaagcattaccgagtggtagaacagagttcatgtaaaacaaaggccacactatagagctggaatagctcagagagtgctagagtgcctagcatgttcaaggccctggatttggggccccagaaagtgcaccatacacaaatgaatacaactttgaaaggaaaagtattcagacataaatctgcttctctccagaggaagacaaatgtaaacttaagtgcctattctgcccttataaccagaaatgcgtaaagcgggagcagggaggtcttccccctcatgggtttcctctgtgtgtatgtcctgtggcctcccctttccccctctgtgctgagaacgggactcagggcttctggcatgttaggcaatctttgtatctctgagccacacccccaggctgcttgcctgcctccttctacactgtggtcaccccgaccccacacccctgcctaaggactacgagcaagttaagtgtggtggtatgttgaatggacatcagttccatcatggtgactggaaattctcaaacttttactattctaagtacctaagtactggcctttcccacctcagcttgtttgttttaaataaaaggttatgtaactcatcctcaaagtcctatacagccgaagggaactataaacttctgatccattctgactcttacctcaacacagctgggattacaagcatgtgccaccaggagctgttttatgatatgctggggactggacccagggcttcatagatgctgggcaagagctttactgactaaattacctccaggactaactcaatgtcagcttcatctagtgatgtcttaagatggtaaaggaagattttaggtgtctatatttttccctgtcctcattgtggtgtgagatctcaagatattaaatttgttctcatactttataatcataatcccatcttataatcacatagagattgttcattgatcaaacaaaagaattttggtaattaaatttcttcttttttttgtttcttttttttttttttttttttgagacagggtttctctgtgtagcacttgctgtcctggaactcactctgtaggtcaggctggcctcaaactcacaggaatctgcttgcctctgcctcccaagtgctttgccctatttcccttcatgtgtatatttagggatttggtgctggagagatagcttaatggttaagagcactggctgctaatccaggggccgcaagtttgagtctcagcagccacatggcagctcacaaccatagattaagttctaggagattctgtgccttattctggcctcctagggcaccaggcatgcacatggtacccagatacatgctcttgaaacaatagaagatacattagcaaagtatctattttatcccccccccccatctctgtgtgtgtaggcatgtggattcaggtggctgtagaggccagaagagggtatcagaaccccttagaattggagttgaactgggcaaaaatgagtgctaagaatccacctctagtcccctgcaagaggtgctcttaagtgctgggctacttcactgtggtggacttaacattcaaatcttgctcactgtcccagccctcaggatatagatgagactgaccccaaacttgtcaagctccatcagcttcagcctccatgtaccaccatgctccatgctagttgcatttccttctctttttatttcatgtatatgagtacactgttgctgtcttcagacacaccaggaggggccatcagatcccattacagatggttgtgagccaccatgtggttggtgggatttgaactcaggacctctggaagaacagttggtgctcttaaccactgagccatctctccagcccattgtatctccttaaaacctttacttttaatgaaatggggccagagtatactgatttcgaatggaatattttggttgaaaattgcttctttaccacccacttaatgtcaggagctttgcaatgaatccagagtttctcattcttcatgtttcccatagtttaaataaactttcaccctttttcctaaacagcagcctttctggagtaattccctgttattccccgaaacttgggaactattctttgttaggaaagtttagtgtgtgtgtgtgtgtgtgtgtgtgtgtgtattttttagacagggtttctctgtatagcgctggttgtcctggaactcactccatagatgaggctatcctcgaactcacagagatctatctgcctgcctctgcctcccgggagtgctgattgccaccacaccctgattactgttaataaattcttatccttctttcacagcactgatctccacttctagaaaataagggcgattttaaaaataattttaaaaattatttaatggatccttcccccaggcgtttgatttccgtcgatctcacattcttttttatttccgtcgatttctcaatccttttattcatgtctagacatttgcaattctgcctttctaccaaggttgtaaattgttagaagactcaaggtgtcttaaaaaaaaaaatcacctttgcacttctgtgttgccctaagtcctgagcaagtttccttcaatgcagtttacctctttaaaaatcggacgcataaagttccatccttctccagcccaaggccctggacttgacttgaaaccgtggtaactttgaaatcctcgctcgtcctgaaagagcaaggcctgggacgcccttgaatgctagggactgtgctgcaggccgcacccccacccccacccccagccgactgcatttgaggacagaggcccaagttccgggccacggggaccaaacgctctgtgctggccgtgctggctgtctccgcagcggagaacaagaggtggaattaaaacccgcactgacgactcggggagggaagctcgccagctgcggcttccctgagggtcgcagctcttctgtcgcctgtggggagagggtccacctggcccgcagtgaggacggggttccagagggagcgcaggcggcacgcttcgggagctggggacagtcgccgggtcccttccaccaaagcctgtggctctatggagccaccgccgggggcagcggggcctgcgcctcccggtcaagatggcggcgggcgcgcagccacgcgggccactggcgcccgcgagaggtggctgcagtcccccaggccgacgccgccgctagcactgtcccccggcgggaagccgcacctcctcaggcgggagcaacccagggctcagttcctccacttcttcagacggccccagtgctcaatcaacgtcacagcagaccatcactttctcacacccccagtcgccaggggactcctgttaccaggaggtagggcccggactccagggataaggagtgtgacgctggcttccaggtcgcacactgtggacagaagaccaacggggactactgggtgcaggcctcacaccccaggcatttcctccaaccttggagcacgattccacaattattcgtagccactaaggaaaacccccttaataagactcagaacccagagccgctgaagtcaccaggaatgtcttggagaatccatagtattatctagtcaaagctacagaataagagggtgtcgtcccatccccaccccccatacacatttgctctgacatcggagtaggagtaggctcctagaaaccttaggtccagtttactagaaatggcattgatgaatgcagcgcattctgagcgatctcaggttgggctcaggttgagaggtcaggaccccctcccagccaccccctcgtgcgcgcgcgcgcgcacgcacacacacacacacacacacacacacacacacacaccagggaaaggctggtgcaggtagtgtctcaattggggggagtgtggataagtacccagaaaagcttccttattaccgtctgtaagctgttggctgacacctcctaccacctcaaggttctgtctaaagttcccacgttgcaatatcagctctggaaaaaggggctgaatgtgaagttttgggttttgttttgatgaagtgaagtcgttctgcataacatttgcactggcttgttattctgcaggaaaacacttcctccatccacctcctcagccaccacgccaactactcgttccttcttctgcacctcccccttttaattctctctctctctctctctctctctctctctctctctctctctctccaccccccccccgcgtgcctctcgcctctcgcccgggtctaggcagcccccttcagcactttgttcaagtgcagcggtaaaccctaggctaagcctaattctctgtggtcctgaccttccttcccactgtgggcctggaatcaggcctgccctcggggtctcctgcttcattaggatccaactgtgctttctctcctctgtgcacctgatgcttttcaaacgtactggttcacccaaaaagaaaaaaaatccaaataaatcaaatcaaaataaataaacaaatcgtataccaaaacagaagttcaaaacagcccatgaatgcaagctctgagccgggttcatcccaccattgaaaccaactatgaaaaaaaaatgtttttggacacagggtctatgtagtcctggctgccctggaaattgctctgtagaccagacgggcctcatactcagagatccgtctgcctctgcctccagagggctgggattaaagctgtaccccacctgggcaggctcaaccatcctattcctaaagttttcaccgagccaagcctttttcactgccctgacacctacctaaagtctctccgggtgcctggagcacctcacctgcactgccactcctagtccctgtccagctcagcctctccctggaagcactgtaactttaaacatctagacaggctgcctgccttgctggtttcagtgacgactcccaggagaccgcagcctggagcagcaggccccatctgcagtgcagctgaacgagttaagctgccctaagtttgagtggtctggggtgggggcctggacctgagagaaccggcgggagccttgggcaagccaggccttgggggtccctagttgcagggtctgagttctttcacaagtgctgtttgagagtcccagaagactcattccttgggggtccctcctaaacccggcctagaggagattaaggatctcttggaccgtgaagaggcaaagttctaagacccgaaatgtttgaacctttggccctagggcctagaagggtccacgatgcaggcaggcaagggagactcagttctctgtgtaacccctaggtgagtttaggttactccagacgttgcagatagcgccccccctgccccccaagcaagtgccagaacccagggttagtgctgccttagcctcaccgaccccgtctgggcctcacaaaggccttgtgtggggcccgggccgaccagaagtggccaccattcccagatctttaattatgctctgagaccctacccttcccccaccccatcgccggcttccagccctttaatcaatttcacgatattaaatattaatttcccgccagccacgctttctcgaaggaggggggaagggacacacagggcaaagccaagaaaaggatggctttgctgggtgtgaccagggtaactgggcgtggaggacacgcgagctcctaagtgaccgtgcccagaactcaggagtcacggtgtttgcacccttcaactggggaacttggggagttatgaacacttaagatgcatgtcttcaggaggggcagccaggtgtgcagagttcgggtctgcttggtgaccacctcctgctctgcggccccttccccacctctagtggcgagtcaggctcacacgggcctgcagcgcgccgcgatgatggatcgcgcctggcgggggtgatttggtgttgatcgcacattatcactggcaggttggactggttgctgatggacgacttctagcggcggcagcagcagcgtcttcagacaccgtgcggtgattcgctcgctttacaaggtctttccccctaccaccctcctcaccacttacgcatgtcgggagagtctaggagagagagtgggggtctccccgtcctcgaggccacccacctcggtccgggaccgggtgtgggccgcaggcccagagaggaggggaactaagaggtctctcctacttcctctcatttctctttcccttacagcctgcccaccttccgcttccccatcggaacacgaagggcctaggtcacttggccggtgatttcctcggtgcccagcccagtccgcggggtgcagtctccctctccctgccgctcacgaccctctcagggctcccagccgcggaggcgctggggtgaagccccctccttgcttcgttttctaaagtgcctgcaaatacaaaagcggttccgtaatgccttccgtctgcgagagccggaggaccttggctgacctttcggaaactgattgcaactgcctgttaacagcccgtactgaccgcactgagcggagcggaggacaatcatttaagtgacagacggcgaggtggccccggctcagttgagcggcctggttaagccctcccctcccccctccccagctactcccccagctccgggtgcactgcgggccgtggccagctctctggagagcggggagggcgcaccgtgagcgcctgtgagtgtgagtgcgtgtctgcgattatgggccgaagggttaaccctttgcagaacgccgccggggtcctttgaagccgagcgctgccggcttaatctgccatttgcagaagaggaataaagaggctgccttgtcctactacccctaatgggtaaactgtactctcttagcgtgacccggtcactgtccctgctgctgccgaggaaagatctcgacccttggatcttctgccatggcgctatgtaacctccctgcgctttcctctttttcctcacagaaacaaggaacagcgcggggacagcgcaaagcgtccaaaggctttaaggttcgcgatgcagtggacgtgggtgttcctggtgttttctgttttggaaactggaaaaaggggaggtgggctcacagcaggaagggcaggtgggggagggggaggctggtgacagggcacctcgggcttctctctctctctctctctctctctctctctctctctctctctctctctctctctctctctctctctctctctctctctctctctctctctctctctctctctctctctctctctctctctctctctggagagatcgccagctgctctccaacaggcagcgccctgaaatctatttaaagagagggaaaggggaggagaacaaagggggaggaggggggcggcgagagagcagggaggatccgccgctccgcgggcacatcaagcgctcacatctgtacactccgcgatcgatggggagaatggataatatttgtcagctgcagacctttctcttcccggttcccaggaaggggagggggcaagggagggggaggggcaggcagaccaggcgagagaggccgcgtcaaggacagcgcgcctcccgctgcagccgcacggaaacccagtgcccagaaagccggcagatttttttctcttattatcattattaattattttttattattccacagcagccagcgagcgctcagccgcgcccctcccccgctcgcctgccgcctccctttgttgattttcagctgcaagcgtggcgggcccgagccaccgccgccgcggagcacgatttgctcttgcgccctgggtcgcagctgcggcccaggaagtcagggctccgcccccgcccccgccccccgaggcgcggcagatcctgtccaccaagcgcgcgcgcgcgcgcgcgcacacacacacacacacacacacacacacacacacacacacacacacacacacacacacacacacactcatcggtggccagccaccaggctatcctagcagtactttgctgcggctttgcgtcccccaaagcccaggcgctggctgcctcgaccaggagccagccgtgggccgcacaccggccttcaccacccccttccccggccgcggcactctgatgccgccaccctcacacatggtcttcatttagcacactagcggctcgcttcctctctgctcttctcctcggggcttttcagagcgaggagggaggtttagaggaagttagaaaccttgtgagcccacggggaagggggaaaccctcgttagcagtctgagcttccgagacggaggggagcgtcctacgggggataggacagagcctaggtgccctcccctcccttgaatgttaggaaggctaagtgagaggtggcagtctcacccattcgtccttttgcctgttagaccttatatcgctaacctagtggtgccctcagctagttggagacggattgggtagggtggagtgggagttgatgggacaggcagtcaacgaatgagacctaagatagctcagactgacccaaccgtaatggctagctcaccaaacctttcccattcaccccaggttgaaaacctaaaacggatgacccaccaattggcctgggtccactgtgttgcggaagatggaggaggggagctgcagagattcggggtttatttgtataccctcatcctcctgcgataccaagccagccagaggtggcgtccctgactgctctgcggtcctgggcagggcaggaagctggcgcggccgccgactgggcaggcaccacttggcctagcccgctgttcgctggaactcgcgaagcaccatcactctgagttgagttcccgagactccggcctggtcaccctgagctgttttcctcccacatcgtcagttggcctctctcgcaagtctcctgatctcccgccatctgcttttcccttccttgaccgatctctggaacttcgaaatacattcaaccgccttttctgagattcaaagttttgtgtttccccaggggttagcagcctaatgcttcccccgtttcccggaacaaagcaagtattcagccgggaggggggcaggctgagtatcctctcccagcagcgcctggcgcctgtgcaggttcagaacactctcttttgaatgcaggtgccttggtgtgagtgagtgtgtgtgtgtgtgtgtgtgtgtgtgtgtgtgtggtggtgggggggggggggctttctttcctccgtctctccggggagcccgagaggacacttgtgtttaggcgaggttctcaccccgagctaggagggcacacactcggctgtttacagtgtgtctgctgctggagatcacttgcccacacttgacagcgcggggcaccctcaggctgccagatcctcgagcacttcgccggaggctttcgcagtactggggccagggtgggcaaggaaaagcgagaggtctcttagaattttgaggttttgcagtccacagatcccccaccaccaccaccaccataacaagagtctggatcgagtagtctgtcaaaggagtttaggggaggagtgaagagctcacgaagcggggtgagattcaaaacagtccttgggctaccatcagacagcctatccccatcccccagtcccgggtgcgccctggactccactcgcgactcagaggtgcctctctctggacagcgctccgcagctccacctgtctttgccaccctacgcgatagacttctcaccccaagcaaggagggagggctacgctagctgtgaccacgagcgccccggctttcagccgtacagctcggccttagatcccgctccagctcttcccttctccccggcctgtggcccgctccaggcgcctctagcgcggcctgaaacttgatcccgtgtcggaaggacagtatgtaaacaccaggcgcgctccgagaacccgcgggaggggccgagcgagggccgcccgggcgagcagctccgaggccccgcgccccctcctgcctgctcgcccggggcgtgatcggcagggccgctgcctagctctctgccttccctgttggctcagctaattggagccgccgccactgtggcggcctcttgttgaattttctagatcgcaaccgttcagtcgtggctgcctgcggctcccttccccctcccacagctgttatcaaggccagcaacttgttggtgatggggacagtccctccactgaccctggcgtcaggctccgcatttacttcagcagttccaagagtgttttttgtttggtgtggtgtgtgaggtgtgtgtgtgtggtgtgtgtgtgtgtgtgtgtgtgtgtgtgtgtgtgagagagagagagagagagagagagagagagagagagagagagtcatgttggaagtgcaaggattcccgccaggattcgaggctcctggtactaaaccagggaacctcctggcagaaagcctttattctcacggccttgcaccaggaagtagtggcagtccagagggcctccaagaacaactccactagctttggttcctaaccggaaaacattacaatggggtggggtggtgatggcagaaaaataattccctctctcttacccggtccctttctctagttgacaccacatttggaacttgtgtgcaagtcccttgaacctcctgcactttggagtctaggccacctagatgccacaaagctacttgcactttgagttgattgatgtaccaagcagatctaggaaaaaacaacactctctgggctctgtagatgcagtgctcccaagctgggtcagcttcaagcctgtggtgcttccccttcctcccagccttctctggccagccatcgattgccccagacacatttgtactggatgccgtctatccgtgcagccagtaaactgtagtggcctataagaggttccaagtttggcctcatggcagagtgggagtagaaagcagttcggtagactcaggaagaaattactggtggcaggagaagaactcagttgctttttatccaacatgcacatagattgattgctagtggattgcacaggcccaaggcccaaccttgtggacagcagcaactcccagccaggaagtacatgcatagacagaggcaaactcccagggtttgggtgagtgagccaccattaggggaccttccacagcccaagagagagcagctgcttttcctgtttgggttctgggaagggtgtctgttcccaccctggctttgatggttccctgacaactgttagggaacaaagactggagaccataggctcattgcctgtcatttcccaacacctctggtcttcgcctctgactttcacccagatgactaggatgggaggttttcctgaggtacctttcccaatctgtttatactagagcacagtttcccactccttccatattgctttaaactatgatgaaagggaatttcacagaattaatccgataacttgatgtggaggctggcacttcagcaggtcaagatcacctagggttttgtttgtatctaagttcaccagattcttccaatcagctaaagttggttgtctcttattgtcaatttttcttctatttctatagctgggatggggagagatttctgaaaaaatgtttactctccattacctctacctaatctgtctgggaatgcctcgttcccttttttaggataaagcatatttctatgttttgataaggaagagaataattgatgttcctcttcaggcctgaaaagataattatgtgtcccaggagctgtctgtttggcagatgatcttgttttcttggccacttccctcaacccccttgccaccaacaggcctgaaggttctggtagctcaagaagaccctgaaaggtaggcattcatgtttgttgttgttgttgtttttatcataccaagaatatcccgagccagccattggaattcctgcttcatctgcctgaaagcttatgccaagagctccccatggggcctgtggtgatggatgtcttgaggcctaggaactggagctatcctgatggcagaagttgagtgcctgcatgcaagactcagacctgagccaaaggaaagcacagacagcaaccaaacaactccaggcacctggctggctgactgcatggaaacaactctccatccctcctccatccatcccacagccaggaaagcccacaggcataccatttagcggggtttgctttatttagctcaacttaggaatggtacccacgaatggtacccttaagcatatcaggaagctgagatgcagccctgacatctcacttcccttggcgcctgccttagcttggctgaacttgctgttcctgtctttttagaggacttgcttgtagtcttgaatcaggatcgcactgtgacacctccccaggggtccccagctattgatttttaatatccgtattcaatattgtgtattaaatattgaatccatgcatgagaggatgcgatgcaaatcaccaaccgtgcctgtgactttaatagttgttttattgcccggaaaccacagttggatgcaaggcatcctgcagccaaggctgggggtggtgggagtggtacagggatggcagacagaagggagggctgagcacagctgggcctccccaggcagacttgagacctctggaatagctcctgctgaagaaatagggaggcactttacagtgtttgcctaagggcagcagactgggggcccactctggggttcaatggaaagggctgggtctgctgtgtgagagacatggacagaggaagaggtgtggagccatgtccttccttccgggatttccctaactggatgtctgttcctagccagtaaccacccttcccctctccacactcaccccaggacaggcacacaggactactgaacaggaaagcgaatgtcagcaggaaaccctaggtctactccactagctgagctagccttagtatctgttctgtccactcacctctcttaacctctggggcagttttcctcctctgccactgtggggaatggggtctgcactgtctcccttagagctggatggaactgctggtgcaaaggacataataatattcaggggaaagccttttgtctgcagctgtccccaggtaggcaggctgaggctttagtgctggctttctctttctgttccctcctccagtccctccgcccctccgggtgtcttctttcaccccgttcctctttaaaggccttggaggcctccacttggccacccaggctccgtgacacccattttctccactcggctagacagtcaggttttaagggaccaccagcagggagacaggaagggccagaaggggtaggtggatatcccagagtatgggtacagggagtgtgcatgtgcaaagccagccgcagtggggaagcccttggtttcatttgaggcaagagagactgttttgcagccgcgaccagtgcaggcgagctggtggtaggtagcgagaggggagcagagcttgcaaggtactgattggcccagcgtgacaatctgcttgtggccaggcagtcttggtacctactcccgggtcttttctcaaattgcattacagtgctagtggttgagggaagcccagtttggttcctaattgctggaaagccagagcgggtagtgtgctataatggtaccaccatagggaagcccaaatggaaactcagtggaccacggcactccggagaccactctccacctataagcctgttatctttgccccaagcttggagaaaggtggatgccagaggagcctggatccaggaagactgcccagggactccctcttctgcttgggaagttccacacacctgactcaccccggaccgacagagaccaactctggcagcagggcccgccaagagtcaggctgtacgttcgtcactaggcacatgaatggagatgtgccaggcagggcctggctgcgcacgcctccgcgctggggctcaggcggcggctacagcctgtgtttccgggtctgcggctgagccttcctggcgttctcctctggctttgtctcactgccagcttctcgcttgtcctcgccagtctcctgggtccatgggtcgcgctctgcctcccagagtgcgcctttgcgcacgtgtagctgccttcccgaaacctagcctcttgctgcgggttactggacactgccttagggtcgctgtgtgtgtccatttctagaaggttccccagtctttagaaaaatcagtctcaggactacgagacaggagactcggagggtttgggtttgcttcgctccgatccaggccgaaactggcaagggggcttttattagccctcctactgcagagtcgaggggggcacacttctgcggctgacctcgctgtttgtggccctctccccacactctggagactgttagtcgccctgaagaatttgggcacgctgtcctgctggccggacttgtaggctggggtccgagtacccagagtgcacgcgcacgtgccaaaggcagggacccgcggtggatcagcaggctgggagtgactgggctgaaagccagggagcacctggaaacaccctaggcctcagggcaggtgacacccttcagaaccccgactccctcctcccccacttcgcccccctttcccggcccgcatgcggtcggcctctgcggcggaaacacggtccaactccttgaaagtaaacttgccgcgagctgccagggccgggagagagggagcgagccggcgggggtgtctgcgtcggggaggccggggaggctagtgtcaagtttcagcccctaatgacaatcgatggcgaggtgccaaggccctgggaaacggctggaaggggagcgggggtgtgtgtggggggcgggggcgggttgagtgaaagggaccacgccacagggcccaacttgcgaacctccgagacgcgaggcgcccacaagagctgagggaggcggcggggcgggggcgggggcgggggcggcgggcggggaggggcgctcgaggagccgcgggagaggagcggagcgcaagcatcttccgcaatccattcatgcactgaagcgcgtgcagagctgctgctcgctgccattgttactcgcgggcggtgtgggagcagagcctccactctggcgagagataaatggcctctgacagcccctcctcgccaagagagctcctcggatttcaccgcgcggcggctctcaggtctgtgccttgctcgcttcccggtgagaacctttaaatcagcctccccgccctcccttctcccggactctgtcccccccgccctctccggcccggccagggcccccgggggcgctgcgcacaggcacgagtcgcctccccagccgggggttacgaagtggggacgccgaagggacccgggggtcgcgggtggggagaagcagctagcgccccccacccgggctccgttcctccgcccgaacgccccgcctccgcgcccacaagatggatcaggctaccgtgcggagagcgggctgtaaatattttaaaagtctctcgcgcgccggcggtaatggctttcgcagttggaatgtgtgctagggaaagaggaagggcgacgtttgtgctgtgttgcgggttgagagaattgtttctataccctctccctaggttcggggtgggctgtaccgccaggatcccgggtttcccgccccgccgcgtcccgagatagcatcaagaacaccagtcgttagggaacttgagtctatatcagggcgacaaaaggcccagtcgaggtgactccagagccactttcttcttcgagggaggtctctcaaggtcttgggtctgagactggtccaaaacctctggtccaggtccgcttctcacgggtgatccggggagggcgggaaacgcacaaataaaaacccctcgagtttgcgtggccactaaaagctggggcttgggtttctgcagcagggacaggtcccgtttgcgtctttggtccctttctcaactcccctgtaaagcctctatccgctcaaaaggcgccatccgctttgcatttaaatctgaacgtagctttgtggctacttgggttcgaaacctgggtaggggagcgggggaaaggtcggggcgcagagaggttaatgcccaggcttggtggcagtcatgtgtgggcactcttctgcttcctcggttagtctaggcttggaatctataaggctgagcccagccggataggagagggtgggggaggggattcagtcttctctgtcgggagagacttaataggcccaccacagggcgtgtgtgaggtgaggtggtctcctttgccagcagcagcttcctggcagggcaggggcgccgaggtgcttggagctggggcaggccaggcacaccaggttctcgtggagggttcccggagcgtgggcctaggctaggactgctcatctctatcctccacctggctctctccccgatccgccagagagtgggtgcgggaggcctttcggggcgcgccagggctgccctagacggtccagtgcgtggagctctcagctctggcagctcctcttccaagggcttgtgttgcgcccttctcgcttgtttgtctcgtgtgagcctcgtaaaccgccctgatttattacccagactaaatgcttaatttgtgaatatgaaacagattaaaaagggcgggggtagggggcttgaggtcggcatattttagcaatcagaccaaagcagcccggcagatgtttcaaatttgtcgacattttcaggctcatgtggaaagccagtcagaatggtcaagagatcctttttccttcctccaacctgagaacttggcagtgatcaacaggaggtgattagtagccacacacacaaaaagacaccagcagtcaaggagttaacagaggctgagctcttcacctccaggatccgggtggagggaatgggggcctagggtcacaaaggcaacctgatcacaaagcctggaggagcccagctaaaaaggcccaagtattagaaggtaactctgaagaacaaagtcgagggtccattaaaagttaattcagcaaataaacttcagtggcgataaaacaaataagaaagatggcaactccaacttaaactaaccaacagataatagaaaggagtggctttgatgtggcctaaccatgtgctttccctttaagcaggtccccacagtgagcggcccaagacgggcctctgtggagcaccctctttgaaaagaccccatgtgtacaggcagtgctttttggcgtttgtcatttgggagcaacttcacacatcaaaggcgaccacagtgttcttttcagctccctggttccactcgcccagtgaagcagatacaatttctataaattggccttctcctctgggttttgattgatcatcaccatatgagattattgaaagtctaatgtcttatttcactttctccaaggggtgaggaggggaaccatttattggaagtcaggccacgtgaagactcccgggttgtgcaatagtaatttccattagcctggatttatcaacctcttgaaactcccatgcgtttcctgtgggtgcctcatttcacctcccttcccccaccaggcctgtgcttctgtggctgttcacaggtatagtccagaaccttccaattgggaaggagaaaatggatattgactacacggaaaggaacaaaagatgtatttctaagcatatttattccaatgctccaaattccttctttggcctttgttttccactccaaacttttttgtccccctttcgcctggatgcgatctttcatttatttaaagttgattatggcgcctctgtcttgtcctgcgccagacaaaagcttagagaaagtcaaagaccgcgttaattatatgtttcttgtaaactgacttttcatgtccccctaacacatttagctggcttggtgtttagtttaacactcaagtgctgcaaatatgctgcttaaaatgctgtctttattaaaacaaataaatgaattcaaagacctttctaatttcaactcgtgtgggctagaaacagaagagaaaaatggtaggaaagagtatgggctagggaaaggtagcagggagactggagagaaaaggcacacacatgcatgcgcatacacatgcacacacatgtacacacacaagcaagcaagcactcgcacatgtgcgtgtatgcgcacacacacacacacacacaggctgcattccttctgccatccctccctgcagccatgttaaactggtccatacaattgtccctggcttagccctgcagcttgccagcctgccaggattttccatcacttggtgcctaaggcaatcattagctcagaatggacagccctctacctgctagccgccagtcacttatcagccaggggtaggctggctacatcaagcataggtcccatttgttcagcctgagaggggtccttggtatttgcccctgggtgagttggtacctaattaaactctacccagggcagcttacactaaatatatgtgggttgagaggaggctgggaggaaaaggcagtcattacttaagcagggaaagtgacttttctgagagcgggaagaaagggagccgtctgatcactttgtttaccctaagcagagcttcagacaccacatcaatggccacaaggaaataaggggaaatgggaactaagggggaaatccagagaccacaggcccctaaacccaggccttgtcatcatctggaagcaagagggaggtttatctgagctctagacaacactggctgcagggggtggggagggggtgcgggggtgggggggagatccaagtgccctttgtggctttggagtcattgctcatgtgccacaggcctgtgtgtgtactcaggagctgggactgtataaatggccgcggagacagaaaggaacagatgtgtcaaagaatccagtgactgagtgtgtatggtaaagttaccctgacgaggcacgggagaacaagagaatgatcgatcagctgaagcctaggcctaggtggcaggatcccgatgatcagaactagggctaaaggactagtttgcgaacaaaggtggtggttgtggatctagaaagatcttggggtcttctttaagccctcatgaattcagagggtgaaaacatttgatcaactggacaaaaagtaaaaccaagtaccaagcacttctggttggtaccaagagttagagcacttttggttggagaaagggtttctttctggctcactattttaaccagttagcatttattaagcacttgccttacgcaaagcagtatgctggacatctggggccacaagtgctagactcctcaaatgacccagcaggggcgactccttccttttatgtgcaaaataacaaaggacataaaggactgtgggtgagcttctgaggacgtggagaaggaaatcagccactccctgagcgtcactgttaccctgcccctgcgcctgcagctggattccaggaggaagatgaggctaccagcctcttggggccagggacctctctgcttccaacctaaacccggaccaagctccagggccttccagattgttctgtttggatggtggcaggggtcacatgggtcctttacttcccccttccttggaaagcctgcctaactttatttcccctgggggccaggccagagagattttgatgcaaatcaagaaggcagcttttcaagtcaggactagcctgaccgagagactagccccagaccgagagaaaagggaagcttgcactgcccccctccagcgctctctctctctcctctcctctcctctcctctcctctcctctcctctcctctcctctcctctcctcttctcccctcccctccccccgccccccccccgctctttctggaactcgataagggaatactgcctccctgaacaaaacaaacttggaaatctccaaggtttggaattgtgagggagtcccccagcagagaatttgaactggcttaaatacatcccccttccctgggcacactccctctgtgccccctagattcgacttgccccttggggtgtttcagtgtgatcacaggtgccctccttcgagccatctggcctgggcccagcctttgctcttggtttccctacgcactggcgaaacgcgctggaaccttcaaagcgcattcctaaacactaccggggaactgtggggaagtgcaaacaaagaggctgggagtactcaggcagttagcgtactgagtctgtgggccaacagggctggcccaagttcagtcagactccctggctctgagccagctagagctggcagtgcgccctctccagcccactactcagacctccttgcccccaaatttgggcaccccccctcctcagccagcttaagtctaagccagccctcctgcccctccgcagtcctctgagaacagtacttcctcattctggtctggtggatagttgcaggcttctgcgcgagctctccgagagagagtaaattgtcaaagagcaggagcccttcccttctttcgagtggccccgggactgagcatggcctgagttccctgactggtagctttgggatttgagtagtggtgaacacttggtaacttcgatcctatgctgaataaaagtccgatcgtgctctgtgttcccttacgcaagcagacgttccctagaaatacaaataggaggtggggggggatgggtgtcaaatcacatgcttcttcatgggtcaccggtgagcagagtcattcgcccactacctttagctctggtctctggtctgtttaatactactgatggctcttgcaagggagtaggagtaacacctcaggtttccaagattctgcttcctttcacacaaaagctgggagaaagtctttgttggggggggggctcttagctcttagcccaacctgccttagaattagatcctagcccaggctattgttgaacttaagtcctggggttacatgtcaccctggcctgctcatgtgtatgttttgaaacagggtcttgtgctgcccagagctcagtcctcctaactcagcttgttgtgtagctgaaacagcaggctacaactacagaggacttttttatttctttctctttttccttatcccaccgagtactggaggattgaactcagagtctcatatatgctaggtaagttccttaagcactgagctgtagccttagtcacttttatagttttttcttttgagacagggtctaggctggctttgaactcagaatctccctgcctcagccattttagtcaaaggcgcagggcgatacactcggtttatatataggtactacagatctaaactcagacccctgtgttgtacaacactgaaccctttctcaaccccaagaattttttgggcagggggaggttggggggtctggggtcagttttgaggcagaatttctctgtgtagccctgaccgtcctggaactcgatctgtagtccaggctggcctcgaactcacagagatctgcctgctcatgcctcccgtgtgccgttactgctcggccaagactgtatttttttaagctataattcagtggtgtgtttttatcgatgctccacttacatacaaacaccttctgcccaatcttctaagtggggacttgggggctggtgtcctatgttttccttccccaagattctgcctagataactagatcatattaattgaaaatggtagggggtaacacctgcacgtgaccaaaaaaatgtcattgttttcagatagggtctcatggtgctgaggttggctttagactcctgatccttctgcctctacccactgaatgctgggattacagatgggtgccagggtagcatatggcaaaaaattctaaggctatcaaagtgtgttgagggaagaccgtgactctctcatccatctctgcttctctgcaggatcactgctcccagcttcctgcgcacaattgtcagcataggtacaaagaaaaaggaaaaaaaataaaaattctgtccaaaaaagagagggttggaaaactagttttaccttgaagaagccaaagcccaaagaaaaatcaaaagacccagtggtcttaatgaacatctatatcagaaggcaggctttcaaaagcacaacatttatttaacattcctattgcaagggattcagcagcctttcagaggtctgaatcaatttaacttcatcttaaactgttacagagtaatacattccccacttagattgtagtgatttcttattccctccatccacccttctagagcccagtgtggtcggtagctcatgcctacaacaccagcattctctaagctgaggcaggaggatcacttcagcctgagaccttgtctcaacacctccaccactaccactcaaaagcataggcatagtgatacatacttacaacccaggacttggagctagagtcctgagaatcagcggctcaaggtcgtactcgctatctagtaagcttcttggtcagcctgtgtttcgatataaggtccggtctaaaaccgaacaacaaaacaaaacaaaacaaaacaaaacgccgaaggaaaaagggtaggtgtggggtgctgcagcatgagactgctcagtaaggaaaggcactcgctgccaagcaggacagcctgagttttagcctcagaacccaggtggtggcagttgtcttgtgacctccatatttacctatgtgcactagaaataaacagaaataaataaaatgtcaaagtaaagactatctgaaagtttgtctggggaagctagggttcaaccgctgcctcggctggttgcctaactgtggaactaagcagttactctcagctcacccacggaatgggaagtatcaacgtggcccatcccataatgttgccattaaattagttggtgggcaaaactgacttaaaaataataccttgcacccagaaactgatcattgggggttagggagacttgagcctcacacacatctggttggtttcaaccttgctgtggtatttgtgaataagctatttgtctttgagtctctgtgtctctgaagccttgggtgtttgacctgcaagagacaggaggaaccccaacatgctactcgcctgtgatactctcagacagtttccagcatatttttggtttcttcactgttaatctgtactgttaggacaaaaaacactggaccaaagccctccaccctcaccattctttttttttttttttttttttttttttggtttttgagacagggtttctctgtatagccctggctgtcctggaactcactttgtagaccaggctggtctcaaactcagaaatcctcctgcctctgcctcccgagtgctgggattaaaggcaagtgccaccactgcccggcaccctcaccatttaagacatggggcaggggtggtgatagtgtgtacttacctagcatacatgacatccccagcagtttggtccccagcagtatgtaaaaaccaggtatagggctaatgaggtggctaagttggtttgcctcagagcctgaacacttgagttctatccctgggactcagtgattctctagaggtggatagatgagactatatttaaaaaagaaaaagacaaacattttgatgggtaggagttgctactcagaggtagagtggtatcttatgcttagcttatatgaggtcctgggttctatctatccccagtgctagaaggaaaaaaaaaataaacaagacgatggagtgtgtgggggggaggtcatgtgactcccacccttccttagtctgaccatctgctgtcctgctgataagagcttcttagaagacaagaacctgttgttatgtagagatccaaaaagccagatcttctccctaggggatatgcctaggctcccaaagaggctggggatcacaaaattgagggttggtcaggtgtggtggtgcaagcctttaattccagcactcaggaggcagaagtaggtggatctctgggaggccagcctggtctacatggagagttccagaacagccagggctacatagtaagaccctgtattggaaacaaacaaaaaagcacagctgaggatcagatagaagaagcgggtgactccatgaaacctctcactgtcctgtgagttagagagttttgttcggaccaccccctgcacctgataaaactgtccgggatatactttcataggacatgctgactggtggaggccctgacagcccgaggaaagacaaaggaatttgtttaaaggtatactttgctctgtgctagaaaacacctctcgtaatgttaggctttggaggcaataatatctgctcttgacattgtggtgtttctgccatataatttaattaacgtgtgatgcaggcacaaagccagagtcaaacgttctgacagctcttggaagccacctaaatccctttgaagttccttactacaccccagtaacacacagacaaagcccctaaggttgaagacagcccctgatatggggtgcagaattttatcagcaattccaatatctgcaaacttcctgatatctttttccctcaataaaatgttttatctggatgaggtggcacagtccgaactataggagagactgaagcaggaggatcgcctgagtctagattgaagactaatatagacatcgtatgatgtacccttaagtcagtctgtctgtctctctgtctttgtctctctgactctgtcttttatctgtctttctatttctctctctctctctctctctctctctctgtgtgtgtgtgtgtgtgtgtgtgtgtgtttgtgtttctgggtatctcgctgtctttccttttgagaaagggtctcattatttattatggttcaagttggctttgaacttgctgtataatctaggctaacctgaaattctttgacatcgtcctgcaccagtctcccaagtgttggtatcatagacacgaaccagtacacccagaaagatcatcaccctttaaaagaaatattttcttcttcgagttcacctatcacaaagttcctgagctccacacaaatcagatactagacttactaagaaggaaaataattatattatctgtataaaattatttaatgcctactaccctcctaacaatgctttgggcacttggcagtgtcttggatgtcatcaaattttattttactgaaaatggagaataaatacatgaacaaaaaagaaaatactgtgagttgtgctaaattaaaaaaataagaagggcaagggaataaagagagctagtatattgaaaaccatatattattctaaaaagaaaaaaatccttctagaaagaatgtagagagtgcattgtgagtcttgggtaggccaaggaatatacttaggtggtgttctcagtcagctcttgctgaaagaaagctgtgtaagaaaccacccaaagcacagagcagcaattcattttgggggatgcgtctgttggtcacgtgggtttggttgctgagcagaggcttgatcataagtaggagctgggtccaaattagctccatgtgcctttcactctccagggacgagtgggccagttagggccatggcaaaaattgcaagagcaaagaagaacaaaatggctcgggaagtctcccactcaggacttgccattgtttcttttgcttacgtttcattggctaaaaggaattctgtgatctgatggcagtgggctggggaaataggcctcacctctagtgaaatgagttgcagaatcaccatgtagatagggagggagtatggggcagtgagcagggtgcggagtagcccaatctgaaacagatggctcaaaccaaaactgtgtatctctagctatgacatttatatatacaaatacatatatcaaatgataaaaccgcctttggtggaattgtgtgttttagattaaatttaaataaacccatatgataattacacatcagcaccccctgaggtggcttatggatctttgttaccaacttcaggaaacctgggaatctaggacataggtcttgccaatgctgagagagaagtgtgtcttttttttttttaacatttatttatttattttatgtatgtgagtgccctgtagctgtacagatggttataaaccttcatgtggttgttgggaattgaattttaggacttctgctcgttccggtcaactccactcgctccagtcaactctgcttgctcaggcccaaagatttatttattattatacataagtacactcactgtagttgtcttcagacacaccagaagagggcgtcagatctcattaggggtggttgttagccaccctgtggttgttgggatttgaactcaggaccttcggaagagcagtcagtgcttttaactgttgagccatctcaccagtccccgagatgtgggtcttgagggagacttttcttatctcctggacttctcatgcagagtacagtagtgggggaggaagaccagaggagaccccagaggcagtaattgctcctgctgacttctgtgcctgtcttggaatggtagcaatctgggttttgctctgctgccaacaagcccttcagctgctctccatggctgcccaggacccagggctgggatggagattccagtagctccttgtccctgcgcctaccctgccttgtcttgctgtcctttaggttttgggtattattattattattattattattattattattattattattattaaagtgatcattgctttgtttgccttccttcagtgaattcctcctgggctctgcagccagccaaagctctggaagctggcccttcactttaggaaaggtcgttgttcaattgattcccgcagctaatggaatctaatcaccaaagcctggagtgattgcaatcagaggaatccacctggttgaaaagaatctaagttttccttttgtaagctgagagagtgaggtgctggggcaggcatgggctctaccaggctcctgtttggatgccttgggtcttctgattcctgcctttaaagtcatgtgaagtgattggccgcctgggagggaggaagcctagccctgaagtggaagtgggattgcttccaaagcagccagccaccttcaggctggagcaccgggcacactcacacaactgcaacttgagctctgagctcactggcaaccgcggtttggtttcgatgggttcaccctgaacttagcactgtttgaatctcccactcatctgtgtgccccacccctgaatccgtctcagttcttacgcagaggtcttcctgtgctttcagcctgctttccctattagatgctgctgctgctgctgctgctgctgctgctgctgctgctgctgctgatgccgatgatgacaggctgggagaatatttattttcagtgaaacacggtagctgtgcagagaagcacacacatcattagcatacagccagatcagcacactcgcctaactgatacccacatcaggattcagacagatcctcctcaggcctccaaccagatatctcagccttccttacacactcatctttaaggcacattgccaccctaccctgattcctaatagcatcagttagcctcctctgatttggtactttgtagaaaagaagggcatgggagtgcactgtgtgtctggcttcttttctttgcagtgtggcagtgagatctgtacacattatgtgtagtgcaattggtccattctccttaaggtatgagtacacattttatttatttctgtttcactcttaatgggcatttggatagttttgatgttgttactaataatgtggctgggaatgtttcgtgtacatgccctggagcagctgcatttctgctatgtgtgtcttaccagaggttgaattgccagggccataggttctgtcagcttttgctgttgttgttgttttgtggtactgaagattgaactcagggccttgaatctaagttttctatcaccgagttatgctcatagcagtatagtcagaattcatagataaggctgaaaagcatcccagagcagatctgagcgtggtgatgcatctgtaatcctaccattcaggattgtgatttcaaggtcagcctgagctacacagtgaattccaggctagcttggaatagagcgagagactgtgtctcaaggggataaagtcttttttttttttcttataaaatcctgagccatgatggctcagtggataaggtacttaccatcaagcctggccacctactagatacacacacacacacacacacacacacacacacacacacacacaaacacacacacacacaaactaattaagtaactaaataaatgctaaaattttgtttttacattttctcaaactgtacgtgttacatcagcacttgggagtccaaggtggaaggatagctctgaactcggtaccaggttgggctgcatagtgagttctaggtcaccctgggatagagccaacccccacttcccaaaaagcaggtcctcgcagatattttctgtgaccgtcctagggacatgctatctgcagctccgagaaacagaagactggtttgatttaatgttcaataaaatcaaaaacttggtccttgatctttagtgacaataagttttggaaactgagaatataaaatttcaaatcagactggagaggtggctcagtggttaagagcactggctgctcttccagaggatctgagttcaagtcttagcacccacctggcggctcacaagagtctgtaactccagtttcagggaatctgacacccctcacactaatgcatataatttaaagttaaattatttttaaaaactcagatcaactcctgcctctcgtctagtacttgggggcggggggggggtgttgaggcatgggcatcgctgcaagtttgagtcaagcctaggaaggtgagtttaagctagttttagctgcagactgagagaccttgtctcaaaacaaacaaacaaacaaacaaacaaacagccagatcatgttatacttccgtggtctggtcctgccccactctaagatccccaattcataggcacaaggtgacaatgtcactgtgtatttctgctacctgccattttcttggtgagtccatccagagctccccctgcagtgatagccctgctcctcccgcacttcttttgttgagcctgcgtttcactaagcacccagctggcctgggactcctagttgtcttaggtctcacagagatctgcctgccccccgactgcctctccaggaagggattaaaagtttgtatcactttgcccagcttgccctaatttgtaattccaggtgtcacctttcccagggagtactgtcccccacggctctgtcaggtcctgtctgttatctttgtgctgattgtacagccacaaaacttagcacagcattgttctgagaaggcctggtatctaagctcctctttagttgagttgggtgggttatttgttttgctttgtttacatgtttgttttgggctttctgacagagggttttactaagtagcagaaggaggatgacccaggctggttgaaacccaaatcctcctgcctcagtctcttaagtgttgggcagttttagagggcaggggccacagagccaatatgaagtgcttataacaccaattctgtctcttagtctggcatggtggcacataaccgtctcagcacttgggaggcagagagaaggatcacgtgcataggccagcttctactacttagcagctagctgggttctctgagatcctgcctcaaaaccagaaaacaatcccaggccttgggaggcagaggcaactggatctctgagttcgaggccagcctggtgtacaaagtgagttccaggacagccagggctacacggagaaaccctgtcttaaaaaaaaaaaaaaaaaaaaaaaaaaaaaaaaaaaaacaaccaaaaacaaaacaaagaacagaaaacaaaacagtctggaaagatggctctgcaattagagcactggctactcttctaaaggacctgggtttgattcccagcacccatgattgtctataattctagttccaggggatcaaacaccctcttctggcctcctcaggcactacactcatgtagtatacaaatatatattcaggcaaaacacccatatgcatgaactaaaacaaaaaaataaacaaaagttttctctaagttgtgtaaggataaaaagggcttgccagggtctgaacaagtaaatgctgtcatttgtgacatttgtgtatcagctacgcattcttaggcgagcctgggtaacacagtgagagactccatttctgaggttgaggccagcctggtctacagagtgagttccaggacagccagggctacacagagaaaccctgtctcgaaaaacaaaacaaaacaaaacaaaaaaaaaaaaaaaaaagaaggggactctaggctccgcctaacagttacttagcagcagtcaggtaggagcctggctcatatataaaaggtctctctctctctttctctcttcctccctccctccctccctctcctctcctctcctctctctcttctctctctctccctctctgtcccccctctctctctgtcccccctcccccctccccctctctcctctccctctctgtcccctctctctcttcccatcattgctctccccatgtattcctggccagcctcttcccttctttctctctcctctctctttttgtgtccttttctgtcctctttccctctactctctctccaagacccccttcccatgtcccaaataaagttcattttatactagacccatcgtatgactggtacctggggaggtgggggaatgcctcagcatgggcctgcttaaggcacccttttccaccgcatcatggcacagcattacaaaacatatcagggagagaaaagaaaaggtttacactcaatatgatgagcgtatccgtgaatgactttctgatctcttttggttgtcttatgaataatctggctgagaagggcccactggctggttcacacaccaatggcctcagggttgcttgggatgccagtttagaatacagagttctggccccatgcctgaaaattctcagtaggcttggggtggggcctggagctctctatatttaacgctctgactgtgacacatggccaggtttggaaactagagagtctaaaaagaatgctttcttcttggatgtgaggaaataccaggggccctgactgggatccagagaccaggttcacatcttcggtctcccaccagatatgttatgacttacacaaccctctgggcctcacttttctgtgaactgggaatcacacagtagatctatttggattaccagtgctgggcaacaaattgccctagaacttcacttaaggctgttttggttttttgtttgttttgagacaaggtctctctctgtgtaggccttgctggctgtcctggagcttgctatgcaaaccaggctatcctcatactcaccgaggagatctacctgcctctctgcctgttgagtgctgggtttaaaggtgtgctctatcatgcccactgaaggttgatttcttagtaacgttaggggtatggtacagggggatggggacaagcaagccaagaagcaaccatgtagccttttctgacttaagtcatcatctcacagtgtcacctctggtacattgaaaaacattcaaaagcccagctaggtttgaagatgtacaccctgtctcatggtaaaaactgtgacactcaatgtctcatggtaaaaaccgtgacactcaatgtgcaggagtgtttggaagcagcacagtacgtcttgagccgtcaggcagattcagcgaggtcagcttttaacataccctagactgacacagctccttccaatctgaggtctccgaggtcccagcaaactcaataccaggtcccacctttccactgctgggtgttggtgtcaggcgcccatagaaaagtagaagagtggtcaacatttctcacttcccagtcatctctagtcactttggatatagttcaaggcagcagtgggataccatctgatgccggacaccttagctcctcagagagggtggtcagatccaccaggcctctgttggtcccttgtgaccccgatatcaggcctcttcctatgcctactctcaactggcagctgtttggcttgggatggagattccaggccattcgcatattaagggactccgggacctactggtgctagaatgatggctagagtaactttagtagcatgcttctgtctccctggtctcttcagacttgaatttccttactgcaggtttggtgacactgagggaagatcaagtagaaacctggagggctgggggtggggttagagtagggggagattgggggactctcccagggaggaaaggatgactagtttctaggggatacattttacaggcctcatctgaggcagcatgaagagggatgtggggctctccgcagtgccagagtgggcaggaaaagcagagcagcagaggaaggagccattctgggcctggtcctgtgtgctggcatttatgaagggggccattgacctctttgaaaggggcagagaagagtccatgttcggtgttctgaggaagctgcttttcctcctggggctctccagctgccacatcagcacccctcctccactggcatccatttagcaactgtcttgttcagagctcctagggaaagagctcacaggaatgtggaagttagcgcacccctccccgtccccgcccaccatcgtgtacactccttgtatttcatggacatagccctgatgcctagagatggttgctgtgtgtgtatgtgtgtgtttcagataaggtcttatgtagcccaagctgacttcaaacttaatatgtagccaagagtgaccttgaacttcggagtcttctgcctctacctcttgaatgctataatcactgatacactcagccatgctcagtattgccaccccaccctcaccatgtgtgtgtgtgtgttcattctggggttctaatgtagctccttatgcttgccttacaagcattttactgaactatttccctagcccctttgcccagttttatgcagtgtttatgcagattgaacccaggtctttatgaatgctaggcaagcactctaccaactgagctgcatccttagccctctttctgtgttgtcatggataaacacacaccacatgtcccatggtaagcaccctaggaattcatggtgaaagacaaaatgtgaggactccgccatgtctgactcaggaaaggcgacaccccaaatcaagaaatggtcttgatgcaaactgcaagaggtttttttgggaaagaccagtgcactggggatgactcatatcccacgcaggggtagaaaagccaaccacgagctcaaggggtaaggggtttataaaggcacaaaaactgcaaacacctggcatcctgaaacaatggggcaacttctattccctgccattagtgaggtctattttggacataggtctaggggcttaaaatttttttcactctctctcagaatctttcaatggcaaggaaggcagggcgaggagtaacacgactggctatgggataggctgcctattctcatctccgtgcctcagtttccttatctgtaaaatgagggtaagggggtaccctcctcgtgaggaggaagtgacgggtgcctttaacaggttgatccccatttgttagggattggcaaaactgggattgtagaaagcaaccagcatcatctagaaggacaatctgaagccaagaggctagaggtgggaactgtatttaaacagcctccctcagcatcatatagggcagaggaaacaccatgactgtcagagtccactagctctgtgatcttaggaaagctaccaaatctcagggtctctctgtttttgtttttaagaaactgtttcgataggtagcctagggtggccaaccttgaactcctatgtctctcaggatggtttagagctttttggattttaatttaattgaattttttgagacagggtcacagtgtgtagctttggctggcctgaaacttgttaggtagaccaggctggcctcaacactcagagatcacttgcctctgtgtcaggattgctgggattaaagaggtatatcaccaaactaggcttggctttgaatttatgactctccttcctcagagtcccgagtgctaggattataggaatgagccactgtgcctggccttaagcctcagttctaccacctataaaataaggttgtggccatgtcttcttttaaccagacattcatgaagtcacataaaggaatgcattaactgtgcatctcagtcttcataggtaaatgaaggcttgttccctactggctcagagctgtgcatccagagggtgttttgttgttgttgttgttgttgttgctgctgctgctgccgccatgctgaggactggactcagggccttgtctatatcaggcagctgctttactactgagctataggctagctcctgggaccaggtttgatttatagatacctggagatctgacttctgcaggcttattagagacagaaatggtggcacacacctttaattcagcactccagaggcagaaggtagcagatctctgtgagtctgaggccagtctgatctacatggagttccaggatagccaggaacacatggagagactcttgtctccaaacaaaacaaaacccaagaaagaaagaaagaaagaaagaaagaaagagagagagagagagagagagagagagagagagagagagagagagaaagcaagcttgcaagggctgctggagagatggtttaagaaagaaagaaagagagagagagagagaaagaaagaaagaaagaaagaaggaaagaaagaaagaaagaaagaaagaaagaaagaaagaaagaaagaaagagaaagaaagaggaagcaagcttgcaagggctgctggagagatggtttagttgttaaatacaatcagtgttcttccagacagctggggtttggttctcagcacccacttggtgactcacaactgccttaggtacacacatttaattgaatctctctctctctctctctctctctctctctctctctctctcgctcaatactgtcttgctatgtaggtctgtctagcctggaactcagtttgtagagcaggttggcctttaactcaaaggccttctgccttctgagtgctgggtgcatgtgccaccacacccagcttgcctctcttctttaatatgttccctgatggcctgtgtattgttatggcaactgaaaacaaactaagacgtggacatatcctcacagttgggtggttgtctcgtcagttcttctgctggatatatcagggctagctagctcatagagatggagtcataactgtcagggagaatagcctggcaccttagaagtctcgcagtaccgctttgggaacattcctggtgttcagagcaagttattaaggctgcccaaattctagggggcagctataggtttcgccctgttctgatctgctcattggtctgctcatacttccattggcagagtacctgggtgctggtgatagacccagtggctttgaggtctggaaatcaaagcagagtgtcaatgcgcttggttctttgtgaggtcttggcttgtaggtgggcaccttctaactgtgctctcatggtcttctctctgtgtgtgcctgtgtcctcttcctctaggacagaagtcaaggtatattagggtctaccctcttgatagcattttagcttaagggccatggtttcccataaggtcacattctagggtactaggacattagcataaaaacatactctcttcctcccttgccaggaggttctgtcaagaacccatgccttcttggatggactctgaggtgacccagtctctcaccttggatgggatgcaactgtgaatacaactgttactattgtaacagttgtaactactattgtctcatctgcttacctgaaggtcagtgagaaaaacctctgactaggcctcacatcctccattttcaatttctcccgcaagcaggaacttttcccagttagccgctcaagtgtctgttgtctgtaagatgtcattgctgggcacacagcaggcttctgggaccacctcgcctatctttgctacctgtctttccctgggctcatccattgtaagtggagtttgttgtgttgtctccacgaacgggacagtgcagactgtccacacctgcctttgtcacctcccagctacagccctccatattccatctgacttcctctctctgtctttccagagcagtctccttggaatgagcatctcagtccttcgcagacacgtacatagggagtgtacagaaaatagttacagagcagaactcatttcagaatcttcacggtcctttcaggtcctagttcagaagcctgcagtccgaaatttcaaagaaccctattaggattctgttgttgttgttattgttgttgtttttgctctctctctgtctctctgtctgtctctctttctctctgtctcgctctctctctctctctctctctctctctctctctctgtgtgtgtgtgtgtgtgtgtgtgtgtgtgtgtgtgtgtgtgagtgtgatgtggacagggcacccctgtgcatgatgctcctgttggattcccattctttccttctatcatggattctgaggagtagactcaggtcatccggttgtgaggcaggtgttttcccggactgatcatctctctgtcccctccacagagattctgaaggggtttcccatcagaacctctcttcaaggaccatgctccttcctcattccacagctgctcatgtaaataatagtaacagtaataatactaatactaataataatttgagacaggatctctgtttagccctggctgtcctgaaattcactccatagagcagactgactgacatagcttctctgttctgttttgagaccttatgctgagctagcttaccatccttcctccactacttgggcactataacgacaggtgtgagataattacagggacttggtacgatggaccatttttgtccctcctatatccccccaaattgtctccccatcccagcctctgtctccttccaggttttattctagccctcctgaagccagggaaatcaaggactgatagcatgagtttgcagacacagctgccccaagagaaatgagaaaggggaagaaaagacaccaatgcaaatagacggcatgcagaggtggacatcaaatggccccacttctgggtacggcccaagggaagtagctttggtagcatcatcaacaagcacagtcgacaggagctagcatgtgctgcagcagcgagacttctgtacagcagttgggttctgcgtgggttccatcctgagactccattaggctttccccacagcttgtcagaaacctccagtgtgttcagctggctggagcaagccgccattctatagcttcagccctcccaccgtgctgtctctagtggtgccaaggtttcatccagaggtagagttcactgggggctctgaggagaggacccagccagggattagtaatgcccacaccccttattcagttttgcagctagactcatggtgggtatctttgaaggaagattagtaagtgtaagagacatgcagacctcagagttgcctcaggccccaggaatgaggtcagacgtgataaccgctgtgctgtggccagagctcccaccatgccatgcctctctgctaaaccagagcatgttttccaaacagtctggccggtcagtcaggcctggggcagcggtgggcagcaacaggctaagtgtgtcgctgggctgtgccccaaagcttgggcttcctaaatcagcacgttccctgttactcagtactctgacttgtgtgcctagaaatagaaaactcccctgcactggagggggcagggagctaagccctagtgacaggggactttgaattctcaggatggtgaccgaaggctgctaagaatatccagcactgaccacaagccagttgacaccctatgcagtggcaatcttctgttgcccttccggcctgggaggaaggaggttcctatgacatcacagctcatgaagttgtcccttctggtaggggtatgtagacatgagagtgaggagggaggggacataaaaaggcatccactggatcctgccttcaaggaatataaaactggaaaaccatagacctattgtccatctcttacaaaaatcatggtcagtcatccagaggggaccagcagctagatcaaggggtatctgaggcctagcagctaaggaacaagagccagggagactctagactcacacactccaatagctagccctgtttcttcgggtacaaagtcaggggcttggattaacgttttacaaacaaagaaatatttgtgtgttgttggtctcatgagctctctgcagtagaaaagaggccacatatacacgaatgcaggtcgcctggactacccaaagaagtcaagtaatagccctagtttgggtttagggtttagggtttgttcttggaggccagtggagggctggaaaaagcagattaaagactgagcaagaaagtgactcagttggtagactagttgcctggtagagcctgggctttgatccctagcaacacaccacacacacacacacacacacacacacacagatgaggtgctggcgaacatctatgacactgagaggtatagggagctgtcaggagagtcagaagttcaaaccagcatgggccacttgagaacctgtcgtccccccccgaaaaaaaaaacaacaaaaaacaaaacaaaacaaaaaccttagccaaggagacaaaaccaaagtaaccaaacaacaataaggaggagcagaagaggaacgcccatgccttcggagtcttgagagtggagcttattgttaaaaattcatgcttactatctgtgaggccttcggtttcatcctcaaccaaatatgaggtgggagaacaggacagaaacatacgcgtatatgtgttgtttgtatgtgtgggtgaggcaaaggttggcatcagtcatcttcctctgaagcccctggcactcccgacagcccaccatgcagaagaatgagcctcctaatttagcacaagctgggtgagccaacctaggaccatgagggcagcgctgagaggagggggagtgtgaattggtgccactctaactaggggcctggacagtggtctggagaagggctcttggtaaccagtgctttcagaatagagccctgggtgactggacaaaggggactgagggaaagtgaccaggaccagcttctaggtgggccccaaggtgactaggggctgaaaacaactcttgaatgaaggtctggggttgcccaggagggctggcagaggcctgttatctttatctccagtgaataccttgaatcactataaaattctggccacaggttctgcctcccttttcccctggtccttcctcctattgtagtttttattgtagtattgttaggatcctaggcccccaccccccaccccttacttagagcaagcatcctcctctgacagcatctttgccctgcctgtgcctgtgctgtctctacttttctgcaggatttcttcctgcagaaatccacttgactcacctcctttcacttttttccaccttccttccattccgggtctggaaaaggccttggactggtgaggtgtttcagtgtgcaaatggagcttgctgccaaactgaacggcctgagttcagtccctggcgggagagaatcaatgctggtaagttgtcctttgatctccacacatactctgtggcctacatgtgccacctccgcactctggatcacacaaggcttcctctggtcacctcagaatcatgccaagttctacttcttacatgctcttcatgtcctctcgtgtcttctgttgtgtccattgtccaccatctctggatgacctgctaccttgattatttagctgccatctgtcctgttggaagacacgtgtcctgaaggcagctatttggtttgtcccctttgggtagacagtgcctggactggcctctgcacacagtacatgtgtatcttgtaggtggggtataagccacgggctgcatggtggggagtaaactataaaggggcagcagctgaaagagggaggcagtcaggcagccattgccgcagcattgagagaatgctctgctgggcaggcaggtcactggatttggtgcaggaggagcagtgaaaggagctggcaagatcaaagattctggggctgcattactgaacagttggtggggggccattttctattgctgcatagcattctggagaccaggtacgttataaatagaaatttaagacagacatgttggggcatgcctttaatcccagcatttagaaagtgggtgcttgaggatcaggagttcaagaccaacctgaaatgtccagtagacctgtggctagtctgggtgtcctagcagtggaaaaaacagaagacccaagatggctcagcaggtgaaggaacttgcttgagtctgatttctgggacccaagactcctgaaggttgtcctctgacctttgacttacaaaaggaccacatagggggcacacacacacacacacacacacacacacacagagagagagagagagagagagagagagagagactcttagggtttctattcctgcacaaacatcatgacccagaagcaagttggggaggaaagggtttattcagcttacacttccacactgctgttcatcatcaaaggaagtcaggactggaacaaacgcaggtcaggaagcaggaggggatgcagaggccatggagggatgttatttactggcttgcttcccctgacttgctcagcttgctttcttatagaaccaggactacaagcccagggatggcaccacccataatgggccctcccctcctgatcactaattgagagaatgccttacagctggatctcttggaggtatttcttcaagggaggctcctttctctgtgataactccagcttgtgtcaggttaacacacaaaactagccagtgcgcgcgcacgcacacacacacacacacacacacacacacacacacacacacacacacacacacactgaatgaataaagtatgtattttttgactttaaagaatgctgggcagtgatggcgcacgtctttaatcccagcacttgggaggcagaggcagatggatttctgagttcaaggccagcctggcctacagagtgaggtccaggacagccagggctacaggtctcagaaaacgaaagagagaaagaaagaaagaaagaaagaaagaaagaaagaaagaaagaaagaaagaaagaaagaaagaaagagaaagaaaggaagaaagaacagtttaagccaaagaaagaaaggaaagaaggaagaagggaagaaagaataacagtttaagccaaagaaagaaagaaagaaagaaagaaagaaagaaagaaagaaaaacagtttaagccagaggtgataatgaccccctataatttcagtcctcgggaaggtgaagcagggagattgcagaaaatacttagcctggattgagggagggaagtgtggtctatttaggcgtggcttatgtgcttagtatgtgtgagaccttgggttctgagggagggaggaagagtggaaagaaaagagaatctaaccaccaccaaacaaacagaaaataggagacagggagtgagggagagagggagagagggagagaggagaggagagagggagagagggagacagggagtgaggaagagagggagagagggagacagggagtgagggagagagggagagagggagagagggggagagggagagggggggagagagggagagagggagagagggagagagggagagagggagagagggggagagggagagagggggagagggagagagggagagagggagacagggagagagggagagagggagagaggggaggagagagggagcacagaggttcacagcttgcaattctgaaggctggttggtaggtgcaagggtgtggtaggtgctggtgggcatctggtgagggtctccctgacacatcccaacaggtgcatggtatttcccaaagactctcccccaaatagcacgcacagttgtgactaatgggggttatagttccaacatatgaacattcactgtgggctccagtggaagtccctgtggaaaaggcagctggactggaggagaggcaggacagagtgggcatccggagcagagagcctccataacatgtgctgttagaaccaactgggctgtactgtagagaagatctgttcatgaaattttagggtttattttcattctttgagacagggtctcacactgtgcatcactcagactggcttttaactcactgtgtagccttaagctggtcttaaattttcaaccctggtgtcgggcttgcacgcatgggccgtcatacccagctttctcaggtaatttgactttattatttaaaattctcttcattgttccgggggccgtgccacatggaagctgttctctccttccacctctgcgtgggttccaggaattaaactcagggcatcagacttgagtggcaaatgcttttactcactgagccatctcgccaagatttgggcatgccattttacattttatctgcctccttttatatctaattcacactcagttgtttatttgtagacaattatgtcaagaggagagggagctggggaaatcagttagcactagggcatccagtaccctcttttggcctccacacacatacacaaacacataaaaataaaatagatcttccttttttaaaaaaatcaatttattatattttgaatttgttatcactttattgaggtatggcatacaaaatgtatacatctgcatgaccaacatccatatcaacatatggaacattccagaagtccctacagtggaagggaatctcctagtccaacttctaacaccttagctctgttcactttctgaaaagatgtcaggagactcctataacacgtgattctggggacagatttcctttggaccacattttatcagttagctgcatcatgccatctgtgcttgcgtcttacaaaacagccttccagcagggctgagccctgggagctctgttctgtgggctacatggagagacagcggtggatttgtttttaatttgagcggggcagagagaatattaggttgtggccttctcaggcttgtctgcggctggctcaggctagactggaactcttgatcttctttccttcctcctctgtcgctgccacccctggcttcctatcagtgttttaaagcaagtgacaggctgggctttgtgttaggtgctgcttgggattttaaagtggaagatgtagttgagaagagtgaagaggagataagcctggcttgcaggtcaactgggtgcttaagctgccagaccttgcctcttctctaggggactttcttcatgccattctggcctaaagatgagaaatagaaccattgcttcaggataggagataattcaagttctactgtctaggtcatgtaggaatgggtgagagacagagagagagcaaagagatgaaagagagagacttacttctgggtttggatgtggtttctggaacagaaattctttacaagagcctctcatgctgttggattattgctggtttctgcctctcacattagagggaatttcagaacccaacgtctagaaagggtgaatgctatggcctgggtgtggtgtgactcccccccccccccgccacacacacacacacacacacacacacaccagacacaacacaacacacacaccagacacacaccagacacaacacacacaacagacaaggattcaaatgctggcaccttgatctccaatttagcggtggtggcaactttaggtagtggggtctcttaagaggtaattaggtgcctgggtcctaagagcctttctgaagagatgcaagcgagtatcaccagagtgtattagctttcctgaaattgggttgcttcaaagcaaaacttactccccgactctctcttgtccccttctctatgtaggtactatcctcactgcttccctgccatgctctcatgatgcaggcaggggtcccttaccaagacaccaatgtcacactattggaaacttccagccaccagaggtgtgagccaagtaagagtttttacttcctaagatgctccgtctcgggtattttgtcctgccgacacaagcatcttgcccaagatcacacactaatatagccagccttacaaagcagatccgcatcctctgcaagctcctcccagactgtgtagcaccctccccttgacaaagagcctagtgttgccaccaaaagaacgaaattccctcattttgaaaggcgttgtgaattcagctccattgtgtagaatggagcaaagatgtctcgagccagcatgacattataattcacgtccctctcatgttatttatctttgcttgggtttgtgtgtctttggaagcagccttaaatcattattggaacaaagtagagagaaaaataataatatataattacaaatgaggaatacaccgtatgatcctattaattgcctcccctgcaatctttatttttggcattttgataataattaaaggattaggcttcaattggtggcagtggcgggttagccttgaactctataaacagtagcagtaccccctataggagtaatctggtaccatctgccacctgggacccggtcgagcagcaccagggctatgctctgccaggctcatctgaatatttactctgctctgaagagaaactgtggcaatggttggaaaataaaccccaaagcaaaggagaagcagaggagtaaggagactgcacgctgcattaatcattgccagccagcctagagaagaggaccatggctggttcaagaagacagagcgaaattatcatcaagattgatttcccctccagattccctgtgccaacaagcagaccaggagggtcccagtgtagccactggcactgaacccatgaaggtatcctactacaccttgtcaaagagcaaggcaaagctaaccaccaccctctgcctgtgggtcattctggagtttctgccagttccacccttggcttcacaagccacaggagtggggcggtgtgtgtgtgtgtgtgtgtgtgtgtgtgtgtgtgtgtagccctctcctagggacctggcagataaattcactgcaggacaatgatgtccttaagggacatcatttgcatgccaggatgcagtgaaggccactgttctgagcccagttctgataagctgagggacctagccaatgaatgaagctgttcacaggtcctagaaagtatgcaagttactacccatgtcttaccacaagggcagaggcagagatgacttgggtagcagttggatttggtgaagagtgtctctaagcctcagttccctcatctgtggaatggagacggtagttttctataaggaatgagatcagtgaatattgtgtttggcatataggaaaccctttgtaaattagctattctaatgctgaagaaagcaaatctgctccctagatctcaaaagctcttcagaagagaattgtggtggtggtgggggggaggacccctttccatagcacatcgcttcccccccccccagtccccgtaatgataggggtggcctttgtttgtttccagggctagcaatggaacccacgggcctcacacatgcgcagtaagtgttctaccattaagccagatctccagtcagctccatgagtgacctccatggaagctcaaaaccagagaaacttggcccgggagtggggaagggcaaggcaggttataatgtcgccatccaatgcagagcctcaggggcacagtgaggtttttctaactctgttacagggtctgcttgctctgtctgaagtttttaccttgagtttcctggccccacacatatccaaggcttatctggaagaaaggtactcttcatggcgacactcgggttcccatggtgacacctgctgatcctggaaagaaagaaactccttggatgctatttactgcagttggcaaggggccaggatgacccacgaaagacatgattggaggattgggcttcagaagtatctggtttgcagaagcagtgtaggcgcatggctgacatgtgccagatggccgtgaagttcagggagcaatccctgtggccaccccttcctagactgtctatataggagtatggttttggggggagggcgcatttctaagagctttagtctcctcggctgtaaggtgaatggtagtgcctcagggttcttaggaggcgtgcaggagactgcatggaaatgtacctagtaaagtattggaagggagcgaaggtccctcaataaacactagctatttttatcctgtacaaattagtcaaacagacttgcttgcatggtgacacagttcctgttagttcatgtcaaaggcatggaactgagagacaaactcaattgccccgtgccagttataaccatagcctacatttatggttcctggggctcttgaggagaaggagcctgcatcttctgtcaccaagtagcagctggattagctgagcgtggtagaggaacttgtgatcctgggccatacagtaggaccctgtctagagtggtcaggggtaggcaaagcacaaaaaggaggctatgcatttggttttctctggctcttggctaagggctcctgctgtcacctcctgtggatgattttctgctgccctcgggaaggctaggacacctagagccttccagaaacatgcccatgcaagtgagccactcggctcctctgaccaagaaagagctttatcttcatctcgtgctcccgtgggtctttcccgatggtatcaactcttcatgccttgtacttcactttcctaattccttctgccttagtcttccccagaaccacagatccactctctgcaccttagcaccacccctccagctgtcctgctctctcacagtgctcccctttctgcctcggcaacagaatgagaatcaggaattcaatcattcagtcacgaatttttggagattgagtctcagtatgcaagccttgaattcactaagaaggcccagttggacagagacctgcctgcctctgcctcctaagaatactgtcacagtaggtcttttgttttgttttgttttggaaacagggtctcatgtggcccaggctgtctttaagttctcagtgtagccgagaataacctttaatttcttcctttctctctttctcgctatcttcctttctttctttccccacaagaaatcaaaggatttctttgtgtaacatcggcgttcctagaactagctttgtagaccaggctggcctcaaactcacagagatctgcttgcctcttcttcccgagtgctgggattaaagagaccttgaatttcggatcctcctgcctccacctcttcacagccccccaacccccttttaatggggttgttggggatagaactgggggcactgtatcaattgagtgacattccaaacccttgtttgtttttgaaacatggtagcagccctggctgacctgagcatgctctacagcacaggttagccctgtctctgcttcccaagtgctgggatttctggagtgtaccacccttctcagcccaatagtgtgtgtgtgtgtgtgtgtgtgtgtgtgtgtgtgagtgtgtgtgagtgtgtgtgtgtgtgtatacacgtgcactcagtgggtactatgataggctctaggaagacacagtgaacagcaacagagagagcccattcaggagctgacagcagcctgctcagatggtgggtagattgcatggaaatggtagagaacaagttgcttggtcagagagttcaggattgttggtttgtttttagagacatgacctcaccatgttgcccaacctagcctggaactcgatatatagctcaggctggcttgaaactaaagggcctctttcctccgtctcccatctactgatgttacacccggataagaagtttgaattttgttagcatagcctgagtgtggagatcagaggtcagtttcctacacggtggacatggagatagaattcaggttcttaggcttggcaacaggcacctttagcaactgagccaccgaaccagcacctagttggttcaatctttgaaacaaggttttgcattgtagcccagcctggctttgaactcataatcctaccttctaaatactgggattccaggagctcagcaccaagcccagatgtgcatattgtacaaaggcctgtctaacaggtatgtggagggtagattggacaagcatgagaaatggtacctggaactaaaatcttcagtaataatccaagcaagagaatgcggtagcctgttctgtggttaatgcaaaagcttggaaactaggtagaatattgaaaagtagaatcagttctctttgccagagtgctgcacgggagcatggtggaaagtgaagggggaaggtttgtatcgttccagttttagtatatgtgctgccacagcgagcactaagaggaggttttgtgtagggctgtataatggtaggttacaaagagcatgggactctgaaaagaaagctgcctggatttgaatcctcttgtcacaaatttccttgagtgttttgaagtcctttacttcaatttttcacgtgacccatagctggtgcccttactggatagttgaaagaattcatagacaatttctgtcctaggcttgcttacttaaacatcactgggtaaatgttagctgtgcttactaagctagatatggatcccaaggtgagctatccggtctgccctttgatatgggggacctggaacctggaaacaaacccagaatcactaagtgaaggattgaaacttgggatgaagttcaccaaggaagcggggggaatacccaggcccaaggccactggagggccacagaaaagagcccagcaagagactgaaagtggctctcagcctgacaaaaacatcagtaggtcctaccactggaaacacatacaagggagcagggtagcgaaggcaaggattgaaaacagttcacaaacctttgatctcagcactcaggaggcagaggcagggggatctctgtgagtttgaggggagcctggtctacagagtgaattccacagacagccagggctatgtagagaccctgtctcaaaaaaaaaaaaaagaaaaagaaaagaaaaagaaaagtaaaccagatacttccccactcagcataaaggaagtgaccggttcccagcactttctgcagaatgcctagggaggatggatagaatagtttgaaaaaggacgtattatacaatgaaattgcatgaattttggcacaaacaaggaccattgccttgtgctgattgagtcacctgctacctgtctgtgcctataaatccaactgctagggaggctgatacaggacgattgcttgagttcaggaattgaagccagcttgtgtaacctaaccaggacggacacacacacacacacacacacacacacacacacagtatattgggagctgcaaggtgtggcaagaagtttcctgggtaaggagcagaatagttcatgcaaagaaattcggcttatgggcactgctggaggtctataacccactgcagggaaagcctagaatgtaagggaagctacctaacacatggcttaaacacacacgcacacacacacacacacccctgcaacataactatacacacatcctgtgcctgtttcttctcttaaccacagaccctggaagtcttccctattcgtaaacaaagcagaacatttcatgaaggtgctatccaattgttgctgggcaaattacattgtttcggatcctatgctttcacaaacaaagctgtgcttaactagtatcttaaacatacagacacacacaagcaacaataacaaaaagaaaactttgaaactgatgagtaaagaaatgagactgctatgctggcaaatgcctttaatttctgctggggaggcagaggcaggtggatctctgcagagtgagttccaggacagccagaattagatagagagaccctgtctctaaataaaataaaataaaataaaataaaataaagaaatggaactgttgcctggatgtagggatctccatcaagaggtgaagctgtcttggaaaacagacacataggaagctagtcccaggccctgaaagaactattacattacaggagatgctttgaccaaaggaagagagcagagtcagaaagaagagcccttgctgggcgggcatggtggcgcacgcctttaatcccagcacttgggaggcagaggcaggcgaatttctgagttcaaggccagcctggtctacaaagtgagttccaggacagccagggctattcagagaaaccctgtctcgaagaaaaaagaaaaaaaagaagagttcttagaatttgagccgggaggcagctaggaagagactggggactatgtgaactagtgtagagttgactttaaagcatcagtaagacgttctgggtgctgtggtgaccccaggaatgggtggttggctttcagcaagcgggtaagctcattttacaaattacctgcaatagtgctaaaaagcaagtctgtcactaaggagcaggatctgggaccttactaatgagactttagcttgtgtgtgttggggggaggttgtctgaaatttgtgtatttttcccccataggaaatgacatatatgtactggaaggctttggaaactttgaaaaaaattcctagaatttatagttctgatggttttgcaaattgtatatttaatcaaaggcactcgaatgcctctctctctctctctctctctctctctctctctctctctttaactattgaagagccatttaaatgtcaacataagtgattccctaccaaatagtgctggttagacattagttcctctaatagaccataatgattcataaggaggcatttctcgactctaaattgtaggcctattgaaatataaattaagatgataaataatttgaccttacctgagagtactaagtatttacacgtgtcaaatacgaaattaccctgaatatcacggcccctaaaaaggcagccttcgtctcagtaaataaaacgggttaatgaatttcccttggagagcgaagggaaagaggaatacacaaaaggctttgctccaggggctcggccctcccggccctccagacttgcagtggggctggggagaggcgcgggccaggttcccccggagagccaggcgggtgctggcggccttcggcgctcggcgcgttcccttctccccctccttccgcaacggcgctggagtttcaaaacatggagtttccacaggaactttgccaggccgagctcgcagccctcccgggttcccgcagcggcactcgcggcagcctccccgcagagagcgctgacccggcggccacccagcgcagcgcaaagctcagcagccccggttcactccctggggaggcgcagagcgccgccctgccccccccccgccccccaaggtcctgcagagaggactgcgccttcggcccggagccgagcccatccgcccagccagtgtgctggcccggggcgggagtcgccgaggcgatcgttgccgggtgggcacgccggcagccggctgcccgcggtgggatttggttttgttttaaagccgctttgcgcgccggggctgcggcggcggctgtggctctgtgtgtgtgtgtgtgtgtgtgtgtgtgtgtgtgtgtgtgtgtgtgtgtgtgtctgtgtgttgggggggtagcacattgtcaatgagaaatttcctgttcgtaagactcagcttgcagtttctgtcctgcccttgaactgacaagtggatctccgcggcgagagtccgggagagcctcggcagccgcgcgcgggggtgggggcgggggcagcggcgccgaggccccgggagcggggctgagctgggccgccgcctgccctcccgtttcccccgcgcacccgtgagctctgagccgagcggtgactaatctgtggctccgggcctcttggcgcgcagcccgggctcgcctcccgcccccttgtccctcctccttccccagcccctgcacgcagagctccgcggggtgaatcgtgcgggccgccttgccttgccttgcctagagtgtgggaagcggctcgaggcaggcgacttgggaactgtctctttcgacccgggccccgagtgtgcgtgtgtttccttccccgtaggcactttgatcagcatttcctctgtgccgcggaggagctagagcgaactgaggctctttaaccctctgcatgccacatccactgaaggcttcagggggaacatgcttcgggagacaggtccacccgatcgaatagatttggccaagccggagttatgtggagccgggctggatcccaggaatttgcccctgtgtggcatactcttctagggacagcaggccgggaagcccaaagccaaggggctgtgcagtaacccaacctgcccggcgaggcgcggtgtagcttgaaaggcccagcgggctgtggcttctggaggagacagggaagacttggaggaactgccttagagcagttcgctggcacagagatgcctcttagtctagggtagggagtcctgctcttgccccgcgctctgggctctggcccccactccctcccttgactcggcctcgctagggagttaatgattgatttactggctccgagaggccggcgccctcccaagctatttgtccacgctgaggagttgctggagagaggcgcagaggcctagggagcagggtctcgcctaggaggggcggccgggctaccgacgggaaaggatgagcacttggttagcttccactgggaaactctagccgtgtccgcggcgaacccgcgggaggccctgccaggacgaagaagggtgccttgggaagtggcacatgtaaatggattggcagctggtgattaggccgcccggttttatgagtcataataggccgcccgcctggccctcaacctgctggttgtagacttggtgtgttggggcccaagcggtactctactcccaaccgcgcagagcgaggatgctccagggggccctggctgccgtaagcattgcacaggatttcctctcatttctcgcagaaggcaacacaaacaccctaaatcaaactgctccgacaaccgaaggctccacacagacacatcaataaggatttcgcctcccgcgttcgaacgcactgaaacacttgtcctatttttatgcaaatgacaccacacaaatagatctcgcaggccctggagaggggcgggaggaggagggacgcgggcgccccaccagggggcggggggggggcgtcaatcccgcacctcggggcccgcgctggctccggtgcagtggggctggcactaaccaggaggcccgccccgcgtgcggtggctccctgccagcgccgcctagtcggccgcgtccccaggctgcctgcagaggcggattagggaaggagcgaagcgagcctgtgactaatcgcggggcctcggaccggagcaccaaggccatgtgcgactgacaggatcgacactagccgaggacacggcgacgcctcgcttaattgcaggctttaaaaattgccgcctgagcagctccaatgcagaaagccacagcatacgcgtgggtctggggagtgcgaccgggggtgtggggggggaggggttgtcccgatttctcgcctgaagaggggaaggtttggcatctcctgaaccgagggagcaacactgagccccccccccccgcgctttgcaaggtcttcccaaaggcatgctaagtgagtgtgggtgaggtggccagccaccggggacaaggttttctgtcatttgtcctttgagtccatgcttccctcttgttgccccgtactctataaagaaggcctacagtaaatgagtaaggttccagccagccttttgaaaaggagaatcacacgctaaacactttacttcgatcctttcctttattcactgactgagaaacagggccccgaaggaccagacgaaagccaagtcaagtcaacgcaccaaggatcaaggtcattgagtgccaaaagtctggggtcacagacaagaaccctggtctcttcgaaggcccgtggtcacagtccctgtgtcccaggccttcttcctggagcgctggggcctctcaggagagaagcgtcggcggggcggcttgtctgtgagtggaggtgggggttggaaggcggtggcggggaacccagcaagagaagtttccaccacgctctgctctgttgctgccaaaatcccctggcccctccccgcccgcactgccttccgttgccaccacaagtttggtttaacgagagagctcgggacaaaagcaaaccttttctatagaccctgaaaacaaaggggaaagagacgcgcgaggccgcagagaagcggctgctagcgtaatggtgccaggccgaaagcagagcattagaactgcaaaagccgcgcgggcgggaggaagtgcgaggcaggaggcgggagcgccgggagggcgggcgggggaggggcgctgcgccatgtttccgtgtcacccgccgagtcgccggcgctgggctcggccgccggctcccgcctgcctccgtaacggcagaaagcgtgcgattagcagccagacaggcggggactccgggcccacggggccgccgcacacgccgcccgcggtcccggcccgcgctcccctccccctcccgccgggtaatcctcctcctcgctgcagcgctgtgtgcactctcattagagcagggtggcttttctctgcgcactcgctcggctcccgctggcaaaacaacgccttccccggccgggccctgggccaggggagtcggggagggccggacgggggcggggtgaggctgggacagcctcgcaggttagctccgccgccggttcgaaaagatggggaggaccctttggccctcccccacgcgcagtgccaaagccgaaggtccataccagactctctgcccctcgggagaggggggagatgctggtgccatcctgacctactgccgtccgcggcacgaggccagaatgcgtggggcagatgagggtgtctgggttgaagagcgggagtggacactggggaaggttcccacaactggtttttgacccgtgtggcttgctaacgacctcttaaggccagaagctggatttcaggtgttgttgccctaagaccctcagggagatcagtgccctttctggctttggggttgaccgcccaaaatgagtaggaaatgggtggggggagactccagtgctccggagcgccccatttctgttccgcgatctctgtacacaacagtagacagcttctccccggcacctcgcgcccagctgcagggctcgggagcaggtgttcctgcctggcccaagtggcggctcagcgcccctcctgtcccagctgcggggcccagagaggagggaggggaaaggcgtgttggtggcggtaactgggaggggggggacgtctcgccggaccttgcctaaaatgggtccattccggggtgcggacaatcgcctggagcctggaggaatctaggaggacagacggccagctcccgtctaggactgccctaggggccagcactggccgttcggggcggcgggagggcttccggtccccgtgactgcggcggcggggcggcggggaagttcccgtcgcggccgcgaggagcaccctcccctggctgccgccgccgcgcagctctcggagcagcgccctaggaaccccggggcatcgggcgacgtcgccctcgccttgtgaagggatgggggcttcagggtgttcctcgatccccgccccgccccagggacctgaacgcgggatcggggaccctgcgggatcggccgcgcgcctcccagcccctcctcgccgctgccatggcgggcacgtgaaacgcagctcggcgccgggagcccgccggggagcggcctggcccgcccgctcctcttcgcagcgggtccagggacgcggaaccaagtcgggccgggtcccgccgagctctccgcggccccgcaccccatccctgcccgaaccgggccttgaggtcacgccagacgactcgtccaaggggaactcgggctgactaatgggacgcttgtgggcctccggagaggccgggctggcagcagtgcccgctcgctctgcgctgacgctgcgaccaggctcttcggggaagggcgagaggaggggtttccccgaccggtggtttcggctccctggggacaatccggctgcggatggctctgggctttgggtcctgtagcctgatcccgggcccgcagactggaggtgcttacgggaagaaggtgcctcagagctctgagcctgttgtggggtctcctttgcttgctatcttgggccagcagctttattgggggggacggggggcggggagttgcaggtcaccttgagggcgtgggcttagataccaaaaccttcaacaaatagaaagtcttccggaaatccctcagtgaggagaaaacaattgataaaactcagggagagtccagtttagttgggagttctcagggtctgggccctccccgccccccactcccgattacagggtcttgtgaaaatcaacagagttttttttattttttccaacgaacagccacctcattgttgacatagttattatatggccctcccaaatatagctacctgtttgttttagtttcagcacatcctctcgatggtgagacagaaatatagaccagtaataaaagataaacatgtgtcagatgcagaataagtcctcatcgcgcatccctggttttgagtttaattacactagaaatccagtcctcccacgagaaggcctgaaaccctgcagtagaggtgcgacttttcctggagagcctcgcctttggagaggggttgctggtggaaggcagttaggttttaaatgtcacttccaaatgaaaacgctttccgtcagcttttttctttttttgatgcagttttcgaaaggagcattttttcgagataagaagtgaccgatcaaaatcgctgaggggaggttgtaagcagccgctttgccccagcttagccttatcttatctttcacacttgcatggcggaaaaaaattggcttatctttatccccaccccattctcgccttaattgctaaaaaacactggtgtgttaaacgggcaggaaggaggtctctggattgtcagcagaacaggaagattcaaaaaactgtgggctcctggggaaagaagagggtgacagagtgtattttcccccccccttggcctttcttgtacagtgtggagggtcctgtcccagctggaaggcaccatgatcagattttttttttctttttaaaaagaattaaaaccagtatggctttggcttgggcatcttcccggagcctcttttttttctcgacaccctgtttaccaacctctctccttcatcccctccccctccaaacaacaacaacaacaacaacaaaaaaggtcagtgggtctctgattgagactccctaccttcatcctctctcttctgtgttgaggggtgggggtgccgggttgggacgtgcagcttgctggaaatcattaaaatatatgcgggtgtctgcaaacacacacttttaaatcatggcgttccctctccatgctggtatatttaaactccagagcgagctggatccccttcctttcagtcgtttgtctgtgtcaccgacaggccgctaatggctgggcttccaggcgctgtgcattatgcattaacctcctcctaccgcggccccacacagaaggttctgtcaggcctcacgacgcaaaccactctacatccccgcaatcaagacagggcggggtgggctgtacgggtgctaaaggtctggagacgctggggtatggagtgagggcacagcagatcgggcctgcaggaagaatagactcaggtgaattgtgctggtgattaagttaaaccctttggaattttcagcctggagaggtgggatggtgaccaccccacaccaaccactctccccctctgggtacctccccccaagcactcagttgattagaattaacccaagttctatttttccttctgctggcccttagtcatttccagaccccgccagtccccaggtagcagagataagcagaaaatggttggtagcgggaggctggtatgttgggtgggaaggcaattatttggcaactctgtcccctttaatttgcattcccacttaccccgcccctcacgcaggataaactatgccctagagggcctagcaaaacccagaacccagtcctggacatagcataagggtggatctgcaggggcatccggcttcaatgcaggggccaggccttttcccaaagcctcctgtgtttctgccatctggccagtacctagtcagcctttggcaacagcagtatagactgagattccagaggtcagggcctggcataaatgtagcctagagcaggattttcctgagattatttctgtgagccattctggttctgttctttgggccacccacctccaaacagcctataactctccaaaggcaattatcttttaacctgtccaaccccaaatctaacagttttctgcccgggaaggcagctacctctctttagatatttcacaattagtaaactccttagggtcatggataggcctccaattgttacttcatttgagttttgaaaggaagacaggctgagctagattggtctacgctactccaccccaccccaccccaccctatggatctttttttaagtcccattgggtaagcctagagttcatttgctaaatgtaagattggaacactgtgaatgtgggttatttgcatgtttttaaaagatagttaacattaacagtatagcccacattacataaagtaaaaatgcatctttaccattcatgtatggagtgttccaataactccaataataaatctagtaacatcagccagaaaaacaccagctgaggaggcctatataggaggctacagaactagggtttccattctatacatacctgtcataaatgaatccccaaccacacacacaaagttgggaacccagattgcccctaattgtaggtaggacctttgcataggatgcaaggccttaccccagacctaggggtggctagactggtggaagtgcggaaggtcttataatcagcagaattcagcaaggacagacaggtttcaaatttgctcctagaagctccaatttggttgtccagttgcagagcctgcttagaatctgtagcaagagaaggcccgggagtctaaagtccagccgaacgttataatcacaaggccttttcatgggggatgaggctggtgggggaggggaagcatccgcagctccacctcgcagtacttctcatttccgtgctgatttatttttcatctggcaaggcatcctcccttgcctcgctctcacttgctcatctgctgcgctttgctttccctgaaatcctcccttttcggagtatcacagtctgacatcagggtcagctctagtgggccttagaggagagggcagggaagagtgcgaccatatgcatctgggcactcccagattcagtagccacccctttgagtgaggggcacaagaagggactgcttttcaacagctttcttttcccaggcaacaattttgacgaaccaggccaataggtgtgatccttctccacttagggccctggggaaagtctcacattttaattctcagtgagtcagaaacaccccccccacacacacacacacatttttgcgcctgcctcttaggactcccttaataagatattttttaaatcccacggaattgggaaacgcatccctaagagatggaagagaaagcttttaattccaccaactcactggagaaccccgtggagtccagagactcccttaaagaagagggggtgactgccacaaattacgtcaaaggcgaatttactggcctgtttgtctccagcatcaaatttctccagcagtcagccttccccaaggccccttcacccttacagcacccccctccgttttagctctaggacttaaagttagacaaacagaccccattgtcagcagtctcaggaggccctacgactcgagaggcctcaggctccatgatcgcctcctggattttcggaaagttctggacagttaatgtaacttggacgctgggaaaagcctgttcctgggagaattgggaggtgagaagagggggagagaaggtggctgggcagcgagccagggcttctgcggtgcggcctaaccaagccggatgagcctggcactgctctgctgttagtccaggccagccctcctgcccagcccacagccgcaccgcggcctttctgcctggaatcgtgtacagagtttccccacaaatacccaactccagctttcccggttatttaagacttgttttgaataaaaggagtcgcttcaaaaagaaatgttgctacaacacacaaccagcggccttccctccagctgtgtctgtaacttgcatgcgttcagtctaataacttttaatgtctagccctaaaacgtctttataaaaaatagctttacagcataatagtccaggtgtctttctgcttgttaccggagattaaaaaaatgtgtaggttagctttcagagacaccccctccgccactcaagaaagaccaggaaaaagaaaaaaaaaaaaaggcatacattccattctgcaggcgctggttctggaagcattagcggcacagcacagctaggcactacccactggcctgcctctcttttgcatcagttgttacaagcatctctggagcatgaagatttaattctgttcaaagtttcgggtttcaaacggtagagatgtttcacttctgctttgagaagggctgtttttataactatgctgagaactaaaacagaatgaataaaattgcacctaatatcagtcacaaagtcagtagtgggtgtcatttttaaaaggaaaaatatcttctagctagagatgagattttttggtcttgaccttgacttaataatcaacttgagatgcttttaattcattgttggcgtgtagacgctccaggatatttaaaaactttccgagtggggttactagccacttccatttcggacttaggttctcatcaagcctgcaccaccctgtccctaggcagaagacatactccagcccgtcccagaatcgaaagaccccgtagaagcaccgaatggggtaaccttttggcctcggtgtcagggctcccagcctgtgtgccttgacttcccttcccgccagcttttcaaactggagcggtgttcgtccttgaggctctgcattccggggaggcctgaacctcgcttctcggcttccccctttcgcttgcctgcccttccccgccccccatccccccctggcgcccagagctgctcctggtgcgtaggagaagctcgatacgtgtcaattggattgaactgctgcgggcgcaggctgtacactgccgccgagccttgatctgcacgacgttaccgagtgaaaatttatgggctgaacggtgaagccaaaagttgttcccggccaagtaaaataaaacgcgggagatactctcacgaggccgaggtgagagacgagggcagaccttccagccatcggaggtccggactgtgaaatgcttaagaactgggagaaactcaggctcatcccaggtccctttatggtcctcccacccccttgtgtccccaagagcagccccccacctcaacacaattcccacacaattgaaatgtccggggagcaagggcgcggaactgccactgttgcgggtggtggtgttttcacgtagctcttagcgccttaaggggaagtagctcctctgggaagaaggggcgaggtgcggtgggggtggacgcccacgcgcactcaggctctgctgggctggctctcggaggggacgctaggccgggagagcgcagcgctggtggcgagaggaggcagtggcgcctgccgctggggtttgacagctttggctgagaggagtgcgaggcgctttatggtaattgcggtcctccactggccttctgggtagcaaggggagtctcggcgcgcggcagggaaagcctcccccgccgccccgccgccccgccgccccccattcttggggctggggatttgttggccgacctagccgtcgccgctgcggagtcggtctccaataccctaggacgtgagccctggctgggcgtgaatgctaactcggccggagctgggacggagaggacagagggcggtagagttggggggggggtacgaggacacgacccgccacccaggtggtttggggttcagatgtggcgaggccccaatgcacccggctgggaatccgtgagggccggggaaagtcgggcgaacctttcctggggaatcaccccctcccgaaaccccaccgcggaggcgccgcagcggagggtgagcggagactggggatctcaaacttgcgagagctggaggcggcggcggcggcgggcgggcgggcggctgtcgctcgagcgctgcgcctgaggggggaggggaggcggctgttgggagggagggagggagggcgggcggagggagggggaggaggaagaggagggaacctgggaggggggacgcgttgggatcgcggcgtgcggcagcagacggagcctgagctcccagcggcaaggtgaggcagagctgcgctccgggccgaacggcgaccgagctcttcggccgagggggagacgcgccggaacccagagcacgaccgagagcgggagcgaggcgggcggcggtggcggagggggagcacgcgagccgccgggcggagagcccgagccgcgctgtcgccgcggagggacgacttggccaacacactcgctcacacacactcacacacacacccagcccgagcgggcgctctcggcgaaccgtcaacatggcgctggggctcttgcccgagcgcgggcggcagcggcggcgcgggagctgctgagggtgacagagctcgggccagctgcgggaggagaggatcgcgcggggccgtcgccacctgccctgaagctcgcagcccgccccgccccgccccacccccacgcggcccagagcccacccctccgccgggccgaccccgagggcagcagagcggctgcagtcggcggcgagcgagcgcggcgctgggagtggactgcgggcaccagaggaagccaaactttgctgctcgctgcgctttcccggccgggctccttcacgtagccgccctctcccgaccccgcacacattcacccagccagccgcccccggatcttcctcgccgcctggactccgctccggggaaaacttcaaagcgccggatcgcagggctccctgcctacttcccgactggggatttcaggtcagtgcccggaacacctttccccgggggccgcgggcgggctggcgcgccggggactgcagccgacctcctccctccgagggtttctcctccgacttcggtagacccccgttgggaggcttagctaccttgctcgctttcggttttacatcagagctgcaagttattaaaaatgcagccaacctaagcggcccccgcatgggcaccagggagggagggactcgacggaggacctgccgcctcccgaggggttgggaggatcgggagttgaacgagtggaagtttgcagcctctgtgtgtctgcgcgggagcgcggtcgtcgccgagcgtcgggagtcaggcgggggggggggtgctgggctggaagctgggaacctcgtctcggcgttacctcgctagcaggaaggggagggcggcgggttcccgtctgctttctttttcgactcggaaaagaactgtaaaaacccccagccgccgccgcttcgtctggcctctcctggggcccggcggtgcctccgagtggaacgccggcttgagcgtgcgctagtgtgtgcggcgggcgcctcggaccgagccgagctcgacctgccgtcgtcgctcaactccggaggggagtcccgggtttttccttggcttgccccaaagcgtgaatcacgtggaataacgggggcgggggggggggcctactaggaaacagcggagagccggagattcggaatgggccagtccggcgacccgtcaggtcagatgcattgttttgtaaatgttcttttaagattctaattcgaccccccccacctccatcccttcccttcgggaggcgtcccaaggcaggttttaagttcggagcctcctggagcccttgtagactgcttgtttagggacggcgtgggggagcgagcagagccctcggctctccgcttggctgtacggagcctggtgggaagccccgatgggcgtgtgaaagtctgcggccccgggaagttggtcccactcggagggagggcgacgcggaggctccaggcgaagaggaactcgcgcaccgggcgcgatcctcggctgaggcggggagggcgaggcggcacagggccagcgcttgaagcaggcgggaggctgcgctacggagccgccacaaactcgggggctgcgggctgcggcgaagagagcctgctattttcgaagagagcctccgagcgccctgaacggagtagggcggctcgtggcacgtgtagtcccggcggacttctggctgcccggcggctcaatggaacacgtacccacgtcccgaagacgaccgaacctgtccccttgtaggccgaggccgagccaggcttaatttgctgttaatgaatcttttccagaaagtctgcgacctccagctagactctgaatacccgcgcgcgaagacgcgcgccgccggcgtctaaagggtgggggttgggggaatagaaaagcgaagaaggaactggaggagggttatgtttatttaaaaacaaaccttaaaaagaaaccagcgcgcctcaaataggtattcgtcctgcctggttgcgtctagactagacagaccggggttttaactgtaaccccctccctgcgcacccttattgagagaatgctagggatgagtactgctatttggttctaaggttagttccttggacggaaaaaaaatactttaaaatggaccgggaggaaaaaaaatgaggaaatagcccaccccagaaggtggtgggtggtgagcagacagacttgggtatttctagccatctgacacttctgtggcattggaaacggacaccaccaccgggagagaccgacctgtacacggtactggattttgctaacagaattgcttgtgtggaaggtatttcaattgtcgacctcagagacacctatatgtggactcttggggggaatactctcttctcgacctttcccactccatccccgactagttacctggtctgggttgcagtgtcgcctctggtgtttatttgggattgaattgtgtcgtgtagacctacgcggagccgggatgattaatatgccgtccaggtttaatctgaggctggcctttagtgtgcggagtacaccaccacgtacgcgaattgcctgcggtggttaggggatcacgcgggtttcggtcaccaggcgctgggcgggtaggtctggactggggctcgatcggccccagctctctcctttgaggcgctgtcaccagtaggtgactgagagttaattaggaagtgttctctggatcaatgggccgcacagctcattagcgattctttccagccctttgcagggccggcctggcctccgcctcccacacagcccgggcccccgcggtccctgctgcggagagtgccgctgggaagtggggaggggtggtcagtgagggacagcgggcaggccagaacaacttcgcagggccgtgtgttgcgtgcgccgccgcgaggtccccacagcccgctctttcttcctgctcgcggccgcctccactgtgtctttaactcgctctagctcgctttgctgcctggctgctcctccccgcctccctcgcctatctcttgttctctaagcacgacgcctgtgctccccgcccagtttgggattagacaagataaaaataggactgcccagcgcgcagagctgtgacagtgcccgggtagccgggctgatgcgagcgcaaggggtagggtctggggaagactagcagggtgctcgggtcggccagattcttattggaccctcacctcctaccccgcaggcgccgtcacgctcgctggactccttccgctgtgaaccgtgcgggccagggggacctgagcagggtctccgcgctctcgcgggtgttgttggtgtgcgggtgatagatcggtctagacaggcatgcagactccctcccggctgaaggacggggggtggggggcagtggagtcggcagccgactccggagagctgtgagctagcaagctaaagctagcctgccgacccagcaagccgggcttgcttgccgggtggaaggcagattgagggggtgtctcttaaccctttaagtgcggtaaatagtttaatggggggagggacaatgagtcttgtaaaagtgacttattagagtggtctgcggggtgggggcctgggttctagacccactcgtgttttcctttctcttctgtgtgcatccgcccattctttcacaaatcgaatgcagctgctcgacagagtactagcttgacctagtactcctgattctgggaactttgacctcaaaatgggcaccctcgcctaagaatctgagtttctgagcagactatatagacctctctgtttccaatggggacctgaagcatgtagggggatactcaaagtgagagaaggtctctctgacccagacgcctccagattaaagcccccccccccagcctgagatgccaggccagcaaatacagcatgtatgtattggtggcagaacacagcattccttgagttgtccataaatacttaaccacgaacttgtgaatagttataatcagacatgtgggagagacaatccaaattggagatggtctggacacttaaaaaaaaattctatcattcgtgtatcgatgacctaaaatttactgcagctcaccataagttagtctagttctattcggggctggatattgataggtaggttcccctatatagaattaacttattccctccctcctttcccccttaaaaatgtgtggcctaaggttcctctgtttacatttaaactgcaaagccatgctggtcaggccaggaaatgaacttcattatatggctagccaaagaacctaagcagtagaaagggaatctcagattaagatgtatctctgaatgacaagtgctgggacaaatctagagactttggtcccaatgtcctagtagaagagatgcccaggagataaagaactggacaagagcagagtaaacacgggtatgtaaatgtagaccatgtatagtggtattctaaaagaaaaactgtagatgtcatgaaactggaaagtggggcagagtttccatgtgttgcaaagacaaaacccatttaaagaagtaaagagggtcacttgggaaagcacaaaaggcacgcatatgcatacataccctgtgcttagatacaggggcctaattaccaagacctcccctttgccttgagatggacttttcactagtgagactgattgaaagtaagaggggagccagggcgtggtggcgcacgcctttaatcccagcactcaggaggcagaggcaggcggatttctgagttcgaggccagcctggtctacaaagtgagctccaggacagccagggctatacagaggaaccctgtctccaaaaaccaaaaccaaaccaaaccaaaaacaaaacaaaaaaagaaagtaagacggggcaactctattgacacattctcggggagataatgtgtttgggcagtagaaaatggcaaagcagccttccaaataggtggctggccctcggttaggatcacttctagttagttcttgccctgctggctaggtagcaggaatccaaagaggctgggagttcttgaccttggagaggtgagggaaaaggcagcagtagtggccaggagaaagatgtaagggtgtggtaaatttggtgaaggtggagcaaggcttggactgacagagagaattgacagaaggatggatgccctctgggaagaataaagggagcgaatgctttcatgttggtatgctttcttatatattttccctccctgctggaagagactctgcctgggacagccagtgcagggtgcattagcaagcacctcggtgaccccagacatgtaaactcctgctagggtttagtttgctcggggcacttgtttgcctggtccctctttgtctaagcccagtcaggaattccagtttttattgggaagatcacacttgggtagagcccaggctgggtggggcagagctgtgctttgaggaaggctggcagcttcctaaaaggcccaaatgctgccccaaccctaacacaggcctcaggagcaaccagtggcccttagaaatgccaccctggtttcctcaaggattcactgttcagacaactagccaggcagggtcagggaatcaaatgtgccaacctctgggctgagtccaccgctacagctaggaaggccctttgttaggccctaatgttctaggaatcagatgaagagtgtaaatgcaagtgtgtttgcttaggagtctcttgggacactctggatctggtctagaggggggggtctccccaaattaggcgttggttggccaccatcagaggaacttggtcagtgttgatggccaatgggattctctctctctctctctctctctctctctctctctctctctctctctctctctcccctccctccctccctccctccctccctctccccagagttggtcttcctgctgagccctaggtggtaggtctgggaaaatccaaataagctggcacaggaagtcctgtccacctccatggtagcccaacagagcttatccctgggcacttggcctaaggatggacctccttaacagatccccaacatgtccctcaagaggggacatgtatattttgtggggtagcagtttttatgcccttcccggatatttctgaaggttcccattccgggctgactgacgctcaattccgtgtgtcctcaatccgtatccgtgtggtatggccccatttattttttttcagggagcaagtatcactagccagcacccacacaggctgggctccccatgattagacaaatggagaagtccactccgagaagatcctgacagcataaaatataatttgtgatctaaaagacagtttccagtataatctcattatgcaccacagactcccggtgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactattgggggggagggaggtgagtcaggttaggttgctaggggcagaacaggtaagaggctagctgagcttggggggcaatttacaactttcccggatagctttgccttgatttcaaaatgtgggaaaggggtcgagtttaggagaaagttataaaaaggtacagttgcagtgaaggccctgggtcttttaatgccaacggtaactataagggagaggggaggtttatagggttacgggggtcttcctgcacccttctcggcactcccaacccgaatttctattgttttgattctacggggccttcgctatggtgccagggacatcaaaatctaaagagagaaaggaagcgtggaggtggggggaacccttctctgttcccgccttgctccttcccctcccccctctacagcgagagaccttgtggtggaggtgaaggtgttagaggctaagtatcccctccaccttggagaggcctggtgggtccccacggatgggactgtgggcagttgtctcatcacgatggaagctaaggtcacaggctcagctggatggcaattgcctgggaagccgcagactccaggtggccgatgtcgaagtagaggaggatgggtggattggactggagtgggagagagtgtctgttggagcttcgggcctgcctagtgccagggtcagggggtcgctgctagaaattctggcatgctaggccagttccaagccaggccaggcaggagctggaaactcatctggctagccaaggctggaaagttttaaaaagagaaagaaagccacttgctggaggtctggctgggagccaggtcagctgtacagcatggccactcggagtgggggtggggtgaacggagggagtgtgcgctccttctgtccacctggaccctctccctcgtgatggctctgccaggtctatttcagaggtcctggttgagctgcagaggctggcaggggtgaccagatgtgtggtgcctgatccaggcctcactaggcaaaggtgaagattagtaaatctttgatttgagagctcctaaaggaaatgaaagcctgggctaggcctagagatgaggaggaagtggggagaggatctttaggccatatcctggttggggaaaggaaagtcttccagcttgcctcggtggttggcttttggtagggatgttggggtgcccaaaggggcctgatttagaagtcactttgctgatcttccatctggtccctagggtttctcttccatctggtccctagggtttcctcttggagcgttaggagatgtagacagatgtaggattcccttccagaggccctttgcttgatctagataatggattgcatgatgtgacaagtctagggtggccatctcaatcataggaccagtccagaagtcagcatttcccctgagaacagagagtccaggccacctactacttactgatgtttggccctccaagcagggcatctcattgtgagagatttgtagtatgtagtgggagattgtgaaatctccatttcagtgaccttagagattgcagtgatgtttaggggaaagtgggctctggcttcctactggatgaattacctaagtttcatgtgctggctcttgcagttgacacacaaagccttaagatgtcttctgcacttacctgaggtgaagacaatatgtgaaagtggggatttcaagtgacacaattaggccaataattggctcctctcctgcaactccaggactgagtttgaccatggcccatttttactagctgtgtgaccttgggggcaagttatttatggcctctgagcctctgtatgtttcttcatttgtatgactgggaataattatctacctttaggatcaaagacactgtttggcacatagtaggcccagagggttaataattgccctgaatgactggtcatgtttctataagttgctccttagctctgcagtgtcccagggaccaaggatgcatgcaggttagctgccccctccagggacattcctctggttgggcctataggggctcctctctttgtttagagttctttgccttatgcctttaagggattccatatgcaacgacttggatccccccccccccttaagtgggatcattatataggtcagaattgattccagaactggtatctaggtgccatttggcacgttttccagtcattatttcagaggaggggacagggctgctggagaggacctagctggaagaggtgcaggaatggctgctacagcagccagaggtgctgtggcgtgatagggattaggtccggatgttatgaaggctcactgtggttttcaataaagtcagccagagactgcttcttttatatcgatatgtatttaaaagaaattactagcacgagaagaaaaccagacctgtatggatccaggccggtagtaagctactgtgatcaggttccctcttcgactcccagaggggaagtcagcttttgattgaagctacacttggttcttgactctcaggggatgcctgctctgaaacaggagctcccccccttctttccctaaaagcctttgtgctgaaagagcttcagtaggcatgaatctctggtccctctgaagaaagccttgcggcctttgctgacgttggtttgtgaacagtggagcagtggattttaccaggccagcacccccccccacacctccaccccaccccctgatttagctcactagttagaggtagtatatgggcagggtgctcctgactggtggtggctgcagcgtggagcccagctgcctggaatctgaaggctctgtaacctttgaagggggccccctcatgagggggcagaggtgcggagctcgaggacccagggttgttttggagggtctgtttgttttctccagtctccgagaggctgagggtggagacggacggacgggcaagagtgtgttccagctttgagtctgatttaaaaaaaaaaaaaaacaaacttgatttaattggagaaactcctaggcatttcacagttctgtacaaatgcaaacttgaaatagcttgagacctacgtcatttttaggaaaggataaatgaagtacaaaagtgttcaaactatgtaaatccttggagttgtctgccctcccataaacacatgacaagtgccaaggcatttccagtcaaaacatccatggacccagcagtctccttcctttgtatttattattttattaacagcattttacacagcatttaacaagcccagactgcccgctttccacagtgcctgggtggaagatgggtgggggtgggggaaagtggtctacaaacccactagagatctcccgatggacaggcagtctatctctactggccagcaaggagccaaaagtagtactgaggagagagctcccttcctatcctaggagtgtttttgggcttctagaatgtgtctgctcccatagtctacgtggaaggtaaatcagggtctactcctggctactctgccccttggttattagtgatcttcaaagaatgagtatttgtctgtcgttattctatatcctggtggaaagtttctaacgaaaagtaatgcctttcttaagtcataaaatgagccttgtatgattatttaattaaaatctatttaaggaccgattaggcgtgtaatttgcgctaataatgacgattatggaaatgttcaacttaaccaaaaagcataaaggagacattttgatcagtggggcgaccagtaagtattcaatgagttgggcaatttctgaaagaccagaggcggacctctgtggccctgcacagaactgcagacatgtccagcctctgtgacaacctcggggggctgcaggcctctctatcacagccccagcctacccactttgtccagtggccaagtagcgtgagcagccatctcttcccatccagcgcctccagactctaccagaggcacaaactctgggagagggctgataaaccacagcgaaatcactgcgaaatggcggtgctcttgggcttaacaaactgcaccgagaaacgcacgcttccttggctggccttggatagagcccggaggggtggggtgtgggggggagccagggtcccttgttccggagaaagctgccagctgctggtcttggtgcgaaggcgaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagccgcgctgcgcctcctcagcactcacacaaagcgcgcactatgcaggcaggccccgtggaggagctgcagaggtggccaccactttgtggctggcgctttcggatgagagaaagctgggtcacatcccgtcaccagtcacatccccagcatgcaccttaaggactgcccaaagggtggggtaggggtgtgggagggtttatatgttgtggttgagggatcttgttagaccgaggtgtcaggagaaggcctggggaaggtgggggtggggcccggagtgtcactgtctagaggggtttggccaagatccatgaacctgggtcctcagctgcttgcggcagagtttgcaagattcgggaaaacaaccagcagccccaaataaagcttgtcgggaagaattaagtgaaggccttctggggatcccgcaggctctgaaggctgttcttcctttgcaatggctctattcagataagttagagagaggcgcggctgtgttctggccactgttcttcagggtggaaatgcaagtgtgtgggttcaggatccaaaggcgtttgcattttccgggaaaggggtgcaggttgacttggagccacacggtctcataagctccccctggcagagcacaccggccttcagctacagcctccaaaggcctggtagaagaggcaccacccgctgggcactagggtgctgtgataggagagcaggagaaaggtgatggtgaggaccagcactctgtccaatcctggtgatgcatcgcataggatgcatagatatagtctagaacttgggtcagtctcttgggtggcctggggcaagctgggaggaaagggtcaccccaactcctcaggagtcccgaggtcgaaaggagccttcccaggatatagaaaggctgttcccgggctatggaaaaccttttcaggctgacttaattctacagcctccttctgggttactttggcccttgtgtggccagccgacaggctgtctgagtctagaaactccccaccccccaggtaggacttctttctacatattcccctcggggagctgggagatgcttctggagtgatacatgaacttcggtgccagttctataaattggtctctttttatgacgtgtgccattttctgtaggaatgttgcttgcaaaacgagtttcgccttggaggaaaggcggaaagataaacaagcctgtaacgccaaaacactggcagtctttccttccttccagctcccttaaagcagccgggctgtatttccaggattagactcatgcttgtaaggagggactctgttggctttttttccccccaagcaaatgcaaattagagaaaaataattttctttcaacgatatgcaatgtattagtcacttggtatcgtgctctcaggcaggcctcatttgcgcgtctgccagctcgctcacatctgcttggcgctgttggggcattttaaccttggcggtgtcgtgtctagtcccatggatcaagaaagagtaattaagctctgaacagccacaaaaattcgtgggtccccatctatatggctttgttttggggtgctttgagttccaaggctgagtagcagacctggaattcttattgttccttgtaaagaccatgaatctggctctcctgcccatcccagccccccagccttcccaggacgtccaggctctgcacagtctacaagaagcgtgcatgcagatttcaggacccttgcatgttgcgccttacttccttaaaaagtttctttgtgtttcctaaggatagccttttgtataacttgttactttctgtagcaaatgtgtttagtttatacaaagccttagtggaaactaagtactccactacttagccgagtactactacggccttgattgacatgggccatttatttaggattcctctctaggttgtgtggattccccagtgggggacagaactctgttaggctggatcaagtgttaggtgggggcggggcggggcggggcggggtggtggtggagggggatgggatgtgaaaaggagtgctggctttcttcctaagttctgggtgctggtgctgggtccacctccttttcaaggacctcttgcttccaaattcaccccagtgcgctttggatgcagatatagttcactgactagtttatctggcgcagcctgaggtaatcggaaagaacaaaaggcagggaagggagtctctggccattcctgtagaagggagggggaaatagccatccctgtccttgggttgggagcggtggtaaatctgatccccatagctgggattctgcctcgggtagaggatggatgcccagcaacccacttttagtagactcttggggtctgccctacccagggctccgtgcctgtcctattttacagtataccaccacactcagctctcagcttaggggagagtccagaggtacagtctgaccgaaggaagctcaaagtgaaggtagggtttgcagtcctaactctaccggtaagctcgggagcatgtcccttgagggctcaaattccgcctgaacccactcaaaagtttatttttgtttgaaatttgatgatgaagaccaaaggagtagtgaaggctcccgcagcggaactctggaagttcccgtgagaacgcagggttccaggggttaactagggtctttggggagggtggctgcccaaggggagaactggcagtttctggaaggcctgagggggtttctggccaggtctgctacctctccctgctgggaccttggcagggagctgtaaggaggggcagaaggggctagtgagctctgagcagggagcgagtgctgggaaagacaatccctttgttgcagactcctcacatcaggctctgcagaggcatggagagggggccgcccctcctcctttctccctccgctgccactgagggtcaagtttattccctatcccgatggctctctgccgtgaccctggagcttcaggaagaaactagaaaggttctgtatgctgggaaggtcaggtctgtgtgagcatggccatcgtccgtctcctccgcgcctgctccctgactttagtcttttactaatgtaaaatttggggttgtgggtggcgacacccacagagccagtggttgtggtttggagtgtgcacctgggcagcctggctcacacacctctaaccccacacctcagatagatgctaaatggctcaggacctgggagcaatttgagggtcccttgctcatctgggaaagcagcccaggaggacccgccctgcattgcatatccgggaaagcattttcttttcatttcccacccccacataggccctccccccaacattctaaaataggaacgtctttcccctcccttccttgacacccagagcgtggtgctgctgtgactcagtctgcttttggagcaaccccaggaagggctggcgctagctttgggcttgggtgaaatccacatcagttgtgttttccccctcctggtctggcccctctgtatctccctcgtcagctccccacccatgatagataggagaccgcatcaccattctgaacagcgtgtttagtggagtcagatgctgttggatggggttaacgggctccagcgattgccaggcaaaactcaagtccagagtgcagccaaagtctctagaaaacacagggccaaatatttacagagggggaccaaggttggagagattcagccacctgcccagggacacagggtgggtgagggtgagagccaaagagaatggacactgactgggaccaggctacccatgtgccacctaagcttcctattgtgggtgcagtgctacagatggacctgttcaatctttggctgctgcccacataactgcccgtagggtggtggccagaagggcctagggaaagaacttaatcccaaagaagggactgccagtgtttgagaggtttcatctcttcctagtctctggaagcaatatttttcctattgtgggtgcaggggtcaccggtggcagtggaagatgatctgccactatggggtggcagtggggacaacagacagttgagcctagtgttgctactgccttcactgcctcctccccgttgtctgcagggggagatcttaaatgtccttaaagaagaaacaagtaagtgggctgcggtggcatatgactttaagcccagcagagacacatccatctcttgagttccaggctagccacgacagaaagaccttgccttttagaaaaggaaagagtatgctcttctgcatctctatgtgctgtcttggcagggatcgactaaacggtgttagtaggtacaccttgggggtcacctgatgtcttttcagaacatgaagcaattgggctcctttttagagatgcctgggttggagggacagcacctaatcttggtcctgctcaaaccaagcatgggtactctagccactctttggctcaggagcaaatgattgttcaccaagtctgttcaggtgagtcctccggctctccgttaaacacagtaagttctaaggactgcagccacataccaatgcatgcttgccacatagaggttcccccagacctcggttccagcaggcagatactgcacttagcaatcgacctgttccgtaagactcagacagccatccctgcctggctcacctctgagccaccttttctttgcgtttcctttcttatccttggttttctctccatggctggcagaaagggttaaaatccagagcaaggttaaagctagcaccttgccctcagaacaggccggtgcttgcttgtaaagtgctttctcatgagtgatgtcccacattttggcacttctagaggcaaacatagcctgcatgtggaagaaggggcaaagaatgagcctcttccttatatatagcagccaagtgccttgaggcactccgtattccagccaccatttcccacagccaagggtcagcaaagtcacctctttgctttagaggtagagaaaaagtcccggctacttcactaggactttctagaaactggaagggctgagatgttcttctcttctgctgcttggtctctctttgttttttcacccagaggtttgggggtgggtactccctgctcctccatggttgagtggcaacaggacatttctcctgagtgtatttctgctgggctcttggacttcccttgtttgtcaccctagagaagggccggcctcctgcctagcaaggcccacagtcatcgaccctttctattttgatcacttgctctttagccaggcacctgaagagttaaaagtccttagcttgttgcaatgaaattatggctggcggtggcgccactgttcgttcaacagacctccacttttaagcagttcaaaaaaagttcacagggcagctaaagattttaagtgtgggttcacgagcgtgcacaagcactcgtgcacaagtgtgtgcagtccacagtgcaactcctggcttagcctactctccgaaaccatacacacaggagaatgaactgcactccaggccttaactctcagtctgtccctgtgtctgtgacacttcattctgatggctagtgttatttatctgtgacaatgctattgaaaaaaatgatgagtggaccccagagaggggttaaagtttcagttctccatgccgtcccaggtccctcacagtcccggtggcattttctgggcggggggtggggggaaggactgaagataccactgggctttcatggggaagaggtcaggccttccctaagctgattctgattgtccttgagggtccctgatgtactcttcccaaggtggccaactatgtaggaggtggctgggtttcaagactgaggaactggggccatggagatttgacttttctcaggcccgttcttctgaccctttttcctggggggattaattgtggagccctgctgtccccagtaggatttctatacttccccagggctctatgagggtgtgatctggtccctcctgcggcttgctgtccaggacccctgtgccaaggaacagcgctctacttgctcagtctgcctgcaatgtcttccctttgttgtgagagtgggcaggagatgcccactcaggaaagggacacttgatgaagtgggtcttgaatctttccagtcccggtgacttgacattccttgcttattttgtacatcaaaaaggggggagggacacagtgaacagctcccacacagtcttccccggtaccccagtctgtcgctccatgcaccgtggctaggccatttggagtttccctgtctgaagaaagagagacccttcccaggaaaccagcttcaccaaagtccattcccatgatgccttcaggaattccagcctcttcagggccctcccctccctgcttcattgttgagctctaactgtgcgtggtgtgttggtgcgtgttgttctatggttgggggccggtgggggttgctggtggacaaaaggcctacttaggacaaagaaaggagcatagctgagcttctggattcaggcctcccaagcctttcccacccccaccccagtccctggcagaagagtccctggacggggtgcctccacccaaccgacctggcagtctgcttctcgtgtgctaaagtgtaaaagcaagcatttgcatattttctcctgctaacaaaggaaatgtgtcgacttaagggaacatttgggctttcggaaactgtgtgggtgggtgtgtgagggaggagaaagaaaagttcccctgatgatctatctgcacaccaattatttcacactcggatttgggtcccgtggaaaaatgccgtggcctgtcctggagaagggaaactgagatgtgtttgtgagcagggaattgcccagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcggcgtgataatcctgttaataaactgcagcttgtcctgacccttcactcatgcagcaaactagaatgtgctgtgggtaggggcggtgggctgagaaggtaagtgggggaggtggtctgggccccttcgcaccctcccttccgcagcctccccctcccacgaggtggaaaatgggtggcttttgcctgttccctgtgtgccagcagctcggagcccatcagcgtcagccctggctgcagagacttatgcgctaatgatttcttgtccccagcgagcaggcagtcattgaattactcagccgcctccccctgcagctcccaggcaaaaccacccctgttaggtgcttaatctaatccagggctccagtagagaggttcaccagcccactggtctctctctttcaccctccagctttcgggttgggcacaggacagcttggaaattcagccgtcccaaacctgctgtcgccaccacctcactgtttctgcctctaccaccccaagagagatgaatgtgccagtgatctagcaacctgtgtctttctggtccctcctcaaatatggcttctttctctggcaaaagggtgggcaggcccagacctgtgactaggatgggtgtcttcctgtttgttagcttgagtctggtctcctccgtcgccgtgggacaggtgtgttcttggttcatggacattggtggacagcgtcaggcacaggctacgtcgtgtatgaattaccttgaaagaggctttgctttctcagtgcctctctcctttacctaacctcacggggccctcccccctttctttttttaaacagactagacgcttgaagccaagctgccatccaaggggcgacatgctttctgcaacccctctgtatgggaacgttcacagctggatgaacagcgagagggtccgcatgtgtggaacaagtgaagacaggtgaatagtctccagggccaggcctggtgagggagaacgggcgggtcttctcctccacactcctgagcagagcccatgcatacccaagcccccctcatctcctcacagccagagaggggcccaaaaggtctggacaagagagatctcctagctggtggcccttgatttacagttttaacaggcagcctggttcagcgaagcattgccgccctttaaaagattagcccctaaagcggcctttcagtgcgctttcgtccttaatttattatttcatatttatgaaggagaattaatccccatctatatgctgctttaactctaaatgtcaggagtgtgggcccaggtggatcggcattcaatgtgcttttaaaacaaatagtttgcttagtaataaatgaggaggtggctaccctttccttgggtccaacccaaggtttcaggttgccctatgctgcccttctgtgttgttattggccaggattctgatcactggacagcccagttaggctttcttctaatccatgatgttggactggggccgagacaactgaacaggaggtgatggaagcagctttggggtactggtgaatctctgcctctgctgctcatcagtgctgttatcctgaggatttggaagttggcgtggaacactttctttatcaatgctctctgataacaagtcccaggacagccaacagcagcctggcacagatgtgcggcttcctctcctgcctgaagtagctgacatgtctctgatactattgtacatccccacacagctccacattgttttgataaaggctgcaaatataacttcaccatcaccatggaaactagatgggtccctaactttgtttgggggaaagaaagttttgaaagcctaccctcagggttaatgcagatgtggataaatgaaggggctagcctgtagacttctagcctgcttggtccatggccattttatttaatttctgccctccagaacagctcgtaagggttagctaagacagcacttggcctctgtagaaaaggtcacgtgagagaagtgtgcttaatttctggcttgcccacctctgggacatatgtgttattcatgtccccacacatgaaaggcctgcctttgctttgttctgccagggtaatattgaatcaccatttgggagcaactttcactataggtcatggcagggagggttaagacagttcaaaaaaaatgaatgagattagtagaaactggtctggtccggggagatagatgaaagatatattcagcaagaaatgttttcatgaaattggtgtgtctttttaaataggaaaattcctgtgaatgatggcgacgcttcaaaagccaggctggagctgagggaggagactcccctgagtcacagcgtggtaagggatggatggtctctcttgatagggtggctctcagtgatttgtaatcaactatgcattagtttgtgtgtaattagggagtgtgtgtgtgagtgtctgtctgtgtgtgtgtgtgtgtgtgtatttgcttgcgcgcacgtgctcactcatgcacacaatgtgaggagggggaggcatcagggcctggctatgtattgtttttaatatactctgccctcacaagccctcgttccttggtcacgtggaagcatgggtcttctataaccatctatcccgttaatgctccaagctgtataattctctagcctccaagtagttcctagggctttgctttgccagtaaaatatgaaacactggactgtcctttaaggcaccagggaaaggaagtcaaaaatgcaaccatactttgaccacgccccctccaagcccctttattgatttagaactaagacaagctagaaagttcctcatatccattgtccggaggaaaactgtttcttgtcctgttcaataagacctttctgtgtccaagaaatgaatgcccctctccccagtccaacctgacaggttccacagagtcagtgtgtgtcctgtaccccggaggagtggtgcagagaatgtcttatttggtgttgtctgtgccacagcatggtagggtttgctcacagatgagcaaactaatgacttggtttctagtctgagtggatctttcagtgcttgtaggatctcagttgaacagaaatgacaaaaaatgaggcttcaaaaggatttgcatgtgggaggaggcggggcactgggcacagcaaagctatctttagccttttctgttggggtgttaagggtgatgtcatgtgacccagtgggtggtctttcttctggaccagggctgctactgtgacaggtgtcccaagtaacttgtgttattcttttacaaaggtggataccagtggagcccatcggatcgatggcctggcagcactgagcatggaccgcacaggcctcatccgggaagggctccgggtccctggaaacatcgtttattctggcttgtgtggattgggctcagaaaaaggtcgggaggctaccccaagctctctcagtggccttgggttttcttcggaaagaaatccagagatgcaattcaaaccgaatactcccgagacagtggaggcttctgctgtctctggaaaacccccaaatggcttcagtgctatatacaaaacaccgcctgggatacaaaagagcgctgtagctacagcggaaagcttgggtttggataggcctgccagtgacaaacagagccctctcaacatcaatggtgctagttacctgcggctgccctgggtcaacccttacatggagggggccactccagccatataccctttcctcgactcgccaaataagtattcactgaatatgtacaaggccttgctacctcagcagtcctacggcttggcccagccactgtattctcctgtctgcaccagtggggaacgcttcctctacctgccacccccacactatgtcaaccctcacatcccctcctccttggcttcacccatgaggctctccacaccttcagcctctgcggccattccacctctcgtccactgctcagacaaaagcctcccatggaagatgggcgtcaaccctgggaacccagtagattcccacagttacccccacatccaaaacagtaaacagccccgggtgacctctgccaaggcagtcaatagtggcctgccaggggacacagctctcctgttgcctccttcacctcggccctcagcccgggtccaccttccaactcagcccgctgcagagacctactccgagttccacaagcactatcccaggatctccacctctccctcagtcaccctgacgaagccatacatgacagccaatagcgagttctctacatccaggctgtccaatggcaagtaccccaaggctctagatgggggcgactgtgctcaatccatgcctgggcacacccggaagacaacggttcaagacagaaaagatgggggctcaccacctctgttggaaaagcagaccgttaccaaagatgtcacagacaaaccacttgacctgtcttctaaagtggtggatgcggacgcttccaaaggtgaccacatgaaaaagatggctcccacagtcctggttcacagtcgggctgcaagtggcttagtgctctctggaagtgagattccgaaagaaacactatctcctccaggaaatggatgttctatctatagatcagagatcatcagcactgctccctcatcctgggtggtgccagggccaagtcctaatgaagagaacaatggcaaaagtctgtcactgaaaaacaaggctttggactgggcaataccgcaacagcggagttcctcgtgtccccgcatgggtggcacagatgccgtggtcactaatgtttcagggtccgtgtccagctcaggacgcccagcctctgcatcaccagcccccaacgccaacgccaatgcagatggcaccaagaccagcaggagctcggtggataccacgccatcagtcatccagcatgtgggccagccctcatccacgcctgccaagcacggtggcagcaccagcagcaagggagccaaagccaacccagaaccgagcttcaaagcgagtgagaatggcctcccgccaacctcaatatttctatctccaaatgaagcattcaggtccccagcaattccctaccctaggagttacctcccttacgcagcaccagaaggcatcgctctaagtcccctctctttacatggcaaaggacctgtgtatcctcacccagttttgttacccaatggcagtctgtttcctgggcaccttgccccaaagcctggcctgccttacgggctgcatacgagcaggccagaatttgtgacctaccaagatgccctgggcctgggcatggtccatcccatgttgatcccacacacgcccattgagatcacaaaagaggagaagccggagagacgctcccgctcccatgagagagcccgttatgaggacccaaccctccgtagccggttttctgagatgttggaagctagcagcaccaaactgcatccagaagtccccactgacaagaacctgaagccaaactctagctggaatcaagggaagactggggtcaaaagcgacaaactggtctacgtagaccttctccgagaagaagcagacactaaaactgatgcaggggcacccaaagcaggccttgtagccgagaatgtaggtcaggacaccgaggccaccaagccctcagctgaccctgtgatccaacaacgccgtgaattcatctccctcagagaggagctgggccgaatcactgacttccatgaatctttcactttcaaacaggcctcaagccagccagtgttcagcttaggcaaggatagtggtgcagcaggaaccaacaaagagaacctgggtgtgcaggtagcaactccattcttggagacagctctgggcagtgagggccctgctgtgacttttggtaaaacccaagaggatcccaaaccattttgtgtgggcggtgcccctccaaacatggatgtcacccccgcctataccaaagaaggaactgatgaggccgaatccaacgatggcaaagttctgaaacccaagccatccaagctggcaaagagaattgctaactcggcaggttatgtgggcgaccgattcaagtgtgtcaccaccgaactgtatgcagattccagtcagctcagccgagagcagcgggcattgcaggtgagccccccaacccgaatttcactaactttatcagttgtcagtttttgtaatgtacaaaggggatttgggggaacgtggtaggccagagcaccaggcagatttggttaatgacacttatgataattggaatgtatgaaatgtgttcaataaggggacggcagtagtagcttttaggaggttcatgtgtcagatactttaagctattctgtagactatatgagaactctactggaatgctgataacaagttgtaattattatgaaggatgtctaaagactgcatgacgtttacctagcaattgctttgatgtctctgcctgtaagataacaaatataactagaagcattgcttagaataccttacttgatacttggtggagatgtgtagcagtcgcatgtctgtgggaatcgtgcaatttttttcaccaaaaagaaagaacattcgtttaaagggatagagtatgtatttgatttgctagtgaattatgatagatgttgtataggaatttccttaagatattttacttttaattaaaagatgaataaagccaaattgttttgcaattgttaagaaaaaaattggtttatgctgataaaaatggatgaagttatctaaatgatccattgagtgcccattttaattacatagatggaaggattacaagaggacagtattttatgtctacccgctgcttactgtgaggtcagttcttcaaatttttattactagaatcttccataaaccttttgagttaaatttcatttccaaatatacaaagggaagtttgtgggccatggtcgtctttgttcattgtacattttgtttcttttctgttgtgttttccttttgtttttctttgcactgtggctttattttattttatttataaccttcaaaagagaatgtctgtctctatgcaatcgtgtatgtatggctatacatacacattgcgtctatatctctatacacacgactttatggataaagaatgtgtgactactcacatatagacactcttaaattttatctgttaaactttaaaatatctgagttgtatctcataaattgtggttggctttgggcaagcttttctctgaaaacactttcctttatagtataaggcacatgaaatagcctttatggtaagatgttgtgtttttttttccatcttcgttttctttctagcgtgcaatgatgcgcttctcagagttggagatgaaagagagagaaggtagccacccagcaaccaaagactccgaggtgtgcaaattcagcccagccgactgggaaaggttgaaaggaaatcaggaaaagaagccaaagtcagtcaccctggaagaggccattgccgaccagaatgacagtgagagatgtaagtaacccgagcagctgggctgtagcatcacattggtgagagcagagccaccctgcttccaaggcctgagatggtgagaggaagagggatttgtggataatggctcaaggtccagttggggactgctctgagaaagaggctgctgtgtggcccttactgtagtgatgtctgcttacatgcagctgggaatctggtgtctatgagatttttttctaggacttggtcttcatttgcaaaggaacaccaggctcaaagtgaatgacagcccaatacaatgtagcagtagaaagcaggtggtaaggatcagttctttttttttttcttttgaagcagctagaatgatactctttagccttgcacctctcccacatggcagtctacgctggaatgggaaaagtacttaggtttttttctatctaggtttttttgaggtgggatgaaggttggtcaaagcaccagaaagatggcaacaggtattagctgagtttgttgtcattggaagttatcaatagaacccaagaatggggtatgggaccagcctacaagacagatagatggtggtttatggtctcgggtaaatgtgggaaaaggtaagcaagcgccttttgggggatctttcagtctaaacgatgggttccctgttgggctgggcttttggagagttttaagggtgtttgctgtgacacttcgtgaaggtctttaggttcctcgaatgtctatgcttaaggtttgaggcctgctctggccttcagaaaccttgctagggaaggcgaattaggatgtcaggggaaacatggaggagagttgttgcagaagcctcctagacaagccagtcagtggcattgggtgcttgagagccctctattgttgcccttgaaggtgtaacacacctggcacagttcttggtgcgccgtctttccttcactacctccagttcatctttaaggtccagaaaacgctctggctggcctgcagcaacagtcagacccaagaagatttgctgtgagctagtcctaaagaaaaaggtagtttttatagcaagcaagtgacgcccttgcccaagggactcaaacggtctctgtcaaaagatgtgtacgtgactgctcttgggccaagtggcaaaggtactccgagtgagcacagagcaatagaatcgccagtgctttgtgaggtgcttggcgaggaaggcagctgcgaagtaggcaaggtgtttccagaagggaggagctagctgcaagtgggagtcccctttgttctgagtgaacgctgagagatgccataagagggtgagaggttggatggcttccagcctttggcctttttttttttttttttttaaagttttcaagtaatggagccaggccccaagtggccactgccctcagataagaatctgtgaggcctcccacctacctgcctgggaggtccacctcctccccacttgttctgcttttggagtggcttgaggggcccctccaaggctcagacagtgggctatttggggggtaccagaacagggctcccgccacttgtaagagccagaaattaccatcaagtgctttggaggttatgtgtaaaaggcttgcttttcaagaaggaaaaatgttactatccccatacttgcctgcctttacaactcatagatgtgacgggagaggggcttggtgggggggaaatcacggctacaagagccaagcttaggagaactagggtagggatttggagtagaggggacaggattctaaactctacctatttctttatgttgttgttgttgtttggttttgggggggttgtttgttttggggtttttttttgtttttgtttttttgttttttgttttggtgggaatggagtaacacaaatcttaccaggtagctcaggctggccttagtcctcctgccacacccttttggatgctggggttataggcatgtactgtctctgctcccttccccttctgagggagcccctctgctctgagatggtgggggcatcttgttgggagggggcatggtcaggattttcatttgccctctttggctgaatgatggtagaagttgcttgaatgagttcagtgcttcccttcacacctgacagtgcatgggaaggacttcgccaggacattttagagatgtggaagggcaaggaagcattaacttggtctttgctgaacatgagctactttaccagtctcttgggtggggtagacctggaacctgctaaaggagagtctgagcaggaactggagggaacttgagtcaaggggctttgtgggaatgtctcatctggggagtttttcccccaggacagcaccagcatcccttatgaactagagagatgccttggcactgatcacctactctgctcagctgtgggtgacagagctagctacctgcagaggggaatgacatctaggatgaccctcagaagtcttgtttagggctcactgggcatggctgccacagtgatgaagttgctttgttgccatggtgatttgtaaatgttgccatggcgatgcttctacaaggtatagtatggcagcacagtcatgataaattatgggatatatgtgctgcaagtcatatgaccatgctatagggagcagatgtcaaacagccacacccacatccgcctacatggcttgacctagaggccaacagtaagagtagtggtaggtagtagagcctggtggttagggcctctgttgcttgttctcttttagcctatcttttttttgctctaagggtaatcttgctggtagtggttggactggccccatttgcagaggtccaagtgaaaaagtatttgggaatgatgcggagcatcctatcgctgatggcagtaggggtatgtttgcttcaagattgttattagttcctggaagaccaccctagtgcaggcctttgggggcttctctgaagggaatgagaatcgttgccctaagaggcttggagaaaggatgcacagaggtttctaagggtttgaagaatggaggagaagctggctatgttgatggtgtgtggactaatgtgaatctcagatttattagtgagactgcttgatggtaattgggatgtagagagaacaataggccctgctgtggagtttcctcaggatgaggtagagagggacttgccatacagcaattcacagtccccgagggtcaggaatacagtggccagatggatgcggaatgatgagttgaaggagccagcctccctgtcaaggaggcgtggatggtaacggggtggcgggggcacccactgtgtgcaggtttgctcaaatgggaaaatcccagaaagggatgagctagccaagcctttagggatgctcttgtcatgtaaggaactgaggcaggcccctctcagctgatgccagcccatgcagcagtcttccgggtggttttaccagggcactttgtgcataaggtcaactgatttgagataagcttcattccactgttgtgagttgacagtgaggctgaaagtgtttcgctctccaagaaagatagcttagacagtgatgcaggcgcctcctcgaaatccggagttcaactgttaagactaggaagtgaatgtaaaatactcagggcagagagagtcttagcgattgattggcgggggaggggggtgatgatggaacaggataagacagggcagtgggatctgggagcggccccccactgaacatgctgctgtctgatagtgattgattccacctataggcagttatgacattacccagttacctccccttcacatcacctacaaaagggagaggtgaacgaggtacacattaagattctggggtaaatttgagctggtttaaggatcctgcataaataatttctctggcccttcccttttccctgagcagccagggttgaggaaggaagaggagaggcagctggtcatcatgttcccactttatagcccagcgcggccaagttgtaaagtggtgtactgttagtggcagagcagttaagagggtcacagagtggctagcacaagtgataccccggccatgctgagtgcagtggtctttgacagtctgcatgccttcactggttgccgtcaagccttagggctggacactgacattgccgaagacccacttggaccatgtccttgagttataaagtactcagagaactgcagtgacatggcatacaagggatccagccgctggctgttctgtctctgccaccatgaggagggggagcggttggggacatgtagccattccttagctcagattggatccagtcccacgttccctaaggtgctgctcacccgcacctgacagccactcaatgctggattgcccttgagagaagtcgatgatgcatgagcagagctggtcggaagtaggggtggaatttcaaatgtattgagctcatcctatgaggtgaacgtttatttcaccggcaaaatgactcctgcggtgctaccaaaatgccagacccacatcctcaggagaccgccacccccggggaacctgtggggtcatgttagtgatctatgggcaagcactgagccttatggtggttgctacatagtgggttttgttgttgttgtttaggggatttattttctctgtgtgaacacatgtgtcacaatatgtatgtgtaggctagacgacaattcttccaccatgtaggtctccaggagtggagcccacttccccggcttacctttacccactgaggcagctcactggttcctgtagtgtttatattttgttggatattgggaaaactgccaccccagagcaagttgtgggctagttcctggttacaacaatttggaagtggtgtagggctatggtggctcagggagagggtaggtgccataggtgtctactggtcctcttgtcccttggtctgctacagagaactgaaggagccctggggagctggagccaacagtttatgcttgcctggctacaaaagtctgtgaaggtggtgaggtcttgtctatagatgtttgcatgacagaaagagcacaggttaggtgacctgagtccccgtggggacccctattttggacattaaatggaagcagcagcttgattcagtgataggtatttctgtgggcagccatcagattgagccctttgaagttgtagcatccttgcccttggctctgcttggtcctcttctcccagcagccctggctctgcagggttctttgccccctcgtgcccatccaggtcctgggcttctttcaacactctcccatccacattcctcagttttcatcatcttttgtctattcaagtaaacatagatgtcgccccttggggatatgacattttggggatatttcatcttttactacaatcctctgtgtctccaaatcatgacctaagagatgcttccccaaagattttttagtttaagcagacttggttgagactaggttggggtagctcagccctttctgagttcccctggctcccaactacaaaaaggttagcaagacaaagtgcgtagcttgctgacttgttttggcatgccctttctctggaaagttctggttatcctgcttccatgttcccaatgggcgaggatctctgtctcccaagacctgtgaggtgttcatcaccatggccttggccaaggctagcctgcctacgccccatagcccgcctccatgtagggagctagatcctgatttctgaatttttttttttttgtctgttctcacaggtgagtatagcactggaaacaaacatgatctctttgaagccccagaggacaaagatcttcctgtggaaaagtatttcttggagaggccacctgtgagtgagccacccagtgaccagggggtggtggacacgccacacagccccaccctccggctagacaggaaacgcaaactgtcaggtgacagcacccacactgagaccgctgtggaagagctagctgaggaccctctgaaagccaagcgaagacggatctccaaaggtgagtgtggtcagctcccactgcctgcttgggaggcctttgcatgcagccgcagagggcgcaattgagtgtgcttgtgtggggtcacagtggggttattgcagcacctctccccctccttccatagacagcttgccactcccacaacgcctcccgaagccctggggaggcggcacccacctcccctccctccaaacccagaggcggccaaagaaaaataaagtgacctgccaagcagagacagtggccacacccttcccctcccccaccccattggtgctatgtaagacaggtttttttcctccccatggggctttttgattaatttgtagttatttctccattagatgactggcctgagagggaaatgacaaacagttcctctaaccacttagaagacccacattgtaatgagctgaccaacctgaaggtgtgcattgaattaacagggctccatcctaaaaagcaacgccacttgctgcaccttagagaacggtgggagcagcaggtgtcggcagccgagagcaaacctggccggcaaagcaggaaggaagtggcccaggctgttcagcctgaggtcacctcccaggggactaacatcactgaagagaagcctggcaggaaaaaggcagaggccaaaggcaacagaggctggtctgaagagtcgctcaaatcctgtgacaatgagcaaggtatgcagagaccacctcttggctactcactgtgcttctagaggataggtcatgcattccatgggaacacggggacttgggccatccaaggttgtggctttttagtgatgtcctcgaacacccccattgcccgtctttccactttcctcctgatttcccagtatatggctgggcaggaagggaaggctgggtggccccacaaccttgccaacgaaccttccaggctcccgctgcctcagtcatcaggatttgtgagcacctgagcccagtgggtgggggagagcaggaagaaccagtttctgtcctcttgtcctggccctttgaagaaagttaccacttggcattttgagggttaacctatttgccatttgaatgtgggataattaaaatattaatgctttgaaaacataattgttatatctttaaaaactgaagccgctccagtgatcagtgctaacaatgggcttttctttctgcatcggctacaactgtgtaacgcctgcttcttctgcccctcccccgcccggcaccgccccctccccctccgtatttaggcttgcctgtgctctcaggctctccgcccatgaagagcctttcatccaccaatgcaagtggcaaaaagcagactcagccaagctgcacgccagcctcaaggctgcctgccaaacagcagaaaattaaagaaagccagaagacagatgtgctgtgcacaggggaagacgaggattgccaggctgcctccccgctgcaaaaatacacagacaacatcgagaagccatccgggaagagactgtgcaaaaccaagcacttgatacctcaggagtccaggaggagcttgcagatcacaggcgactactatgtggagaacactgacactaaggtaccttctgccctgctccccaccttgtgcctgcttcttatgaaggaagctcccatcttcctggactgcactcccttgccaccgctcctgtcttagaggggcatgtgcactgggtggccatgaagtttcaaattagtaagagtgaaaccccaccccacccctcctctgaccgaccatccccccccccccaaaaaaaagacaagtgtctttctctgtgggtttatcacttgaagaggaaagggagaagaagcaatgggggtgttaaagggtcacagtcttacctgtgcatactgcttactctcgtgacagatgactgtgcggagattcagaaaacgacctgagcccagttcggactacgatttgtcaccaccagccaagcaggagccaaagccctttgaccgtctacaacaattgctaccggccacccaggccacccagctgccacgctcaaattctcctcaagagaccacccagtctcgccccatgccgccagaagctcggagacttattgtcaataagaatgctggcgagaccctcctgcagcgggctgcccggctaggctatgaggtgagtgtatacttgtgggtactgggaatccgaagcatccagctgctgctgctgcaggctgggtgcaggagcttcagggagggccttggagagcggagcccagcccctctacatcaggaggtgttccaaggcccagcaggatgtttgtatcatacccactctggctgttggctctttgtttttttggtttttggggtttttgtttgttttgttttgttttgtttttttcgagacagggtttctctgtgcagccctggctgtcctggaactcactttgtagaccaggctgaccttgaactcagaaatcctccgcctgcctctgcctcccaagtattgggattaaaggcatgcgccaccactgttggctctttggtagctaggtctgtcagggtagaaaaaccaaagcaagcctcagatgttctgttcctgttcaggcaggtaagccagccatgccacgcttgctcccttagctctgaaagaaagtctgacataacccaggacttggcaactgaggtaaattgtaatgatttcttttggtttgtgattaaaaggggtgtagagaagctatcagctctatttagggtggcttatgctattgctggtagaaaggtggtcttgaggagtcggaagtgactgtggggatggttggtgtggacccactgctgttggggaagcagccctgactggaatgacatctgagagagggaggcaacctgaggggctctgccccaaactcattgctgccaactggacctgtgccctcagtgttggcccgcctgagtgtgctcccaagcctgcatgatccacagtaatccattttccctctcatcttctttgggcttgcaactgctgttctctgcactttcggttgacaaaagttgcagggggactacagatcttggaaagatactgaccctgaacagtgacggcaaagcccagccctgtcccatcaccaccttccccagctcttcttggttggactcttcgctccaaaggctccagggggacccttcctgcagttcagaaccccctagagctaacctcctatttctgcccctgtatgcccgccacgcccacttaccaattgaaattgtggtgcaataggccacggggcaaaggcctttcttcttctttttttaatgctgacatcagccccctgggagttggatggtcagaatgaaatgcagttcagcaagctgtgtgtggaggtgtgaaggaaaagggtgaataccctggcccacctttggctagggccagcaggatttagccggcaccctgacatcctttcattctgataaccattgtacttcgaggtgggatcgcctagccctacaataaccagtgacggaaatcccagcctgggaattgtagctttgtaggtgggaacttgagggaaggatggtccttgggtgcacttgtgtttctggttgtgtgtgctgttgtttgcattaatacatctgtgttttatatctcaggactagctcagagatagctagaaggaaagattggttatcagctcagttactgtggtttaagtgcaagtggccgttggttgtttaaccgcaagcagagagagagagcatcaccacctaggacaagggtgaggcttcgtgctctgcatcgatttcctttcaaggagcttcaccagtgctccacttgggcttctggcaagctcaccaaaggagccggtgagggaatgagggctccctcaagggcagcgggcttctttgctcatagagaaacaaggcttctttcttagccctttgatctcggcatcatttccaaaggtcttacacctttgcaaagagaaatggcgaggctcaagagacccttgtggcttctctaaggaatagttgttatgcagccggtaggtctgaggtctctgcgaaggagcacttttttaggctctgttcctttgatggcccggggaatatttactgaacttctccatgcaggcacgtggaattttcaatctgtaaatttcaatcccgggtgatttaactgttaatgttaaccatttcactcacccagagtctgcctttcctgggtttcttttggcagaatgtacggtgttggatgataggccattcagatgcggcaatttcaaactttctaaatgaagggcaatttcctggtcctgtagggaactgttggaaacctgcagctatggagttcttccagcagtgaactttactactgttttcctagttggctaaagtacagtaaaaacgaaagtcctctcccccgaccctcattctctttcagctagtgtgtgtctaggggtttacagcaccccatctcttcaggggtgtcttaactagatagaccgctgatcaggcaggcaggcaagggacactgaacattgtttgtctcctaagaaggcttctatttctcttgctaaaataccagcatgcaaccacatgcttgtgcatttagtggtgatggttaaattttctatgaattaaataaatcatgtttttaaaaaagttaatgaggcatttaattaattaacaatgtcgagtttatggcctttatggttacattttgcggttaatggcattcggcttatggcctcttaacagaattgtccaacaaaaacagtttgatttttgtttaggaatgggtgggttgtccttcaaacacccatttctgatgcaaaaaataacaagagagatgtatcaggcggcacacatcttccccattctctgttgggaacagcagttggcatctgtaaagaggccacccttccacctaggagagtggtattagcttgcatgacctcagcagtggggtcggagggatgctgctggtaacagctggattgaagccctctagctggagcttttcattgggcctttcgaggcttcccagcagacctgggaattggtttgagtgatgagtcgaatagttccccttggttgggaatcttaacccctctggaccacagtctcccagagtgttggatgagaacactcccacttttcttcctggagtttcctaggctgtggagagtggtgtggggcaagatctcacgccaagtgacatcagtgtagctgagtgaggataggccatggcaaatacctcacctagtgtgtggccactgctaccttcccagccttcctacggggaaaagagcgaatcgacttggccttctgctctggcttctttcatttctaggttccctcagatctgccctgtagcaagataggcttccaggtgagggccataattgtcagaacaaataaaccctgggttgagagaggacactgggcagaccgccgggatccacataaattgatctttgcacagcagtcagtggcgctcgccgatcccagagtcacgtgatgaggtctcttcctggctggggcacacagctcattagattgcagccgtccactcgagtctggctagcgagggcctgctaaaagagcagcagcttcatacggtatcctggataccggtgctcagggcaggtggcctgggagctcagagcattgtgggctttctggcaggttagaacctgaaggaagaaacaccgagccaggcatgccttttctcttcctccccttgttttagaaaggagccgccgtggtgacctgaagcagcacggcacagatggtcagatttcccagcatgcagctttaggctcacagggaggcatctggaacattctagttaggacctaagtgacccttacctttgactgaactgtcctagaaagggcataagagatttttttcacaacccacctcatgtctatgagtggccagcaggagccatgtctaacagataagtttccccagtgttacctgtgaggtttccctttcactgataggccatgtgttaggccacccccacacttacccccattcttagaagttaggactgatctacttggcatgacttagaggaagatagcgtaacctgtttcctggcgacagatactgttcaatgtgtttgaaaacttgcttaatcatggtaataagacatggaataaattactgccgtgcttactgggagtggttcatattaatattttaacttgctaaagaactgagattaataatagtgatttggatgcagactcttgacactgaccgccttccgcagagggggaggggcgggcttgttctagtttgttctactatgtgatctatctgattcttgtcactgacgtaggtaaataagagtgtatttcattgattcagtcttgagtagaatgagaagtgaggaaaggtgggtcatttgaggtcttagtgtccttggtggtgtgactgaataaagcccagagcatggcctagcaagcaaaggctctcctgctgcactactccccgcctccccagctctctgtatgccttttttcctcacgtgactgtttcttggggggggggttgttttgtttctttgttattaagagtggattttgctttatatcccaggcttgccactaaggctggcatcaaacttaaaagtcatccccctgcctcagtctcttgagtgctgggattacaggtgtatcccacctcacttagcttcatgccactccttggtgatgtctaagatacctggcaagaagccccaactagagccctgcctctcatccagaggcctggctgcccaacctctgcctcccctctgtacacagggctggaatctacctgacccaccctgggttgcggggtgtggtgacaacttttccattttgcttgcctttgatcactctcacttttatctaaacttggctgtttattatctataatggccctgtgaaacataaatgccattgtacaggtgaatgcacccttggatttgttttgttgaggcagggtctcacggtatatcttagaccagtctcagattcttgttggtccggtggcctcagcctcccgagcattagcaattacaggtgggagccaccatgcctagctttgaatgagcccttttgagacctatgcagctgaatctctgcatgctccctcagcactgagccaagtagattggggcctcatagctttgggccacacagagcccttcacactgttctgagcccctcaataaacatccaggcaccacccaaaccaaagtgggttctcaggccccagtgtgcagtcttagaactatgaagaagtcttccttgtgaggtgactgtgtggtgattggatggtatttcctgttccctccccacaggaagtggtcttatattgcctggagaacaaggtctgtgatgtcaatcatcgagacaatgctggctactgtgctctgcatgaagcttgcgccaggggatggctcaacatcgtgcgccacctccttgaatatggcgctgatgtcaactgcagtgcccaggatggaaccaggtcagtggtgtgtctccttgcatcctcatccttcctttagaggaacagacggtagctctaaggggatgcagagaacccctgagagagagagagagagagagagagagagagagagagagagagagagagagaaagggagagatcgcacctgcacaaattccagtctagaagtgaactgaacaggttttcctggcacgtgtagacaaacccctcctagtcttggccagttctgtagttctcccacagaccaggaccctccatagaggctatgtcttcctgaagagtcagagggtgctgccttttcaaaccctaaactgttcattaccatctgggaagtcatattcaaagtacttgtgagctgaaacacccctggcaacagactaaagaccacatgtccctccctccactgcttcctcagtcaccacccacatccaggccctggtattcacttggtgcttaacctctgctctgagtcagcacagcatcttgaggggtacactgctgggagacggggcatagatagctaaaggtaacctgtgaatcttttaggcttttgttttgttttgttatttggacacagtctttctatgtagccttgcttatcctagaatcactctgtacaccaggctggccttgaaatcacagagatctgcctgcctctgcctcctgagtgtcctggtttcctaataacattgactcctgtgtcctcctttgaatataccactgtcaggcccttaagacactttcatcatagacttaagttcttccttaggcctaaggataaaatagatgtgtacttgagagctgacccttcactggtactttagaagagagctgcttctttgactttgagccagtcgtttatacccgggtgctcactgtaggtggtgtgtctttgcttctagcttagaaggtggtgtgtgtgtgtgtgtattcacacaagcttaatgtcactgtgtgtctcttcccaggcctctgcatgatgctgtggagaatgaccacttagaaattgtacgattgcttctttcctatggtgctgaccctactttggccacatactcagggagaaccatcatgaaaatgacccacagtgaacttatggagaagtttttaacaggtatgatgtagtccaatgaataatcttactcaaaagtttgactcacctgtgcacagtatggtttcgggcacctacagtcctagatactctgagagcataaggatggaagatcatgcatgtaaggccagccagactgacttatgaaggcctggtagttgaacacttagcacagggaaagccctgggctctcactcacaccacctaaggagtggatggggtgggaagagatgggaactgtatattttgatttgggtgtgactaggcagaatgcaaaggttgtttgtttggttggttggttggtttttgatggtgtaatcctgttatagtgaggccatttggcttcttcatggtagcgttctttgattgtttgtttagtttccctttctagaaatctcctttttcccgaagtatggctcataagtttacatagcaagtctgtatggagtcacacaatctgatgggcatgcagtttggggtgatgttgtttgatcttagggtaaagccatcttttaagccccaggcgctaggagattcccctaaacagaagcacagagggttttatgactctcaggcgcacttacagtttgcattccttatcagacattctgggaagggattccctcagctggaccatgacccactcatgcccatcttgagttggactcactgggagaagttactcagttgatcagagacaaggtgtagaaatacagttcttccttggttttataggcaaaagctgcagagcttcttcgctctcatttggtaggccagggtggcctgtccctcggcaagtcaggataacagttatgtaccacagaaggcttctaagaattgagaggctacgtgcagacccattcataaaatagcctatcatgagttcataggagaaatgcaccctaagtagatcagcattttgttattgtcaagtgacgttttgtttcgtgtggggacaggagcccatagtggggcccaggctggcctcaaactttctgggattatagttgtgcgacaccacacctagtgatcttccatcactacccctgtttctctgcagactatttaaatgacctgcagggtcgcagtgaagatgacaccagcggcgcttgggagttctatggcagctctgtgtgtggtaagcagctttttattgtggggagtggatggcttccaatgtctatgcctacccggagggagggcggtgggcactggaaaaacttggtcactggagaagattgttagaggtctggatgtggtggtgcggctgaaatcttctgtagttaacggatccctctctctcatttgtcttacattagaaccagatgacgaaagtgggtacgatgttttggctaatcccccaggaccagaagacccagatgaggaagaggatacctatagcgatttgtttgagtttgagtttgctgaaagctccctcttgccgtgttataacatccaagtgtctgtcgctcaggggtgagcatggctatttctggcacaaagtggccaagctgcttctaaggcagtttgtcccattaggcagatgaaggtagatgagtgggtggctccttagctgtcggcaaactttggcttagggtccagattgcttgattatttatgcccagtggagatggggcttaaccatagcatggtataggttgccctcatgagaaagcaggagcttagagccaccatcttggatattacagttgtcacccattcccgaacaaatcaccctaggaactcccccaagacttgaggtataattggattgtagtgataatctacctccttatctaagaataggacagtcacacttggaatccttaatgtgtcctcagatttggttagatcccatgtgtcccctatgggtgtgctgctgcaccttcataccgtcctctggggcatacatctcaagaaacagctatgctgtgctatgtggggacaaaagtgtttaatgagtaataatctcctcagctctgaaacgataaacacatatgccatcacaaacagcgacagaaattctgaagggtattagctagctattaagagtattaagaaaaaccgggtgtggtggcacacgtctttaatcccagcacttaggaggcagaggcaggtggatttcttgagatcgaggccagcctggtctacatgaagcatgaagcaagttttagctagagctgggtgagcaggactttttctccatttgtttccatcctcagcagacacagtgaagcttgttcaaatcctagtacaggttcttcgtaggaaacgagatctggcctgagttctttcagctgcagttactctccttacctcaaagtccagtgatgagctatggtgggagagagccagtgggagggttgaccaaaagacagctggccctggttagtactcaaaagtagtcagggtactgtagtacctttccatttggccagaaatctaagtcccacccctttctattttctaggccacgaaactggcttctgctctcagacgtgctcaagaagttgaaaatgtcctcccggatattccgtagcaattttcccaatctggaaattgtcaccattgcagaggcggagttttaccgacaggtctcaacaagtctcttgttctcctgccccaaagacctggaagccttcaatcctgaaagcaaggagctgttggatctggtggaattcaccaatgagctccagacactgctgggctcctctgtggagtggctccaccctagtgacacgggccatgaaaactactggtgagccacctgccccgcccacccactgtgtacagtgtgttatagtgttaatccttgtgcatatgtgtcataatacaacaatttctgtaaagaaaggacactattacatatgaaaatatctcttctttatataagagaagttactccggtcagaagaacccagaagcccgtgttttctttctaaaattttaagtcagtttttatgaagctgttgaaatgtctttatttttcagtgtacacatgctttgaaatgtatgttcgtttttacttggaacatttttcttttctgttcttttctaaggagaaaaaaataaatgaataaatgaataaatgaaaaggagctctgtgcttggcgtaatttcatacaaagctctggtggcgggccatgggtgtattgtgtggtgaggactatgtgtttggtttgctggagtgaattgggtgaaggcacttggtggtggtatacttttatgttttgtttacagagtacctgctcacaccaggtaaatgctattggacgtgatccagtggtatgtaatataaattcaaaccatatccacacacaacaactaattgtaagaaacttttgtatcctaatttaaaagctgtgaaattacttttcacacatcaaaccggattgtttatatgtttaaacattttatgctcttatttaaagaagactttgagctatttttttctgtactctgtaaaatattgaaaactaacataatatgttgaggttgcttgaaaatgtacataaaactaaaattttctgaattgtgtgtttatgtttgaaatctgtgttttaactttgtaagtaaattctctgcctttgtatttatattttacaaaaatttttcttaaaaggcaataaacctgttgaggaaaggagc

SEQ ID NO: 611 - DNA, 123694 bp, mus musculus; identical to SEQ ID NO: 610

SEQ ID NO: 612 - DNA, 15214 bp, mus musculus
ggcagtccttagacagctcttcccatgcccggcagtttgcggcatctggaggagctctctggagaatctccaacctcagagcgagccttctactaccgtaagtacctacaaatgagcgcatagttcagtggctgaagattaattactggccacaaaatcctaaacaaaaccccgaaagaccccctgctgtgattaatcgccgtaaatcaaactgctccccagtcgttccccccacccccttcattcctgcctctctccttctttccccggatccgagccccgcctcgatgagaacctctgggcaatgtggatatctcccctttcatttctcagtcttccctccaaaccctaagcagggcttgtacccagcaccccgcggagcccaatccttttgattgctgtagcccttaaagctatgaaaggggctacctttagatattttgtacatatcactctcaaaaacactgcggcgctgcctaatggtggggaaagtgcttggggtagagtgcaaggggaccattaaaaaaaaaagcctcaactgcctaagttgggggtggggtgaaagagcaaaatgggcgtggccaattttgaacatcgggttgttcccaagttccctgagcataagattcatcatcttggctgaaatgatatggtacaattatgttttgtttggtttggttttaatgattgaggagtggtcagccatgctgagcaattcagcttttctgactccactccagttaccaagaaacaagactcagatgtccatgtggtaaggctggatcaggctggatcctcagagggcattccctgggtgcaatcccaggttggactctttccttggcaaagaatctagtttcccccaatagatcctggcccagtgccccaaggggaaacagcaacagggtggtattcaagctttgacctggcactgagaaaattggggacaaggggttctaggaattgggatgggaagggtttcaatacggtcttatgccaaattataaccctgtttgaaaaaatgagacaaaatacacctgtttacaagaaacatacacagaatgcctggcactgtacactcattttccgtaatcgaaaacaacaataccagatacacatgaacagataaataaataaaaaaagttcagagactgtaagttaagcatccttcaacacaaaaagaaaaagaaaatcagggcccagctcttcttgaatcttctcggtgtcaacatgttgtctaaggccttttgaaaatgaagctttccacttgtccatctcactcactgttagtctgttagtgttagaccatactaggggctgcaagccggccataagtttagaaaaactaagtcattttcttatcctcttgtggttgctgcatctacctcactctactgagctaagatcaaatagctgaaggcaggtgggattttgtactacagtagaggtccccgtggagtttgtgctgtgaggacacaccttcccgaggcaaaaggttactttgtggtgagaggggagaagatccgccttgtgcatttggagtccatacggttccattttcttcagaggtagtgaacaaatctgcttagaagttaagggcaagttctaagagggatcattcagttatactttcattaactacgtggaagcagctgaattaactaacacatactcaaaagagggttttaagctttggagataagggataagggtgcattataagcactccttacaggaaacagtctttgtgatggactaggaggggtaacagaggatgaagaggggacaacgacagatgctggctctgggcacttgagccttggagtttaaattaaatgaactttactttttatttaatattttaactttcagcaaattatgtatcctccctaaactccaattgccccagcaacaaaatggcagcagtggtcacaaatgcccttttttattaaactattggatgactgagatgcgcgcgtgtgtgagtgcgtgtgtgtacatgctgtgtttgactagtgcagttgtgcacttgtctaattaaaaggcgactcttggcatggtccacttccccccactcagtaggatttcttcaggcttgtctaaggtcaccttctgtgcctttgaaatctcagggacaaataaacatttcaaccaaaaaataacatcttggatcgcaggaaaagatcttgagtagagagactgggaaaagtgacaagtggccttattagcatgctaggttcctgggagctcatggaatgaaggttgtagagagggatgcactgatcacacctcaactccagagagcagaactagaccctgagcaagaaaatgtcttcttttagattctactacgttttaagaagcaaagccttcaagacttggaatactacaccagagggcctccaggcctggacaggccacagcctaagccatgatgcttcggaccttcactcttttgctcctttgcatttgtaagttcaaggaagggatgagaagcaagtgagcctgatagagaagctcctgtgagcaggctcctggggaatctggggaactgtttgaggttggagagcaatgtagaaaagcagactttctcttctcagggctcaatccgggtatgacttcactgggtaagtgtcttcctatcagggattgtaaggtactggcctgtgtgtatagcggctgggctacttgggaatcaaatcctcttccattatgatttgatttcccaagaaatatgcagattcttatcttgctttagaaggcagtctacttccccctgctcagttggattccttgagcatatgtccctggcccctctgtcccaaatccatacaggagcagaaactcccactccctacaagaaggcagaagtcagcatctgggtgggttagagctaattttaaggtgtgttatagggcactttgtgggatggggagggctgagcactaatatctttctgattttggggaatggcagcagtggagtctcaaccagagctatggatagagtccaactacccccaggccccttgggagaacatcacactctggtgcaaaagcccctctcgggtatccagcaagttcctgcttctgaaggataactcacagatgacctggattcgtcctccttacaagacattccaagtttcattcttcataggtgcccttactgagtccaatacaggtctttatcgatgctgctactggaaggagaaaggctggtcaaaacccagtaaaattctagagctagaagcaccaggtgagatggcaagggtaaaaactcaagaatattcacccactcttagtacgcaaaatcgccatcccagggaaggatttgttgaagtgattcatttacctcaaatgtatgcatgtatgtgcgtcacagataacatttaagtgcctactcagtaacagacaatgcatgcagaggactcaaccctgcaagggtggggcaaggaagagttgttcagggaaggctcgtctaaagcccatctcacctctcctgctatctaggcagtaccgccctttctttaactcatatcagttcttttttttccaggccaactccctaaacccatcttctggatccaggcagagaccccccctcttcctggatgcaatgttaacatcttctgccatggatggctccaggatttggtatttatgctgtttaaagagggatacacagagcccgtagattaccaagtcccaactgggacaatggccatcttctccattgataacttggcacccgagaatgaaggggtttacatctgccgcactcatatccagatgctccccactctgtggtcagagcccagcaatcccctgaagttggtggtagcaggtgggtgtggccacggctgctggcatctgacaattgttatcccagggatcatggctggttgagcaaaagttgttcatattacttgcttctgccagtttctaggccctgcacagtcaatgaggtagagttgcttgacaatttcctgagctacaaatcagagtcacacatgctttaaagcagataatcctttgacttgtttgtgagcctacccagctattcagaaacttcatcttatcatagttttactgtcctttacttgttgatcatcaatcattcattcatccaatatttattgagcacctaatatgtgccaggcattgccagtgcagtcttaaaattggtttattaaaagtttaaatgtatttgcaatgattatatttaagagtgggaaacagactgaatcactgtgcctgttgatgtaaaacaaaccaaacaaatgagaaagcaagcaacaggttccctttgtcctatatcactagagccagtaaaggcagcaccaagctctaaacacagaaggcaactcccccaaaggtccaaatgctagaaaaacacactccagcctcaacttctctatcccatgccctggatgattccaaacaaaattgtctttatagatctagtttctgccccaagcaaaatagatcttgggaaattgtggtgctacagaaagtacccctgatttctagttccacccatgacactgtatgatgttgagcaagtcatgtcacttctctgtgctttggttttctccattctaagacaggataacaggatctttccaatctattgtacaatatcactctgtgcttcaatttcatgatctgaaaaatctctataagaataatgcctacctcacagggttgttgtgaggatttgcctaaataacatgtacagtgcctggcacatacgttctcaataaatggtagttaataattttattaatatagctttttcttgaggatcaaaatacaaaggattgtgtaagccatgtatatggatgcttgttgtacacatactcttccaacatagttccccactaacacacttgtacgattaatgttcaccagaatttcccatttcttcattaattttaggctggcagggactttatattatttacactcaataccactagactggcatgtttcatgacacatccgaaaagctcccatgagtatatgacagagctgatctttccatagtagatgagctggtgtacctgggatctgagtggggataacatggagtcatataaagctgaagtttagtagcacaaccaccttagaaaaacaatccatggaaatgagggtggaccccattagcagatttcattggcttactgagctatctccctattgacctccttcaaccttgtgctgcaagtgttgaaagtaggtgtcttaaagcaagattaatgtgttcagatgctctcatcaatatttcagtgaaagttatgctctacaagatggaatcaaagtcattttgagaagtgtagattttctggctgtgggaagaactatatatgtcattttagagaccggaagattcagggaattatggatgtagacagtcccctgagggaagcacctctacctgggcaagctcacagtggagctaatagagctgaatgagagcggaagaaacgtgtccttgattatatacatgaagaggcataaatctaaggcaagagaaggaaagaagcttacatcccaattaccacttttgtccaaagaaagtagaaaaataagcatagactggggaagaactggccaaactgtatcttaagggtctcttccctttctaggtctctaccccaaaccaactctgacagcccatcctgggcccatcctggcacccggagaaagcctgagtctcaggtgtcaagggccaatatatggaatgacgtttgctttaatgaggttggaagacttgaagaaatcattttaccacaagaagccaataaaaaatgaggcatatttctacttccaggatctgaagatacaggatacagggcactacctctgtttttactatgatgggtcatacaggggctctctgcttagtgatatcctgaaaatctgggtgactggtaagatatgggtatgctacggaacaggttgtaaagcttcctctgactccctctctcctcttgtacttagtcccccggccagaactagtggtgggggtcaggaacagaatttgtgcaccatactgagggatttgtaaagtacaaatgggaagacagaggagggaaatcaccctaagtagtagaaggagtggagactttcaccattggctgtttgtattttgggtctcatcctagacactttccctaagacctggctacttgttcagcccagtcctgtgattcaaatgggtcagaacgtgagcctgaggtgtggaggactgatggatggagtgggtcttgcactctacaagaagggagaagaaaagccccttcagtttctggatgcctccagcaacactggcaacaattcattcttcctaaagaatgtgacctacagggatgctggcatctatagctgtcactattatcttacttggaagacatccattaagatggcaacatacaacactgtggagctgatggttgtaggcaagtgatcttaactggctttaattttcctatcacctatttgttattattattattattattattattattattatactctaaggagggggttagtggcttgtgcactttcctagaggtacaagctaaagagataacactaggagtatggtatagggctttctatccttcaggaaccttctctcctgagactaaccttaagccttgcctctcagcatgacacagccccactgtgagttatgaaaaatattaaaaataatttctttcaagccagggagagtttacaggtatggggtcttcctgattgaaattaagaaccagtagtctttagagaaccacagagaggggaaaagaactctaaatgcacaaagtttgaagccattaaccaaatgtaagtgaagaaaatcccaaatgaagagctgtgaaacatttggcaggggagagggtgctgacttagtgtcacttctaactgtggtctctggattggtttcagataagccccccaaaccctccctttcagcttggcccagttccgtgttcaaagtaggaaagaccatcacccttcagtgccgagtgtctcatccagtgcttgaattttctttggaatgggaagaaagaacaacattccaaaaattctcagtagatggagacttcctcatcactgacattgaagggcaaggcacaggaacctacagttgcagctatcgtattgaggcacaccctaacacctggtcacatcgcagtaagcctctgaagttggtgggaccagcaggtgagaagataagttctcatatcctgggattccaaaacggtgcccagaaatatatgggaaggggagtgagggcttggaaatcaggacccatgcatctaggcacactttccttgggtgtgctaagatacctcaagggagtgaccagaatatcctgaagaatccttcctattctccacgaacaggaaggacacatctgtctcaagcttctaaacagaagctttctctgtgaccagctcccctcccccaccatgacattatctgtctgacctcatccccatcaaggtttctgcttctggtctcctctggtcacaggcttcctcacctggaattccattctgaatgaagctgtcagggtgtccttaaccatgcagcttgcttccttgctcttgctagtggtatggatccggtggaagtgtcggagactgaggctcaggtaatttgctcagcctgttgttgcccaagatagctgactgtgtgctctcctagtctccagaatgggccggtccccagttaccataagtgtggagacacattcttaggtttctctcagcatctagatttacaagtcaaggcattctcattctatctgtttctttttcacctcacagaagggtcattacccaagccaagtggagtcatgtatagttttctggggctacacgaataatcagaagcatgttccctgacctctacacctcctacagtgcccaaatcacctcttaaacagctctgtccacaagacattatagctgtcttccctattaatatggtgtgaacatgcttgcttgtaagaagctatgctgttggctcttacagcttgttatctgactaccatcctattttttccaacattatatccctcacattaaagggatagagagaatattttcgtccattttaagttccttacaaatcagtttttctgttactcttgactcctattgtttgcccagagcacccttagggtagagttttaagctggataggcatttgataagacaataaatggagccagagggtcagattgtttcctctagccagaaaatacagctcacaagatcctactgccatttcctgagattctccagtgtccttcggaccattgatatctctccctaatccccacggttttctaaggatattatagatgacaatgaaaagagagaagtaacagttcttaatcgagtagattaagaactacctggataatttgacttccctccaccccttgcctctggatgtacctgtctgccacctttgtgtgtctgggaaagttaacacacaatggaagatcactgtgactccgtgtgtctgtgatttctgctggaatctgagggataatgtgccagggcaacaagttgagagagccaattatgatttctgacagagaaaaaaaaacacccttggagttttcacgttcagggagatcaattttatggcctatagatctgtcctaaatttcatatgctttaggctaagctcctagtgggattatcctactccaagatcattgcatcaaaaaataagataagaatctagattttatagaaagcagcctgaaaagttgttttcctgaccagaaaaaggctgagggtattcactgtttcccaaggaaaacaaaattgtcagctgaattttggctttatacctcctaattgtatgggaggcagagctcagcaacagtgctacacatttgtagtcacaatctatgtggtggagagagagatcccactctctgacaagctcgctcaggactgacaggccatcttctggtaattcatcaaggctgcctaggcaacccttccataacaaaggcaggtgaggcaggtccgtctaaagaccaatactgccataggaacaactgcttccaaacttaaacttgatgactgagaaacactcaaggttgctctttccacccccacactcaaccacccagagctgctgagctccaggggttctgagaactggagatacaaaagcactttcccacctgacatttcatttgctgcagcaacctcatcaagagccatgggaagctgatatataatacagactgggggaggggcggagatgaggggcatggaggtcatagaagtgcaagaggtttggaggcgattaggccctcaagaagaaaagtcatcagtgtcagaaaagattatgtgccattatcctggtcatacccaatccctattgggtagtgaataagccaatgacataaattgccgcccccttctctccgccctccccctaatcccagcaactcctctcatcttttttttttttctggtctcgctagagaagcctggttgttgggaacagctcaaggggtcgccatgctcttcatactcatggcccttctttgctgtggtgagtacaaaggggtgggacaggggtctgggcagcaggctggggaggagggagccgaacctggcaagggtttcttttgcaggactgtgcaatggggcattgacagaggagattggtgagttttgtcctgccccagactgggacattcctctctggagatccgaaataactacagagtgtcagtgtcagtgcccagggagtgactggttgggagggaaggacagccaggaaggggcacttgttaaagctactggcagcactcagcctccaactgtctttctgcctgtaaaaatttccttcagactcctgcatttttgtgaggctcagctgagaaagcagcttccccttttcccagtacctggagaaagaagaaagataggaaagagagggttctgattgaaggggaaggggcgtgtgatctgggtatggacttcaagagaaaggaaaggagggaggggaaataccaagaggatggctttattaactctgctgtttctagaaatagtcatgccaacccctaagcctgaactgtgggcagagacgaacttccctctggccccgtggaagaacttaaccctctggtgcagaagcccatctggctcaactaaggagtttgtgttactgaaggacgggaccgggtggattgcaacccgcccggcctcagagcaggtccgggctgccttccctcttggcgccctgacccacagccacaccgggagttaccattgccattcatgggaggagatggctgtgtcggagcctagtgaagcgcttgaactagtggggacaggtaagagaaaacagaggatcatcccggagtgatccccagtgcccctggaactcctgtgctgctaggagtaaagggtgggggaggggtgaggaaagagtaagaggagacaaactgaggaactcaggggtacatttcatttgtttgcagagaaagtaactgagcgtcccatactgggcacgtccaaacttttgattcctggccatcccattttgttttctagacatccttcccaaacctgtcatttcggcttcccttccaatccggggccaggaactgcagatccgctgtaaaggatggctggaaggtttggggtttgctctgtataagaagggagagcaggaacctgtccagcaacttggtgctgttgggagagaagccttctttacaattcaaagaatggaggataaagatgagggcaattacagctgccgcacacacactgaaatgcagcccttcaagtggtctgagcccagtgagcccctggagcttgtcataaaaggtagagctggatagggtgtggggggaggaggggcgggaaagtgcgtgatagacactcctatctccaccacaaactttgctgctggtactaggagcctgtgtccaatcttagagccaggcaggcgtggcgctgggagtgccagggcccctggctccacgatattaatagccataattgttattaatagcttgggtttgtggagggtgatttaatttttctgattattttcccatcaattatctcatttaagtatagaggaaatcttgaagtgaggtgaagcagctactatttcattctcttatccagatgggcgaaccaaggctcagaactaatagcgtcccgaagaaagatgactctttcagtatactcctttgcctgttccagtaacagtgaagatttctctggagacaatgagggacagggatgagggatccctataaaaacaaacaaataaacaaaaccatcaatgcatatatgtctgaataaaatgcatatagcggacttcttcctaaaaccaacatttgttgtatttgcttcatgttttcttgatttggttttgtaatgttttgtttttcttttctagaaatgtaccccaagcctttcttcaagacctgggctagccctgtggtcactcctggttcccgagtgactttcaattgttccacctcccatgaacacatgagctttattctttataaggatggcaatgaaattgcatccagtgacctagcctggggaaacccaggaggcagtacagcccactttctgatcatttcagtgggcattggtgatggaggaaactatagctgtcgttattatgacttttccatctggtctgagcccagcaaccctgtggagctcgttgtgacaggttagggaggggaagtctttatgggggggggggtggtactgaccccagtgaggggaagaaatgtgttctctaaaagacacttaggacagtgcttagtgtatggtaataaactgtctatgtaggacagctgcacatgtcactatcataagaagaaacaacaaaggagtaggggaggccaataattcacttctgaagaaagaagtgagggagataggggtgtccaatccaagaaccacactcaagttgcctgctttctgagataatccttttaggcttgaccttgagctttgggttgaatcctcagccttttcctgagctgtcagggattggtggctggatgaccctcagagaacaggagaaaaccttgaaacgtcaggtacatgttatacagccattacaaatgaccatatcaaagggtatttaatgtcataggaaagggtttgcaatataaacatatcagactcttaatccctttatgcactgggggtctcaattacataaatagcctcagctccaagaacatagtcatgtgttaaaatataagaggaaaagtaggtaaggaatcgttatacttgagttcgtgaaattatgttttcttcattagttttttattgcattttctaattttctacaatcaacatatatcatctcttataacaacattataaaagctatttgcaaagtgcgggaagcagtcttctcttatattatgatctttttcattttagaattctaccctaaacccacactcctggcacagccaggccctgtggtgcttcctgggaagaatgtgaccctgcgctgccaaggaattttccagggcatgaggtttgccctcttgcaggagggtactcatacccctttacagttccaaagtacctcggggacctcagctgacttcctcctccacactgttggagcacaggactttgggaactacagctgtgtctactatgagacaaccatgtcgaacaggggctcatcccttagcacccctcttatgatctgggtgactggtaagaacagacgaaacctacggctgggatagagtcgattgagcagggactatgggggataatgtctcctagaactgtaggccaaattatgaaggggattcaaagcacagcaattatcatggaggacagctatgaaggtggtatactcatatctcattcatcactgttctctgtctagatacattccccagaccatggttgtctgctgagcctagttctgtggtcaccatggggcagaatgttactctatggtgtcaaggaccagtccgtggagttgggtacattctgcacaaagaaggagaagccacttcgatgcagctttgggggtccactagcaatgaaggagcattccctatcatcaatatatctggtgctagcataggacgttatagctgctgttaccaccctgactggatgagccctatcaagatacagcctagcaacactctggaactcatagtcactggtaaggggatgaaaccatggaatgggtgttgtagtgtagaaaggatcagattgactgattcgagaaagatgttttttaagaactcatagagaggcaaacggtagtctcacctctttcttgatgagatagtagaggagctcatagagaaataaacactaaaatggctgaccactgacccacagttaatttcttataggtttactccctaagcccagcctgttagtccagcctggtcccatggtagcccctggagaaaacgtgactcttcaatgtcaaggagaactgccagattcaacatttgtcctgttgaaggaggggacgcgacagcccttagaacaacagaggccaagtgggtacagagctgacttctggatgccagtggtgagggatcaagattctggtgtttacagctgtgtttattatctggattctgctccccttgtggcttcgaatcacagcaactctctagagatctgggtgactggtaaggttctgaaacccaggaaagccttttgattctgtgatttttagaccttttagaagttacaaatagtacaagaaatggtgggcttcggggtcacttcttttaactctgtgttcttggtctggttacagataagccccctaaaccctctctgtcagcctggcccagcaccatcttcaaactaggcaaggacatcacccttcagtgccgaggacccctgccaggagttgaatttgtgctagagcatgatggagaagaggctccacaacagttttccgaggatggagattttgtcatcgacaacttggaagggaaaggcattggaaactacagttgcagctaccggctgcaggcctaccctgatatctggtcagagcccagcgataccctggagctggttggagctgcaggtgagtggataatgcttccatcaaagttcctgttgttaagctcctgggatctcaagaacaatccccacagagataaaccaaaataggagacaggaagggtgtggagttggagccctcaagtgtatcctagctcatataaagatgagtagaacatactttgtgttcacttagagacactgaatagattcatctaaggcgtccctgcctggctgaaaggagatctgagtgactcagcctgttctccttgcatcttgattggtcattttttccacagctcaatgcatggcttacatgtggctctggggaggcaagaaagagaggacaaccaaatatttaaaggaacactgatgatgctaagctacaattctgattttttgatataccacagggcctgttgctcaagagtgcactgtgggtaacattgtccgaagtaccctgattgtggtggttgtggtagccttggggatagtgctagccgtagagtggaagaagtggcctcgacttcggactaggtaaatactcactcagctaagctcagttccagaaatggagtgctgctgggaaatccatgatccagttacttctctggcatctcagccctgccctacaatttgttttcagggaccgcccattagttttgtatctttctctttatacaggggctctgagacagatggaagagatcagaccgtagtccttgaagagtgtaaccaagaaggagaaccaggcactaccaccaattctccttcatctgcctcgcaagaagtctcagtggaactgacagttccaatataattaccctctcctttataagagctttcctcttttatcttttacctgtagagacctgaaaatcccacttgtttaccctagaattcagtggcatttactgcttcttgatctctaaccacttgagttgggtcaagaggattctgggcgtggcaagctctacaggtcaagctgtttcctctatcctggtaactcctcactgtactgatttactggtgcatgcaattctgttaaaaaatgtattcttctgaataaagagaatattcactatttaactgcaaaccaaa

SEQ ID NO: 613 - DNA, 53659 bp, mus musculus
ctctttctccctctcctttccctgcccccattcactccataatccaccccccctgctgtggcactcctagtttagagccgcccagactgtggacctcagttcctcaggccagctgccactctgaggatgtgtgtggctctctgctcagctcaagccccgcaggtggacccccagaagcccgccatgcaaggtgagactgttccaggtctcttcctcacttcccaccaccacccacctggatgcctcttggtggagttgggaatgttaagggaggaatcttcctacaccgcattctgtaccctagagcggaaccttgctgaggaggaggatgcagatgcacttccctgtaacactccctgtagtttttaaagcgaggtttatttacttgtgtgggtggttgctgtttgtttcacgtacgcgtgctagggccaagtcaaaaaggcgcttggattctgaaagccgcgggcctgaagttggaggaggagtttgcaggcaaactgcggtcaagaatttgggttttctcactaggaccgccacttctttccagcctggtcctatgagcttcctgtcttccttcagctcttactacaaaggcgaaaggctctttcttacttgccttggagggacaaaaccaaagctaacaaatgtcttaactgctgccactgttttggtaaaaagcttaagagtagtgagaggcggcacttgatgtatacatattgagctagtcggagttgcttggctttggactcttggtgtaccgtgaagcatgcagaggctcctaaaatttaaagttcctctaataccattagcagtccaggaatatccgccaggtgctgcagctctggccatgtcttttgtgcgtctgtggtgcttgcttaccctgcggtgttccttgtaatgggaatttgggaattaaaaactagacatggtgtagtttttcttttctcaaatcaggtagccacagtgtgtgttccaaattcctcttcttgtttgaggctgtccacgaattggaaggaggtcacgtcgatgacttcggttaaaccacaggaaacccagggctctgtctaaagcttggtaacaaagaaccctttggtcttgagtattttgtttggaagcggtcaatgttattttctgtatgtaataataaatcattaagggaagtgtgggagtggggcacacactttttcagggtttcagggcagtttaaatggatgtgggaggcaaaaaaaaaaaaaaaaaaaaaaaggaagcctgtgcacaagtcgtgtgcagtgggggctaaagatcaacttcgtagaaaaaaaacacataaaaaatgaaacagtctcactttgtagctcaggaccagctccaaataatcctcagtgctgagagggcataggtacatcctcatgtctaccaccactcataacacataggcactcacatgtacacacacacacacacacacacacacacacacacacacttgtatggatacgagagaatgaggtgttctggggcctgtgtgttggatgctaggcaaatgctctacctctaagttacaatcctggtgggaaaatgccacaaaaatgaaatacaaagggatgattctattgccaggcatttctttctttgttctcagttcattttcttgatccttggaagtttctaacatgctgccactgtggcatggcaatacatcctagcactctgttgtgttttagtggaggtgggggtggggagagggatacagtagtggggtagggagactggcagctatttgtgttcaggtatttttcagcagttaccaccatgtccctgcaaagataagtatatctgtggctgggacacaccctataggatattataactttatgttgttgttgttgttgttgttgttgttgttgaggtgggcatttaaaaaacttgcctatgttgcttttgagctcctggtttaaaggatgtgcttcaacctctagagtaaccaaaattacaggtttgtaaccccgtgtacagcttgggacttattttgctcttttcaaaaatacactgttttgttctctttttagtgcgtatatgtgtgggagcaggtgccctagcacatatgtggaggtcaaagggcagcttacaatactctgttctttccttccaccatgcggctactcaggtagccaggcttcccagcatgtactgttttttgtttgtttgtttttgtttttgttttgttttgttttgtttttttttggttttttgttttttttggttttttgagacagggtttctctgtgtagccctggctgtcctggaactcactctgtagaccaggctggccttgaactcagaaatccgcctgcctctgcctctgcctcctaagtgctgggattaaaggcatgcaccaccacactgggctctgaacatagagtcttaaggttgatctcaaattctggctcttcctgcctctacttcccagatactggggttacaggtgtgtgctaccatgcacagtttataactgtaaatgcaaaaaagatttcatatacttaaaaatactcctgtatctacctatgtgttcagaaagctttttactgccatgaagaaccctttgaaaggtcacttattacgtagttatttgtgtgtacacagtttctcttatgaggcagcccagagaaagcacgcttttacttctgaggtggtagggtctcaaaatcagagggatgcacaaggcatgaggaattcattttttcctggtggataaggggtgggaatggagtgtggtagaggcagagaaggtattccagacataggaaataaatgagcaaagacaaagcagaaagggagaatacagttgctttacagaattacagagggttttccaaatgattagagcatgtgggcatggtggtacgcaccttcaatctcagcactaggaaggcagaggctggtggacctctaagtttgaggccagcctggtctatagagccagttccaggacagccatagttacatagagaaataagaaattatgtcttgaaaagccaagggaggggggagaacaggaaaggggataacacttgaaatgtaaatttaaaaaatctatccaataaagaaaagaaagaaagaccaaggaaccaggcagtgggggtgcacacctttaattccaacactcagaaggttggactttgaggccaacctggtctacagaatgagttccaggacagtgagggctataccaagaaacccctgtctcaaacagacaaacacacaaaaaagagctgagtcagggcttcggtttggggagaaagactgggaatggaggccaggtgtgatggtgcttgaatttaatcccagtactaggaagggagaagcaggaagatctccagtcagcgccacatagtgagggccttctcaagaaaaaactaaaaccagccaaccagccaaccagaggctgggaatggaagaggaagggcaagtttgggtttgatttattttatcatcttattttagtgttgagaatggagcccagagcctcatatgtggtaaaggaatatgtccaagcttttgagatattcttcccaagcctgggcgtcactatcgaggaggcgctttttgtggaacattcaggttgaactaaccaagaggtccagatccgggaagaagtagggagaagtaagccttatgtcttcccgttttctcttaactgcattttttcccttaaatctacttccgtatgggctatcttgatagctcagcctgagtactgaatagatacatgttcattagcttgcttctacagttttcccttctcacatgctaccttacttaataatcagtaggaaaaatactttgcactctgtgaagaatataaactgtattaatctactagagccttacccaactaagaatttaaggaggtgtggaaacctatccatgtacaaattttctttttttcttttttctttttttttttggtttgatttgtttttttattcttttggttttttgaggcagggtttctctatacagccctggctgtcctggaagaactcactttgtagaccaggctgaccttgaacttagagatctgcctgcctctgcctcccaagtgctgggattaaaggcgtgcgccaccactgcccggccaaatttattttcaactgcaatgtggcatcattaagttttagctcaaatataaaaagagtataaatgacagcattgatttacatacattgcacaatgctgtaaaatgtattccaacgaataatgggtctttaatggggctaaacttttattattttgaaacaaactctcatgtagaccaggctgccctgaaaaactatatagctggggatggccctgaattcataattctcttaccttcacctcctccgtgctgggattaaatgtataagccaccattccagatgtttttaatgtggttctctggaccacatccagggtttcattcatgccaggcaagcacctaactaactgaacaacatcttggcctgtagatcacattatatcgactattttctgtgtcaaacttctctctgaaacagcatcaacacttttagtgcctggtttattttgcttctcaaacttctaaccattttggaaggaaaggttttcaaaaagtttacttaccttctggacccctgaacctggaaataattgcatcctttcctgatgactcaagactgtccttaagacagcatcaattatgttaatctgatatatacagtgctcaggggttcgagtggaggctctttgtctctgtggcaaacgggcacagatctctctgccttttaatttgtaatgtctgctttgtctaatctcttcatatatcccttctctgttagctgtcacttcttgctgctgtcagttttttctactgtcttttattgtctctggttccaggctgcattctccactgttcattttgatgtgctgtaagctaaggaatattgtaacccaaatgtgcagaactatctgaaaagtataaataaataaagactctgggaagtcttcctttatttatttgtgtgtttggatgcttgcatatgcacatatttgtacagagcccggatgttgattatggatatctccctcagtagctctctaccttgttttttgagacagtgtcttttactgaacccctgaacctggagccataagctaccctgaaacttcctgagatttgcctgcctctgtctctgctagggttaaagacaccaccatgtctgaccacaggcagtgctcttaactattagaccacctcttcagctccactcaaaataaataaaaataatggtaataaaaggagcattttgggtcttctaggtctttgctaatcttcagaattttattttatatcattatcttgtcaatttgagaataaaaatctagttagcatttgctaggaattgcttagactctataggtcaatttagggagtttattttttcccttatttgggacacaatcttttaccaactattatgtaggctggcctgaaacttattttgtggcccaaattgtgaatattttttctgtaatttacttagtgagaatcgatttcttttctttactgtgtgctgggcagtggactcagagcccagggcatgccaaacatgtggtctaccattaagctctctatgccttatgtgtaaagtaacatggactttatatactatcccccccttttttgagtctcaaactcatgatccttttgtcagcctctctgaatgctgggaccccaagtttgtgccatttttctggctctgggttcatttttagtaagtttgagattccttgtaaagtttttatgtgaatgagaaagttcacctacattttgaaatcttgtggctggagagtctgatagacattgagctgcctgccctttcaaaatgtatttcagctaggtcagcatcagttcttgtgtttaccttcaggaatactgcaagttttttactccttagggtcttcatttgcaggcttgtgccagctggttaattagctgccatcttacctattgagcatccagtgtgttgacaaggaaaaccttagagttatttaaaaaatatttcctctattaaaaaatgaacaggtgtgatgaggtatagttattcttagcttgcttgatgccacttagaaggactatgcatctgctggggcattcttgaatttgcatttgcaagtcccatcatttgatttgtcattttgctctgtcagtttacaaaagagggtcagtttggcttcctttgttgtgaccttggaaggaccactaacagatattatgtgttctcccacacacattataaaccaaaggaaaccattttaattggatttgctgttgcagatgctgtgcatttcaaaattagattttctaaacccatgaagcaatgaatagccacggagtacaagagctggcatttagttatatggctacatgaataccctgggttctgttcaagtgggccaccttgtatacttttatagcttgtgtttttaatagctgtcctcaaaaggtcagatgttataataaaaagttaaaagaggtgaatgcaaatacttagtatgcttagatcattcagttggaagctgtgaccgttatctttgtgattatcattatgacatctttcaattcctgctcaagcatggctagactcatttgaactgtgggtactggtgttgatgattcagatgagtttaaaaaaaataaaaaacaagaaaacaaaaaaaccaaccaaacaatggctgggctgaagagtttggtcagtgtggtaaagagcacttgctcttcccgaggaattaggttcaatttccagcacccacatggctgctcacagagtgctgtaacttcacttccagggcatctgatggcctcttcgggctttcaccaacagtaggcataccatgcacatggttcacagacatacaagcaagaaaaacattgatatacataaaataatttaaaaggttattattgtgtgtatgtgtggtcgtgagggcatatgctgatggagatcagaggatagccttatgatgtcagagttctcctactagcacacaatttcaaatatcatgttgcagactgttctttaggaatataaattgagaatgaaaagagaaaccagttagaaccagcaagatggttcaacagataaagggattcattgttgcctgtaaacctgcaaacaaggcacagtttaatcctagcactcaagagtcaaaagtgcagcacgcccgccaccggaagtttttggtgcatttctctctatggactcctgacaaatgcagctcacctatgcagtgtaaggccgaccaatacatgcatgttgctagcaaagaatctttcatcacctgtccgttcatgtgcttgctttagcagaacatcctctctcctgtgtctgcttcagtgaaacgttccttcaccagtcggccttagcctttcacctgtgtccactttaaccaaacgttccttcacgtggttgccccagcaaaacacatccaaccaacttcccaaataacccttaagtttccacgtcgcaagccgggcatggtggctcatgcctttaatcccagcacttgggaggcagaagcaggcggatttctgagtttgaggccagcctggtctacaaagtgagttccaggacagccagggctacacagagaaacactgtctcaaaaaaccaaaaaaaaaaaaaaaaaaaaagtgagttccaggacagccagggctatgtagagacactgataaaaaaaaataaaaataagtaaatacataagatataattgtatatggaagagttttcttggtttaacttcttctccttcctttcttacttccttctttcccttctttctgtctttccttccttaatacttttgttttgctttgcttttggtggagggggcagggtctcagtctagcccaggctagaaatcagtttatagtgcagactagctttgatcttatggaaattctcccacttctgccttccagagttccaaactaggagtcactgtgtctgacttgtttgtttttaaagcatgctttcagaactatcaagagaggctgggcgtggtggtgcacgcccacctttaatcccagcactcaggaggcagaggcaggcggatttctgagtagaccagcctggtctacaaagtgagttccagaacagccagggatatacagagaaaccctgtctcgaaaaaccaaaaccaaaaacagaactatccatcgaagaagaatttcttttaataaaaagtagcttttacctgacaatcattttgaagatgattcaaacacaatcttttactaactattgtgtaggctggcctgaaacttattttgtggcccaaattgtgaatattttttctgtaatttactttatgaacatcaatttcttttatttactgcgtggaaaaaatgcttctttaacatagattttttttttccatttagcaaagagttgttatcatctgtaaaatttcaagctttgatcaagttgcaaaagagctttaggattataaaaagctgggctgctgctcaggttttaccctcttttgggttttaaggacttttcatttgaatcacaatgcttcatttttgcatgtcgctgcaataggtgtacacacatataaatgacaatatcagtgcatgcaaagactaccttttcacttgcaacccatgcaaatgtgtctggcccaggactggtcgaaagctgtctgaacccccttctaatcctttagccctctgaggaccttgagggtagtcctcaaagactaggttagaaatcccacttctttttcatttcttctgtgtgattatcttatcagtttagttctggatgtctttttactccattctcattgcatctacaattagtatagctgtaacattcatcactctggacagaaattgcctcttgcttctagataaagaggcactcacagtccccaatctgggctgatgcttaactgcttttgtagttggatctggctttcagctttgaacacatgatgtattagagtggctgatagatatataaagaacaaaatgtgttgaaagttggatcagtgccttgcagcccattcttctatcgcctcattcattccttctattctccaactttctctaggattctaatgtaagggttcttgatttgctgaagaatgataccctggactcatgtaagctcagagtgttttattctgcacaagtccagcatgctggagtctcccattatcaagatagagagacacccaagtgagctcacgggcctgctttaaagcacattaggggattcctgggtaggtgacctttatattgctccatctctaggaacattccattactggggtgggggctggaaactgttactgaggaagtaggtgaggaagtctggaaactgctgctgacccattgtccttgcctcaggccaggtggcaggcagcttctgaggcctagacttgcctagagttacccagttcttggaaacagacatttaggcctcttctaaactgccaatttgaagcctgtcgtggagtcaggctagccttctcacttacttaatccctgattcattccttcaaagcacaaataaaggtcttgtatccctccttcccgaatttggaagtatttcctaattatatgttgtgtatatcttggaatgttggtacagtgatggcagcttcatagcaggtacatttgttttgatatgacacatgaatttttctttccatttctttaaagacaagctctcagtatctcaggctgacttggaactcaactgtaactcagactggctccagatgtgtgacagttctccttcagcctgcctcttcctctcaagcacggctggaattaaagtgatgcaccactatatccagttagaagatgattagcttgaaggccatctcaaaatttctttgatctttcagttgtcacctttaatgatttccttcctatttatattgtctatattatgtaacccatattgattcttaatttggatttgtttaactctacttcatactttcttgtagtgatttctgaaataattttgtcttcataattcatgatttgtgacaaatgcaaagtaatcctgtggtaagaggcaaatccaaccctaacacacttctgtaatgataatattttatatatagacactagttaatgccagatttaaaaaaaaatactgtttagtggtaaagagatggctcagtgtttgggagtccttgctgttcttctagaggacctgagttcaactttccccatccacatctgcagctcataattacccgtgtctctagctccagaggatctaacatccttttctggcttcccgggggcacccacacacatttcctcaccccccccatgctcccctgccacacacacatacttaaaggcactaatctgagtctagcagagtatcgtgaagaatcatttcattgacttttctttaattttctttccttctcttttcctctttttttaaaagatttttttatttattatatgtaagtactttgtagctgtcttcagacaacccggaagagggcatcagatctcattatgaatggttgtgagccaccttgtgattgctgggattcgaattcaggaacttcacaagagtagtcagtgctcttaacctctgagtcatttctccagccttcttttcctctttttaaatgacagtcatatttggttctatcctgggtctctgggctgtccagcctctggttcctggacatccacgcaatgtcaggtgtagattccctctcatggccacaaattagatcagttataggttggccactcccacaagttctgcaccaccattgccccagcaagtattacagctaggacagactgtaggtggaaggttttatggctgggttgatgtcctagtcccaccttttctgcttgtagaagatgggtggtttgtgctctgtaatcctccattactaagaaattttgctctagattccaggtagtttccatgttgtttgtctttctggggttgggtcacctgactcagaatattttctagttccatccatttgcttgcaaatttcatgatattttgtttttaaacatctgaataatatgtgcaaatgtattgcattttctttatcattccagttgaggaacatctaggttatttccagtttgtggctattatgaataaagctgcaatgaacatagtagaacaagtgtccttgtggtaggatggagtatcctttgagtacatgcccagaagtgttatagctgggtcttgaggtagattgattcccagttttctgaggaaccaccatattgatttccatagtggctgttctagtttaggttttgaccagcaatggagaagtacatatttcatttttaaaggcaaagtctctctttgtagctaattagggctggctttgaacttaggattctctgacctcagccttctatttgctgtgattataaaagcatacttttctgttactttttttttttaaagtaaagagctttatgttcccatgcagagtggagccaaagagaaattcactagatgtttggtgaattgcaatagattagaaagaggctccaatgtatattagcaaaagaaggatttagcatgaatcttggcagaaaaatatgtgaggttttcatactgtacctttattgaagagcaataacagttctacatagaactacatagttctattgtagtctaataagaatttattttctgatgatttcagaattgcccttttagtcattcttccttttgaatcataacatttttgagggcgcatagccatcatttgcatgtcctatgccattgctgtttacaggtgctatggcatatctctctttcagactgaatgggaaaatttacctgtgtagaaacccatccatcttgtacacagacctggaatttacagcatcagccataggaaactttcaatgagatgattggtagagggaagcagcgctgtttaggttcagactgcagtggcagatggcttagtggttaagagccctggctgctcttacagaggaccacatcagaggactcacagccatttttagctccaggctgagggaatctgatggcacttctgacctctgtgggctcctgtatgcatgtggtgaacatacatacatgcaggcacacaaatgttcatgaaataaaaataaatattgaataaaagaatttcagactgcaaaaaaaatatttataaatgtccttgctgtgatttgggaagaatggaggctgtcaggttgtatctagttaataatttcatgagagctatttgagtgtgttttttttagtacaagtgtcactctatctgaaggttagcagacaagatagatgatattctacaactttttctgaatttgtgctagattctgcttcggattgagacagtgactggcatctagtgttctttaatagatttttgaatgaatatgtatatgcttgctcattttcttcatcatgtttgtcttaaaactggcctgtagggactggagacttggcttagtagttaagaggactggctgctcttccagaggacctgggttcaattcccagccctcaaatggcacctcacaagcatctgtaattgtagtttcaggtgatctgatgccctcttctcgccttcatgtacaccaggcatacttgagttatatagacatacatacaaaatattcataaacataaaatacataaatcaataacaataatgaaaagaggaggcttttaatagcaactttggaggtttgttttgaagaccagcaaagtgaatttaaatacctgtacagtgcctagaaagggggaagagcttcaagatgatagtgtcattaactattcatcccatttattccacttgttcctagatgacagtgggttggttgctataatcttcctggtcaacattttccattctgtttttatatgtgctttgcttttgctgtcagtttatttatttatttatttttttaggaaagcatgagaatggaagcatttgcttttaaaaggagtttatttgccatgaccctttggtgtgggctaagtggcatgtgtgtgcagtagattcagaaccagttttcttcaaccatatatgaacaggattcccagatggagcacaaatggacacaaaagagtgtcgatataaaaataaaagccccagggttggaaattatggctattaaatcttggaatctgaaataaaaatgctttttataaaatgagaaagcttgaacataccaattacttactttttaaaaatgttcattttctctatgggagccattactgaactctgtagaagtgaaatctccggagtggtaatctatactcctattatcaagacacacattccgaaataagactcctaagagcattgatcctagtccagctatatgcttgagtgtcctctctgtagcaattcatcacagaggtgttttgtctttgaaaactgcaaataagattatgtgactggttttctctgccttgcaaggcagccattttgcctgtagttagttctgatattttgaacaaagtacctctgcataatactctttctgttggcctttttttttcccggaggggaaagacccaaccatccaatcaaacaaccaaaagcatacttgatcagacagctgtgggagtattgtacacatagccagtacccaagaagttatacagatttgctaggaaatatggcaatatgtgtaaccttcaaaatttcataaatttatttgactctttagtttttcctaggacatctgttcaaaatggtgtaggatggtattttggcccatagtaattctcaatcaatgtttaaaagacagaaaaaagttagggtaggtgacacacacctctaattccagcagttgggaagcagaaacaggcagatctctgagtttaaggttagcctcatcttcagagtgagtcccaggatagccacggctacacaatgaaaccctgtcttgaaaatcaagaataagaacaccaccaataactccccccaccgagagagagagagagagagagagagagagagagagagagagagaggagaggagaggagaggagaggagaggagaggagaggagaggagaggagaggagaggagaggagaggagaggagaggagaggagaggagagaagagagaagaatgccccctgtggtggcatgcacctatcattccaacatttgggaagtaaaggcaggaagataatgtatttaagactagcctgggctacatagtgagtttgagactagcttaggctacagaagagcccatcttaaattagaatgactataaaatacatctttatgaggtgtaacacctactatgtaatggactgatggaaactgagtttctgcaagtgacacaatgaaaactgagcatctgactagatggatgcaccctccctccttttccatgttattccaaatacagtaatttctgtaccttgtagcacgtaaaaaagttgaattctaaccttatttcctcatttgagataaaagaattagtgattgtttccaactttatgatcaagataataggggctggagaaatggcccaatgggtaagaactcttgctgctcttacagaggacttagttcagttcccagtacccatagagtagttcataaccacctataactccagttataggagatcagatgcccttttctggcttctgcactacacatggtgcacatacttgtaggtaaaacactcatgcatgctttataaaaaaaaaaaaaaagactaagaacctgattcttcttatgtgagcgaacagcaagaggttttctcttttgttttcagtttgtgcctgattgtgtgtacaaggcttttcagcagagaagatttgctatttttcattatgtaaatctctgtgcatgtatgtacatgccagggcaatgcccataaggtcttagggtcttagaggcttcggatcccttggagctggagttataggcagtttggagctgggaaccaaacctcaagtcgtttgccagagcactgcatgcttaaccactgagctatttctccagctcccaaccggccctttgggggatttgccatacagttcaagtaaggagaattgagaatgtgtgtcttttatttgtttgtaatggatcagcttgccagctttctgtcaaaggtatctcagtgaggaatatgcagtaattcaactttggtcaaccattgtgatcaagatttaaaaaaaaatttttttttttttttttaccaaggtctcgtgcagccaatggtagccttcaacttgatgtactcaactatgaactcaaattctttttgtactcctgcattttccacctgagcgagtgctgggtgggattactagtatatgccaagagtcgtggtttatatattgctggggatggatccctgggctgcaagcatgctaccaactgaactgcatctccaatctttttatttcttatagtttgaagtatatttcttatacttatagggcttaagtagtctacaagagaaatatgaatcaccctcattttcacttctgtatcacaggaggaaatccgtgtggaaatgcaagagcctcagagtccaaacaggctacaactcaccgtgattgctttctttgaagctaagaagctagtgttctcggcttccttgtttaagcaacagtctcaccttgttctctctggatgttcagtgtcagccatctgtcttctgttgcctttctttgttagtttcctctctgtttagtcaactgttagactatttcttaaaacggtagtatctcttttaactcccatttcatcccttgtcattagtgtggcaatgttattttaatgagatggttgtgggaggcatctcctgtctcaaaaatcaaaagtatattttccttatgtatgtggttttctgtgttgttggtgctcctagaatgtaggtaccttagaaagtatctgctgtattaatgaggggaaaagtgcctgaatgattacagggccgagagaaaatgaaaccttgctcttcctattgtctgtccacagccttctgatttatgcataaggctgtttttattatatggatggatgtctgaattgtggaatgataatttttatagttctgcaagattctgaatggtgcaagaataatcagcttgcaatgtattattttcagtttgccgtctgacataaaattcatcaatttattttaatagtcttgctattcaaatcaggagagatttttttttaaaatagggatgtctcagtgttctaatgctatttgttttaagacagggtgtctctatgcagcactgaccagactggttttgaactcagagacccacctgcctctacctcccaaatgctgtgttgttacacttgcttctagtactcttttatttaaaccctaggccattactacttttggaagcatatgaggacagagaaaagtctagtcttttgttctgtgatccttctaccatacctccgtgtctaaaaatgtcaacatttgacacagttttgactgttataaacattattttatatttgaggcactgtagtgttcaagaaatgattttatatgctaatgtgtatggattataccaggaatctaaacatatgtaaatctacatatgcatatggatacatatattaattacaagacaattttaagaattaatttttatgttctgaccatgtgtttctgtgtttactttgtgcgtggttcatgtgttataagagtgcttgcaacttacccaaccaaactcaggttgtcaggccattttgtgagcttccaatcatgtctttaatgacttgtagttatgaaaataactaaaccagttaactactctatgtttctaagtgagtagatatcatattctacagctttgtcttaatagttttgagaaggcttgttcctgataaagcacatctataggagacaatttcaggagcactagaaagaatgtgtcatcagcctggcaccaccaaacaagagggctttgaaggcactttgtatcagagagcaagtaccaaatatggcttcagtaagagatgtaaaaccacaggctttaaaacagcagtccaaaataccctagttcaatgacctattttcttttaaaaagttatccttgttcatggactggaggcagataatggactttttagttttgatccctgtagcgtttggtagattggaacattgcaagctatcatttaagatctagggcaactaaaacctgaaataatgcaggggcagtgacttaaaatgtcactattcattaggtatttactgtgtgtgagctgcttcacattacaatagcattaggtaggtcttatgatgtccaggttatagatgaggaaactgagcctcaatgattctacttgactgtcatatccacatttctacagctactaagtgcagtaaactggatttgaatccaggtctttctaattcagaaacatgtgatgagccattgtactgctaattttactaacttagagataatgatatctactgtgtgtgtgggggtgtgtgtcttaagaacccaacaagatttttataaaaaccctcaatgtgctttgctcaatgtaatagaactgataaggttctatgaaatggaagtctatatgagaagtggaagacaatatactactgtgtatatggctactcttcaaagaaactggagctatttgtacctagttcttagttttctgatgagttttagacataggttttgaaaagtggctcattcgttctatacacccagtggtgtcataaaaagcatggctaattctccctctaggtgagggcagaaagacgactatgcttgaggtgtctatacacacagatgtgttaagactatgcttgaggtgtctatacacacagatgtgttaagactatgcttgaggtgtctatacatacagatgtgttaagactatgcttgaggtgtctatacatacagatgtgtgaagggctctagaattcttttgggcagaatgaggatttcaggatggttctagctacacttttgacattgatgttgtttcttctcttgtttatcatagaaactgggctgctcctccagttaaaggacatcaatcatttcctaatgcaagacattgctttcctgtctggtaagtaacctttatcatgtacttaagggaagataaatgtataaactggtcagcagagttcatttgagatatgtataaatagtttgctatccatatccatatatacacatatataaacacacatatattagattataaaatgttttaataatcatttatatgttgtagatctagttactaaacaagcggacattaagaataattaaggattttaacatttttaatatgtaattaagagcaatcttaatactcttgtgcatttgtctttagacattcacagggtatgtggggaaatatgtgtcttagaagagtgtggggtagatttattaattttttttgtctattcattttttaagatttttaaaaaagatttatttatttattatatgtaagtacactgtagctgtcttcagacaccccagaagcgggcatcagatctcattacggatggttgtgagccaccacgtggttgctgggatttgaactcaggaccttcagaagagcagtcagtgctcttacccgctgagtcatttctccagcccttttgtctattcataagcagagcttcttttttttttttaaaaagatttatttatttatttaatgtaagtacactatagctgtctttagagacaccagaagagggtgtcagatctcattacagatggttgtgagccaccatgtggttgctgagatttgaactcaggacctctgaaagaacagtcagtgttcttcacctctgagccatctttccagccccataaacagagtttcattatgttgccacagcaggtctggaacttgctatgcaaacaaggttggcctcagtctcatagagaaccttctgcttctgcctcacaagtgctgggattaaagttttattccaccacacccacccttttctctttttatacttattacttttatgtgtatggttgttttagtttacaaatatgcatgaattgtctgctcaggtgggcatcagatcccctaaaactggacctgcagatggtttcgggctgccacggatactgagaagcagcccaggatcttctacaagaactgaccatgcttttttttgttttttgttttttttttttggtttttttgagacagggtttctctgtatagctctggctgtcctggaactcactctgtagaccaggctggcctcgaactcagaaatccgcctgcctctgcctcccgagtgctgggattaaaggtgtgtgccaccacgcctggctctgaccatgctttttaatgctaagccatctctccagatcctaatcctttttctttttcttttttattcattaaaaaaaaaaattctggcccagcttgcttgctccggccatatttatttcatctatgtgggtacactgccactgtcttcagacacagcagaagatggtaccagatgcccattagagatagttgtaagccaccatgtggttgctgggaattgaactcaggacctctggaagagcagttggtgcttttgaccactgagccacctctccagcccctccttttgtttaataatggtgttctgatgtaaagcataagaatagggtgatgttggagctgagcctgggttcagcccttacccatttctgaaataagaatgaaagaaagaaagaagaaaagaaagagagaaaaggggagagagagagagagagagagaggaggaggaggaggaggaagaggaggaggaggaggaggaggaggaggaggaggagaagaagaagaagaagaagaagaagaagaagaagaagaagaagaagaagaagaagacgacacacacactggatttagtagtttctgtctggactatattgccatcagatataagaagttactattctgtcatagtaaatttagctctttgatttgatttcatcactgttggtgtttcctagacggtagtcaatttctcatgtttaaagtacttttgctttacttaagtgttctaccactgagctacacttccagtcctctgtgttaccaaaactgtgttctgaatagaaccgtcttcagggctgtctgcctccatccacactcttctcacttttcttttgtctttagcatttttgtgtgtttttttaaatacttctgcttatactttcttttgaagaaaacgtttctaatggacaagcataattaatgcctctacttcccaatttagaatttaaagatcttctttgttcttttattacaggcatactagttatacagtatttgtaggtgctcaatggtaataagcttaatagattaaaatttaatagattagtcagtccgtgataattgacccttagtggaaccatgtatcatttccattaatagaagatgtttgcttaactagtactagcttgtttggaaaaagagaggagaagggaggttagggtagggaaggaagggctgtcctggtttgcttgcttgcttgctccctttctaatgtgtgttttttgtttgtttgtttgttttgttttgtttcgagataggatttctctgtgtagccctggctgtcctggaattcactctgtagaccaggctggcctcgaactcagaaatccgcctgcttctgcctcccaagtgctgagattaaaggcgtgcgtcatcactgcccggccctggtttgctttctattgctgggataagcaccatgaccaaaagcaactggggagatgtgatggttacttatggttcagttctgttcctacagggaaccctggctgatacaggtttatttggcttacaagtcttaagctcagttcatcacggggcagtcagtggagcaggagcagagccagtaaccatgcaggaaaaactgcttactagcttgctttgtaggacttgctcagcttgtgtggggcggcaccgcccacattgtgctggaacctcctacatcaatcattaatcaaagaaaataaaaagcccacaggcatgcccacagacctatggaggcagtttctaaattgagggtccctcttcccaggtgtctcttgtttgtgttgagttggcgaaaaaaaagtaagcagcagagagacagagacagagagacagagaaagacagacacagagagacagagaaagacagagatagagaaatacagaggcagagaaagagagagacagagacagagacagagacagagacagagagagactgttctgttgaggactgagtgggccaagttctctctgccatcacttttatttcatgttttgtagctctagtattaggtacgtaagcattcagggttatgcctccttgataggttgacaacctgaacattatctaatgatcttgaaaagtacttattttacttttaagaaattatgtttgagccgggcgtggtggcgcatgactttaatccgagcacttgggaggcagaggcaggaagatttctgagttcgaggccagcctggtctacagggtgagttccaggacagccagggctatacagagaaaccctgtctcgaaaaaacaaaacaaaacaaaacaacaacaacaacaacaacaacaaaaaccccccaaaacaaaaaaccaaccaaacaaaaaactaaataagaaattatgtttgtttgtgcacattatgtttgtaggtgcctaggaacccctggaacttgagttccaggtgcttgtgagctacgtgacaccagtgctgggaactgaactttgtcagtccctctgccagagcactgtcgacggtgaaaccatctccccagtctctcaaatgtactttgctcaaaaattctttggaggagaggcccttggtcttgtgaagattatatgctccagtctagggggatgccagggccaggaagcgggagtgggtgggttggggaacggagggtgggggtatagggggtttccagagaggaaactagaaaaggggatagcagttgaaatgtaaatgaagaaaatatctaataaaaattattttggacctccttttctatatgaatgttttgtgtgtgtgtatgtatgttcaccatgtgcatacttggtgtctatggagggaagaagaggatgtcaaatcccctgtaacaggagggatagatgattgtgagacaccatgtgggtgctgacatttgaatctctccagcccctgaattttttctttctcccctcccttttatgtttttttttttaagataaggtctctctcatctgtttcttcagccgtatttattatgtgtatcacatgaaaattcctatgttcttattcatctattcctctttgactttctttctttctctttccttccttccttccttcttttctctttctttctttctttctttctttctttctttctttctttctttctttctttctttccttgtgctaaattttacttgttcttttggtttatatggaaattgtgattctcataaaactctgttaccccaaatagccttctagtcatcctctttaaatatgaaaacactcattatgttttgtcacacaaattgataatttggttgatttggttgatttttaggtggccggggaaaggacaatgcttggatcattacatttccagaaaactgtaacttcagatgcataccagaggaagtaattgcaaaagtgctcaattacttgacatctattgcaaggtatgtagtattccactacattctaaaattttgttttatatcaaatttccatttggagattaaacatggagcttgctattgtgaataataacttcacctaaagtaaataaatataagaaaagaggaggctgatagctgcttgtattatgaatatatttagaaatatactgtaaaacatactaaagaaaaatatacaaatatactgaggatctatgtaaacagacatagcactttagaagagctggccctcacaaaatgttgcagacatgtataaaaggatacctttactattcaagagtgaagaaagccatttgtccttttgtccaaggtctacatgtaaagattttatcagcaccaatctttggagctaaagcaggataatttgataataaaatcagttggcaatactatgaaacacttagaagcctccattagaaaaggatttctcaacagtaaggatgcaagtacaaccagtcggaccatttataagatcccagcatctctacagtaagcaagggatttcgcatacaccagtaatcacagcaatgaggagtgggagccaggagagtcttttgctttttttgtttgttttacgaaacagggtttctctgtgtagccctggctgtcctggaactcactctgtagaccaggctggccttgaactcagaaatctgcttgcctctgcctcccgagtgctaggactaaaggtgtgtgccaccactgcctggcaatctttggctttttggtttctagattagccaagaaaatttgagctccaagtttaaggaaaagacctcatctcaaaagaataggtagaaaatgacaggggaggacacgtaatgccctcttacacacacacacacaaaaaatttagatatcatatttatgttgaatcttatctatctgttttttttttaaattttttattaggtattttcctcatttacatttccaatgctatcccaaaagtcccccatacccaccccccactcccctacccacccactcccctttttggccctggtgttcccctgtactggggcatataaagtttgcaagtccaatgggcctctcttttcagtgatagccgactaggccatcttttgatacatatgcagctagagtgaagagctccggggtactggttagttcataatgttgttccacctatagggttgcagatccctttagctccttgggtactttctctagttcctccattggggaccctgtgatccatccattagctgactgtgagcatccacttctgtgtttgctaggctccatatctatctgtttattaatttaagacagggtcacactttgtggccctagctggctggcttagactttcctatgcagaccagactggcttcatatagagttcttcttccagagtactgggattaaaggtctgtgcccccatgcctagccaagataaattttaaagaaagcagtttccatttattaaacctcaaatagaagagtcttatgaacaaaaatcaagttctagaagagtaaatttatattgtacctatggaagcttaaagtatttttagaacaaatcaaagttatattatcctttaaattgccttctcttaaacgcaaagagcagcctgcaatgcaaacaatatattaaactacatatttttcaagtgaaggaaaaaatcattgacagatttttctgtgaagctaagcttgatattaagaaagacactagctattggagtttcctcgtcaccatgatgtgaagaatccaaatccgttattctaacccaggtttatcatagttatttcattttacagacctttcttttgtttatttgtatatgtgtgttttggtgtgaattaatgctgtatttgtatgtgtacatgtgggagccatgaaagggcaatggattccttgaactggaattacaggtagttgtaagcaacttgatgaaggtgctgggaaccaaaccaaactcaggacctcagcaagaggagtaagccctctttctcactgagtcatcggtccagccacctcattttcctaataaaaaaattgaagctagtactgaaaaacaaagtttaaataataaataggagaatatatatatatatatatatatatatacatacatacacatattgttatagagtttttctgtgtagccctggctgtcccagaacccactctgtagatgaggctggcctcaaattcagagatctggctgcctctaccaagtgctgggatcaaaggcatgtgcagctatgcctagcactcctgaacttttttatatctattaacttcattctgaaatctagtttgaaaatcatttttaaacatagcaggttttttcttttggtttattatgagaagagtctcactatatagctctggttgttctggaactctgtagaccaggttgacctcaaactcacagagattagcctgcctcagccttaatgaatgctgggatgaaagtacaacagtactcctgcctaagatagcacttccatatctaaacttgtcttcagttaaagatcatctgtaaaatacataatcataaacaaagacacagaacagataagccttgttactaataaaaattatttttcttctcttataggcaaagtggatctgactcccgatttactattattctagatcgaagactggatacatgggcttccctcaaaatttccctccagaaaatctcagtaagtaccatgcactttgtagtagctactatatatacatacatatgtgtatatatatatatatatatatatatatatatatatatatatgcttatacttaacctttagaaagtatggattacttttatattgatggagacaataggtattgatattgatataatgtgaagggaaagtaggaagaatattttgtgatcttaagtaaagacctcctgccaatctaaatcctagtgggaacaaatgagtaactgatgattcagtttctaagtaagcaaagattgtgcactgttttgtatagctttaaaagaaaggcatacattttatgggaccttttagaaagtggagatagctgacttaggccattcccactagagcaaacgcttgaccaaaatactgaggttactgaagttctgagtcagtactcttttctgctatattatttgttgataaacataaaaaatatactaacacttggagccagatataataacaaagtgaataaggccatccatttcatattcatcatgaatttttccttatttgggaaccctttagtagtggttttctattatttgtttataatagctacttaattataaacaatgcatcttaattgttttttctggtgcggtgatcaaactttctagggaaagcagcagaatggggaaagctcatgattctaggctatatagtctgtcatagcagacaagtcacagtggcaggaacttgaagccactgatcatatatcctcagccagaagaacaaagacgtgaatgtgtacacggtagcgcatagctcactttctccattgtcacataatccaggattccttaccttgggaatgatgcttccccacagtggctcttcccacctcaatgaacacaattaaaataatctgccacagacacatccagaggcccatcactcagagattttagatttttgtcaagttgacacttatcactaaccatcacatagtgaaaagaagataccacagatgtcaaacaatttgctaaggaaaatgacagcactgactgtagctctggtggtagagtgcttgcctacaaagcccgagttccattcccagcactccataagtcatgaatgatggtgcacgcttataatctctgtactcaggagacagaggcaggagaacagacagatcacggtcatagttggctacatagtgaatttaaagccagtctggactatatgacatcctgtctcaaacaatagctatagccaagccttatgagtatggtttcctgctcaaaagcattcatatttattaagtagcactgatacctctatttctttctttctttttttctttctttctttcttttttttttgttgttgggtttttttttgttgttgttttttgtttttgttttttcttttcaagacagggtttctctgtgtagccctggctgtcctggaactcactctgtagaccaggttggtctcaaactcagaaatccgcctgcctctgcctcccaagtgctgggattaaaggcgtggtccaccactgcccggctatacctctatttcttgattaagaactgttatcaggcatcaaatttgtctcatgtatgcttatattaatagatataaaaaggatgtaaaatgcaagtaacttaaaaaaaactgagtaagaattgaaatgtcagccaggcgtagtggcacacacctttaattccagcaattaagatgctgaggcaggtgaatctctgtgagttcaaggctagcatggtctacaaatcaagtccaggatatccagggctacacagagaaaccctgtcttgaaacaaaacaaaaattgaaacttcatgaactctaagttggtgtccttcttacctgctccttttataagtgtttgcatggattatagatacataactaaattcagtggtttttaaaaagctacatttctttggagtgaatatatctgcccttcttgtactattgagttgtgtcaatatggtacaatgcaataaaagctagctcccttttcttatgaacttgaggccagcggagggcaaggacttccttcttgttgccttacggctgttgcccagaagtacattccattttcagcaaacagctataagctcatggtctttttattctcaaagtaccaaattaaacaagatttggggtataggagtttgtggcatgtaatgggctatattgagaccctgtctctaaaatacaaaatacgaggctgaggagatataagagcacgtgtcatgcaagcatgagtacctgagttcaaatccccagaaccaatgtaaaacgctgtggaaacaggagaatcaggggatcttgctggctggtagcctagctcttcgtctatgatagcggtcttaattgagcaaggcagagagagatagggcagtccaccgcaacgccttcttctggcttctgtgcatgcacataggtgtgtgaacagatatgtacttacactcactgaagtaattattttctgttgctgtgataaaaccctttgaccaaagcaagttatcgaagaaagtttatttggggttatggttccagaaggataagagcccactatgacagggaactctgagagatagaggcaagcatggtggcaggaaatggatactgagaactcccatcctgaactgcaagcaagaagagagaacatttggaaacaatgagaggcttgaaactctcaaagcttgccttctgtgacacacttcctccagcacggccattgtcactacgtctccccaaacaatgccaccagctgaagagcaagggtccaaatgcacacgtttatgggggacatactccttcaaaccactgcagtcatacaaaatgaaagaaaacgtttctggagatgtagttggtgaaatggctgttcctggctatcaaattgattgtaaaagtggaaagcactacagaccagaattagagggctcacctgtgacccagatcttgaggctggaagatacaagtttatcacctggaccttggcatggagatcttgaggcaaagtggtcaagaaaagcttaggcccaggcaaagtaatacacatctttaatcccaggagactgaggcaactctgaattcaaggtcagcctgggacaaagcaaatcccagatccaggggtggtggcgcacatctttaatctgggccacaccttctgctggagacgtacataaggacattggaagaaggaagattgaatcttcttcacctggttgcacttacttgccagcacatttacttaaaggtgtacaccaccagaacgtacttctatagaataccagctgaaacaactagcctcatgggactgagcaaccactaggctcttggactacccatgcacagctgaccattgttgggttagttatactacagactgtatgtcattccaaaaagttcccttaatatagagagactatccataagttctgtgactcaaaaaaaaccctgaataatagtcgattagatatttatttttaatatttttatcttatttcttttaaaagattcattttattttaaataatgtatgtatgtgtgtatgtatgtatgtatgtatgtatgtatgtatttctgtttatatatgggtatatgcatatgtgagtgttgttcaaaaagttcaaaagaaaatgttggatcccctgggactggagtaagtggttatgaaccacctggcatgggtgctggtatcatacacattaattatatctcaaccatccctggctggtttcttgacatgtttgaaataaagataactatcgatgagatgaagatgaaattgaactgtaatcagaacatattgtatgaagaaaaatataaatctattttttaaaaaaatgtgatattgaatctgatctcatgaggtaaatttcacattatctaagaactactggtaaaattaaccattgtgtaacatggtctgtttgtgatcaattacgttaacacttgccatttttcttctgctcctagagatggaacctagaatcatatatgtcctaccacttacttactaccccatgtagtctgttgctttcagtaagatcactacatagttcaattgaagaccttagctcacagtttcccaaataaatggatgtaggtaggttaggcatcataattaatgagagaagacatttgaaattattgctgactgacacataataactgtatgtatggggttgaagagatggttcagcagttaagagaactggttgctctttcagagaatccagtgggttcagttcccagcactcacatggcagctcacaaacatctctaactccagttccagtggatttgacctctctcctgacttctgtgggctcctgcatgtggtacacagatttatactcaggctcacatatatgcataaaataaaataaatattaaaaaataattgtggccaggtctggtggtgtatacctttaattctagcccatgggaggcagaggcaggcagatctctgagttcgtggccagccctgtatacagagagttccaagacagccaggggtatatagagaaacctactctcaaaaaaacaaaacaaaacaaaacaaaaccaagaaaaaaattaaaattttgtatgtaccaatgggacaaaatgtgctttcactttcacatacatatacattgggtaatgatgtgactatcacatttaaacatttattatatttctttgtggtaagaacattcaaaatgctctcttttttaactatttagggggaaagttaatttgagtgggaatcttctccatcttaaaaagtttgccttgtgttcttctagattattatcaggattcaactttacaaactgtaacctttctcaatgcttaaatccagaatagaaagtagtaagacaatacagaattgaagtttaagtctcagccagggcaggagaagaggacaagctatcagtaagtaagaactaccttcacaaagaatcttagcattccaccttaaaaaaatctaactacgcagaggcaagccagtcccatctagacagttcttaaggaggagagtaggttttttctctctccctccactcataggacgtgcctgatcttcttgaatagtccagcacaagctaatccacaaggttcaatcaggctaagtagttaggggactgtgttaactctgaattacaatgagcagcagggaaggatctgtcagctgactaatcagggatagtggattttttttttttttccagctctgccgcggtggtaatggaagcagccgccgtagctttgtttgatagagatttttggctgctggttttaaataccacccaagaagcagctcgtatttcatcaatgttgtgttgacaatcggaagagaagagtgtggttgtgtataggcgagatggcagaagcaaatcccccgagaggcaagatgaggttcagaaggaatgcggtaagggctctgcctgcagtcctggaaagcctattcccaagttcaagtgcagggatgctgcagcatagcctcgtgctactgcacaaactgctgagtggggcttttaaggacagaaggggagaatggagtcttggattttcgtgaatggcattgatgtgattactgtggtactggcttagggtgatttaaggaagtggaggaggtagtcatttaaaatctcaatgtcatcaagtttatcagagagtattgttgatcatattatttgttttaagagtacactagcaattaggaattgtttgcctgcatagctttaaagcaccacttaaaagaatatctaacaaaggaatttatgctttttttttggacaagggtcaagtagaatgtgatatcctggatgggtttagaggtgatttcatcagcacttaaaaaggcatccctgctgagctgtcacttcaaaagtggaaacatttaaacatctgtaatgatagggaatttcaaggggaaaactcaagcctacagacaactgttttaagggacagaaaagtgacttgttttccaacataagctaaaatttcaagtccctcctttagtaactttccagaaactttcctgtttacattttcttcattcgtttgttcgttcattcattcatatatatattcatattctaaattattcataaaatttctaacacgatcttccaatttgttttgagaaacattgaaataaccctagctaatctaataacaaactggtcatccacaagtcattaaatgtcaccacacacacacaaacacacacacacacaatgttattgttgtgatgccttaagatacaattattgaggaaacatacaagaatgaaaagcccaaattacttatagaaaaagctcaattaaactaaactcccactgaggacaaggaaaggaaagattacattgttgctgagtggtgtcgagggccaatagttgagtgaatgatttttctgataagggtttttaaaattacacttattttgataaggttatatattcatacctacacatgattttatgttatgaaaataatagctgtagacttttgacaatttatgatgcatgtaaaatgtctgtgtatatgtttttgcaatagtgtatggggctgacattagcagttttattatcaaaggtgccttgacttcaccttttggaaagtttgtaattcttttctgtacatacatctttaaaatgctgagcttactcttatatataaatgcttccacatacacataaatgcagtacacaggtatcgattgaataggtatatcttcattatgctacctaggacagcagtttcaatgggaaatatgtaacaattactgggcaaaggcactctcagtatagcagagaggtaaagtatatttgtaaatatatagttcaaaagaacttgaagctggaagtgggtcaggtgttccatggaagatgtgtttgtttgcacacatgtcactacatgtgtttctgttaggcttccctgatttttcccatgaattttatttctgtcaaatgaattcctttaagaggccccctaggaacagatatcttaaatgcaattgattgaattgatttttgaagcctagagctacagttgtaggaaagtttgctttgcttactagagtgaacatttgggccctccagttagtgacaaaatggcttaattgggaagaatttttggatttggcctgcttctggaggttatgatagagtgaacaagatggtctagtagaatgtgaaatctcaagagaggattaaactgattatctggtagaaatcgaatgattagctgagtgacaaggaggagattagaagtgatacgtgtgataaaatgagcaaaccacaaggaaggggtattgctcaggaccgcctgctccccagggctcttggcaagttccttggcaacacttggagtaactcatatgttctgtactcttgaagagtggggatgagaagggatggggaagtaagcatagaaaactcttctctgtagctctgggtaatggagttttcccatgacattattttcagtcatgatattagagtatatcagcttccattccatgggctacatgatgctaaactgttttttataacttcagaaattgctgctgatcccatttttgtagagtcaaatgatttcatttctcaatttcaaagagtaaatctgtgtttttgtgtgtgtgtatacatatatatgtatatacacacacacatatatatgtatatatacaaatgaaaggttaagtgtccatcagaagctatatatgatgtatataggccttagcaccactgtttacctgctgggcttcaatttgtccatcagaaagaagggataatatctactgtgatccagtagtaggaagaccaaattgaacagtataacaagcctatgatgtaggtaaagcttttcaggatcctgaatattactgtctttttttgcctgaaaggttaaaaaagaaatgttatagggatagaaactgctttttaagaaaatagtaattaagcaaaagtttagttatgtaacatattttgaacatttccaaagaaataactagagaggctggagagatgtcttaatggttaagactactggctgctcttctagaacacaccagtttggtttctagcacttacagggtgcctcacaaccatttgtaattccagttctggagaatcctatgccctcatctatcctttgcagacattcatgcaggtaaaatgtccatattatttaaaaaaaaaagaaaaagaaatacttaacaatttcataggatgagcgaattgcctcccttatcacacagaagaatatttaataactttacttttagggcgttaatagttaaatgtagtatcaagcttatgcctcactgaaagaccatgaacagttctgaggttggtatgagtcaaggcaagaaaatctgttctctaggaggggaagatagtagagaatatgttttctgtctgttttcttgaagaaccaggaaatgtggcagacagctgtgttggggctgttagcagtgattggacacatgacagtggcagtgggcaacatgttcctgttacagatacgtgcatttaattaataacgtcacatgttagaatctcaaaagataaaaatgtctaaaagaaactcaaaccaggtgctgagtcttctcagttttatcgttcttttgtttgattttcaaagaagaaacaaattaagactgacctaggactattttttgttgtttgggcaagttcttaaaaagaatgtatggatttagaatgtagtttaattttagagaaaatagaaattgtgcctttgcatgtttatataaccatacagattagatactcttaaagcatttggaaaggctgtattactaaaacttggcggtcatagcctgtgattgctgtcctctctatatctgttataatatgctgttcaatttttttccttcatttgagaagcattctttctacttaactattctaagtactggttgcaaatgcctttctagtacaaaatcattcctggggattatgaaagggaagttcttcttagaaatttttcaatctagtgtagaaggagagaaatttcaaagacataattttaaaagaaactgcaccatgacaacacgagtagttctttttttgcctatagatttatacttgctctttgtttcactgtagaatgattctgaaattatctttgaagatattatattaaattaatagtctcaaacttagtagatgcttgagggcaatatctatacagctactcaacaagtgagttctgtcaaacagttcatctgatttatcagttatttgtttcataaaattgaagcatgcagttcagagcaggcatatcagttatattttctgggctcacacaaatcaagtacactgagttttcagtcttagtcccagagtcttaatcagtcctgagcatctgcttggcaaattttcctgtaaaaagtgaatgtacaactttacacaaatactgttcacaaaccctcttttttcagattatgtttttgttgttttatgatcatggggaatgaactcaagacctcatgcatactaggaaagcattgtaaattcttagcatatatactctaacaaatgaacaactaaacaaaaatacatataaagcagatatattttaagagattcttttcaggactcaaagccttaagtgtgtaagggtaggagtatttatatttatttaatgcttattctgaaactcgcattcacagtgaacattatctttcaaaagatttatttatttttatttaaatgagtacactatagctgccttcagacactccagaagagggcattggattccagtacaaatggttgtgagctaccatgtggttgctggaaattgaactcaggacctctggaagaacagtcagtgatcttaaccgctgagccatctctccagccccaacaatgaacattttgtaagtacattgtagctgttttcagacacaccagaagagggcatcagatttcattacagatggttgtgagccactatgtggttgctgggatttgaacttgggacctttagaagagcagtcagtcctcttaatcactgaaccattattaaaacactgtgctaacttcttaacatgaggttctatttccatctccatttaacaactggagaatctgagtgtagtgagcaggataatcaacctctgtgtgtctatgccttgatcccctgaacctatgaataggctacctgacatggtaaacggaattttatagtgtgacaaagaatcttgaggaggccaggattgcatctcaggtggtagactgcctgtgtagcaatgacctggttatacccagcagtaacatgaactcaatgtggtagcacatacctgtattagggagttagaggcagaaaggtcagaagttcaaggtacaaaattcaaagggaacgtgggatatatgggaccctaagcttgagaataaaggattcttgagattgggagatgatgcaaaatttccaaggcatgatttgtatcaagacaaggatgttcattatcaaagagatacgagttggagtgttactctgtagtaaagatcttatctggcatgtgggaggccttgagtttcatcctgagttatcttttaaaaggaaaggaagtagagaaagcatcggaaaagatgcatgacagaagtggaggtcaaaccattgaaaggccataaaccacagaggtgatggactgtccctagaaactaaaaatggtcaggcaatagattcttagctagagctcctagaaggaacacatcctagagatgccttccttgattttaattcagtggcgctaaccttgaattcctgaccttcagaagcacagtaaaaatttgtgttgttttaaatcactaaactttagtaattgcttatagtatcaatatggaggctgtacacagagttttatcaagtacaaacaagaaatataatcaaaaccctagttcacctgactgcaaaaccagactctagcaacagggaaacattggagaagcataatagggatggtatcactttatagttcactccctaaacttgagatgcgaagtaaaggtgacaaatctaaatgtgtacactgcatgtgaggaagacaatggagctgggaagtagtgggggtttagttaaaatacaacctaaagagtagcaaatgttcaccagcacacatcccttatgttgaggagcagcaggaattggaaatggtgagcactgtggtgaactagagagcatccaaaaatggggcactgaccagcccgctcagtcaagtgtcatcatgttgggaaaatgggcccaagcactatctaatctttgatttctcacaagtaacaagaaatccaactcctacatgatacccgtggttttagtttactccatttttaatattttatatattcttaatttgtgtatgtttgtgtggggtgtgtgtgtgtgtgtgtgtgtgtgtgtgtgtgtgtgtgtgtgtacatacgtacgtgcatgtacaagtgtactcagaggccataagagggcattgaatttattggaagttggagctacagatagttgtaagctgtctgatacagattgtgagaactgaatttgggtcctctgggagaacagccagtgctcttaatcactgaactatttcggatgcagcactccctccctccctccctccctccctccctccctccctccctccctccctcccttccttccttccttccttcctttctcactatatagccctggctggcctggagcttgctatatagacaaacctgtcctttatcttacagacatctaggtttttaaaatttttgagattttgtttgtattttatgtgtatgaatgtttatcagaatgtacttttatgcaccatatgcatgcagtacatgcaatacctaaggtgaccagaagaagttaacagatcctctgggagtagactttcagaaggttgtgatctgtttgatttgagtgctgggaatcagacttggatcctctggaagatcagtcagtgctcttcactgctgtctcatttctccagccctgagatctaggttttataccccagtaatgttattcttttttttaaaatagactttttatagagtatttttaactgctgaattaaactgaacagggggctctcaggaactcacggttaattttgttttatagctttgttcaattgccagtggtgtattatacttacaatgaatatacttgaagtgtttttctatagttcgctttgctatgctttaatctctcttgaggctgatgactggactcccagactagacctttcctgcccctccttccctgaagatagctaatgtatagatgtcatgagaaggccttgtgggctcttccaacatgcaatatctacagaaaggaaccagaatcttgccttccatcctataacatgcttcgtttttgttcccatctgggttactcaaatctcaaatcttgggatggattgcactgattaaatgtatattaaatcatgttttaatgatgctacttcttgggagtttttcctgcctcctgccactttcctgcctcctgccacattttgctctggttcaggatcagacttgattttaaagtatgtactgttttccacagttatagcaagtctccttctacttatgtctgaattcagttctttctcaaggctcatgatacctttctaagcatggctaggaatgtagtaccatagtagaacacttctatagatctctaggttcaattcttagcacaagaaaaatttaaaataaaataaaatgcatatctgaccatggtgctctggtattcaaaatgtcctagaaatttctttcacttctaaggggaaaaacaaacatcaaactcactcctgttgtggttcttgcctacttctccaccaccttttccctccaacatctgtttccttcacatttcttgattgagaatcttcaaaaggtgaggtagtttaatgactacggctccagagttagcacaagccagggctatataagttatgcttaaacactatgagcttcactttatttgtaaaaggggcaagttaactccttcactgaactatgctgaagtagaattaaaagtgttggcaaaatatttggcatagcgtaggcatttaatatgtggtggtatattaatattgggccattatttttcctttcattgctaatcttgcatagtatcctctattcctttactttgaaattcctttatgtagtaattattttttcactgctatgaatgattgcctttaactgtcaatttgatacaatctaccatcctttgggaagagagtctcaatgagacctagggaagactgctaatatgggaagatcatcctcactgtagatgccatcattccctcgacagctgatccttagaggagaaaaatgagctgagaaaacatccaagggtgatatgttctgctcttgatatggatgggacaagttccctcatgttcttttggctatgagtctttccccgactccatgatagattgcgaactaaaatgaaccctaaaccctaagtcagttttggacagaatattttattacagaagtaaaagctagaacaactgcctatgtatgccagcctttttttcccctagaagctgagcaaatactgaaattaggatggcattttgattcaattaattcctcttttcttcctcaaaccccttttggccatcctgtttctcacaggctttgtgatattgcttcctcatgtactttactctaattattttgtttctttttttttttaacttactctgctgtactattactgattactaataaacttggttattgaaagtgcttgatattatttcattttaatgtatggagtgaacacatagtgacaaaaatgggacttaattggatgaaagcaaaattgtggttctgtgatgtagttttcactcattgtttagggtagatagacaacatttcagttctggttggctttttgggctaggacttgtctcctaattctgtttttagaaattattttaaagtttattgttattatgatgtgtatgtggattttatgcatgtgagcagctgacaactctgtggagtcagcttttgtaggtcttggggattgacctcaggtcaccagtcttgcacagcaagttcctttacttgctgagccatttggctggcccactatctgttttcatttatacgggaaatagaagtaatttgacttcaaattcagcaaatccacgctataaaagcaaacacataaactaatgaaattaaacagaacccagaatttattgtcaactgatcttcaacaaaaagatccaagagaacatgtaataaatgggattggggatatacatataacaatgaagctaatttcctatcactgtcaaaaattaactcaaattggatcatggacacaaaaacaataacccaaaactataaactattaacaatagcagaaattataggaggagttcttaaatgaattggtatcagttttaggtatacctaaaactgcagaccccaaagcataagtaggcaaccaagattaaatcaatgaaaagaacttttgtacatccaaggaaacaatgaacataatgaatggatagcctacagggtagaggagttgtaatctagcaacatggctgctctgatcacattcaaagaccttctaggtctctatgatacagctggaatgctgacatgcccttagtacacacctttaatttttctggctggaatcctttagtacatacctttaatctgaatcaatggcctctaattgagtggcagacaaagtgatgaatcagagatagatttgacagaatgagtcagagaaatcacacatccaactctcaggagaaaagctatttaagagcagctcagggagaatgaagatgggttggtcagtccatagggagtcagcacagtgaatgcagtgcagtggaattgagatcacttgtgagtccatgaagttcaagtcatacagcagaggcagttgaagccagagaataagaaggagccagaagattaggcacattgccagagtttgaggtcacacagagcaattcagtgaaagacagatagaagccaaattcaatcaatcagcttggtgagaagtttgagccagaagagccgagttgaaccagccatctagagttcagaaagaactagaaagtgggagcttatttggaagtagccctctgagataacaattacatctggctaataaaagttactacaaatgagaataatatttgtaaactgttcactgaggggctaatacctagattattaaaaaaaaaaccctcaataggaaaacaaaacaaaacagttctcaaaagccaaatctaattaataatgggcaaatgatctcaatgacatttcttaaaagaagttatacaaatatccaataggtatataaacatgctcagcataactaatgagggactttcacagcaaaatcacaaggttagaatggctaatatgcttaagaccgaaaccagcatgctaggaaagaaaaagagagaagagaccccttgtacatggtaagaatgcgaatcaatacagtcattattgaaaacagtttcttcacagaaaattgaatatataattaatgtttaatccgacaaccccacttatggtatatccaagaaactgaaatgaatatatcaaaggaatacctgcatatccatgttgattgcaatacaatctacgacaggcaacgtgtggaaccatgcaagatgatgatccattgatgaaaagataaaatgttgtttacacacattaaaactgcaaaataccatccattgttttttggtagcatggatagaactggagatggaaattgtattgagtaaaatgagacaggcatagaaagagagccaattccatatttcactcattggtagaggctacaaaggttgatcctattgaagtcgaatgtattgtataggaaggggaagggagagggggaagagacacacagtgaggttggataataggtactaaccagtgtacagttaaagaggaggaaggagtttggggtcctaaaaggcagtgttaattatactctgtaattacaagataactacaagagtttgaaaattcctaacacagaaatgctgatgtttgaggtaaaggaaatgctaattaacttgatttgattagtatgcattatatgtatatatcaaattataatggcataacacgcaaataggtacaaatatttaattactcaaatattgtaattattaataataaagaaaactttaaaagcaaaactaacttcaagataaaactttagagtctaattatttgcagcttaagacctgcttatgtcctgtgagaaaaattccatactggggacattataaggatctggcctatgttatttttatttctgtttccatgtttttagatattatcagcatccatttaaacatgttgacctcttactgacttctctaacttaaaagtttgcttcctccaatgacatattttctgatttgtgctcagttgggagttggtgtgcccgcttactcttctatttcttgctccaggcctccttccctgggagcttacacttagtcctggttttgcgtcctaccagttttcttcaacggactttcacggacattggatttcgatttagccaggaggattttatgctgaaattaccagtaagattattgcttgaatcttttatccttctactgcttatatagtctgtatcttatattgtttgttttatatgtgtctatgtaacacttaaaatttgtctctcaaaaatttaactctgcaatgtcctacaacaatctgtttttaatctgttgttaaacagggcaacttataacaatgaattcctttaaaaatctttgctatgtgttatagatgtgtgcatatgtgtgagtatgattacgaatttttattttcagttaacattgtgtggtttgtgtatctgaaatgccatgatcctaagctagctcagagcactgtggtctttattttgaaaatatatctttatatgtttttattatttgacatagagtgctcataaaatttaatacctgaattgtaacttactacacaaagttcctttgctttgttctgagcactgaaattgttgtgtgtatgtgtgcatgtgtatatgtgaatgccaaatttctcataagtaatgaaagcttttagacaaagaagaattaggtgttttggtttctgttgaagttaattttggttgatagagatgttttgtaaataaaactttggtttctgaagaaagttaatgcatccaggtgtgggggcatgcacaggacagaactgtttgaagcatttataccagataacagtctgctaagtatttattgaaattcattttgcagtttgatagagggctgtcatgaaggacagttaacagtgtctttcttgcttattcacataggttgttatgctgagctcagttagtgatttgctgacatacattgatgacaagcagttaacccctgagttaggcggcaccttgcagtactgccacagtgaatggatcatcttcagaaatgtatgtgcttctgcccttactgtagagcctatccttcattttctctagacatttttcctacttgggaaaagcagatttttgggtctccaagtgttcaaatgcatatatcattcaacattttggttttcttctctaagagatatctagaaatgatagagtcattaaggatagcaattgaaggagaggcttagtgaaaaagaaaggattctctctctgcccagttcttcctgtgatcatgcagtaacacagagacaaagggcttgggttcaaatcctggcactgctgagttatgtcttagatcttagacaatatataccacctcaccaagtctttttataactataaaatgatactgatagtatatcataaggatcttgggaaggatcaatgagaaaatgaataaaaaagttttgcttattgcttggtatatgggagatgctcagaaaatacaagtatatttatttcagcctagatgtgtggcactcccacagctattagactagatagaatcctgtttttggagattttagaagaggtaagggctgtggcctcttaggtattataaagcctatgatgtaagtgtcttaactttcaatcacatgatctgaaaactcttctgaagaaaataatgatggtcactaaattagggtcacatttcctagtccttattcaaactgagtgtttggcaggttcattcagcaattcaggtgttcgcatgaaggttaactgttagagcaagcaatggcttgacctaaataatcttcaaagcctaaacgaatgagcaaatattttgagattcatgcctaacagatggtttatattgtgtctgtgttttcccctgtcttcctgtggtggatttattttggaaacaaaatagtgcagccatccttgccattttagggcaatagcacttttgggatcgcagtttcagatctttggcagtacctgcaatgaattgttgtgacaacttgttctccagttccttagatcatatgcttttgtggagtgctgatcacaaatgctaataaatatcaacttacagcactgttctcatgtctctttagaagtgaacttttttttttttttttggttttcccgagacagggtttctctgtatagccctggctgtcctggaactcacttcgtagaccaggcttacctcgaattcagacttacctcgaattcagaaatccgcctgcctctgcctcccgagtgctgggattaaaggcgtgagccacaacgcccggctgagaagtgaacctataaagcagtttggctgagtgctgagtttgataaagtaagaaagacactgatggtcaaggccatatagaaaattactcagcacatggtgccatttagaaatagtttccacgagtgttcaaggaacaagtccagaaatgtagaagtgtacactcaaggatttttgacactaatttttagaatcttaggggttttgatgcagagttagtcctaactgtcaggggtagtgccaacttttcttagaggagttcgtagagtacatgtttgttgtttatacatatgtaaagaacaatccaaattactgatccaaagtttgatatgttgtcagagtttccatcaaagatcccctggatttttacaggccatagagaagtttgctgtcacagtgaaagaaatggctcagatgttgcaatcctttggaacagaattggctgaaacagagctaccacaggatatcctttcaatagaagagattctggcaggtcgagccgaaaggtatcacctgttgaaggtatgtatcctctcttctcttctcttctcttctcttctcttctcccctctcccctctcccctctcccctcacccctgtctcccgtctcccctcacccctgtctcccgtctcccctcccctcccctccccgctccctctcccctctcctctcctctcctctccccttcccttcccttcccttcccttcccttcccttctccttctccttctccttctccttctccttctccttctccttctccttctccttctccttctccttctccttctccttctccttctccttctccttctccttctccttctccttctccttctccttctccttctcctttcctttcctttcctttcctttccttcccttcccttccctttcttttcttttcttttcttttcttttcttttcttttcttttctgtatcaggaagggaacccagggcctcctgaatgttagacaaatactctgtcactaagctgtgattctttgtgaactaggctctcatcatgttctccagaataacctgaaagtcactaggtagcccaggatgacttcaaactttgaatccttttccctgcatctcccgagttctgtgatttcaggtatacaccatcacaccgtgctgcttggccttggttgttcatgctgatttttacctagggaaatggaaaatacattgaaaatattttttttcttttatttttatatgggtgttttgcctgtatgtatgtctgtaccccacatgtgtgcttggtgcccgaagaggccagagcgggtatcagattccctgggattgaagttataggtgattatcagctggcatgtgtgtgctaggaagtaaacttggatcctctgcaagagaggcaagtgctcctaactgttgaggcatctctccagtcccttgtggaattgattttgttctgtctgtggtaggtaggaaagaaatggttctgacaatttagaggtccttttctcaaaatattggggaacaatttgaacaaggaaaatcagacatctgagtattatttttctccctcacccataatatgtaagttgggtgccaaggcagttttgcattttatatagggtgatatgttttaattaaaatgtgaggaaccaaatgtttgcatcataatttttgatgatgattctcatgatggttcctgactattgtggtggtggttgtttagggtttcttgtagcttaggcggctgtttgtttttttttttttttttttttccgagacagggtttctctgtgtagccttggctgtcctggaactcactttgtagactaggctggcctcgaactcagaaatccacctgcttctgcctcctgagtactgggattaaaggcatgcgccaccatgcccggctaggctgactgttaactcacaactgtagctgtccttgaactcttgattttcatgaccagttataagcatgttccaccagcaatggcttggcttgcatggccaatttatatgcagccgtagggatgatgtagtgagatatggatatagtgtatatgtaatatgttttttttttaatttttttttattaggtattttcctcgtttacattttcaatgctatcccaaaggtcccccatacccacctccccaatcccctacccacccactccccctttttggccctggcgttcccctgtactggggcatataaagtttgcaagtccaatgggcctctctttgcagtgatggccgactaggccatcttttgatacatatgcagctagagtcaagagttctggggtactggttagttcatattgttgttccacctatagggttgcagttccctttagctccttgggtaatttctctagctcctccattgggggccgtgtgacccatccaatagctgactgtgatcatccacttctgtgtttgctaggccccggcatagtctcacaagagagagctatatctgggtcctttcagcaaaatcttgctagtgtatgcaatggaaggagttacggagacaaaatttggagctgtgacgaaaggatggaccatctagtgattgccatatgcagggatccatcacataatcagcttccaaatgctgacaccattgcaatgtttttaacacacagtttatgcttcattaatgttagttttatttttaaaatattttaattttcttggtgctgggaattaaacttagagcctcccccttgctaattacataccattgccacactatctttttttttgttgttgttgacaaatgtctactcataaccttttaagtcccttggaccttctgaagaaaatcttggatcatgtagataaaggaaaaaagaaaaagaaaggtatatggttctttctcagtatgtattaaatctaccttgtagcttcatgctttctgatattgtagtcgttactgtgttagtatggtttcatctgagcacataaaatattatcaaaatagaacaagattggttagaataacatctttggcctccgtttctaacacgtatttcactgtcatgagctataggaaactaagttgtaggatctttttgaaggccatctgtaggaatgagacatcattttggagatgttagaaaaatgtctatcaagaatgatatataatgggggctcagatacatattgagttttaggcgagcctattctacatcagtccctgttgaaaaggcaggatcttctttgagtctcctgtttctgtcagtggccacagcctgtatgtgcaggtgagtgtagggaaagcagaagatggttttgttcctcattcatccaccctgtttttaatttgtttattttattattattattttttaacacatatggagttttccttgcctatttagacactatattcattcactggccatagagactagaagagtgtgtcagttcccttgcaactaactgaaaatagacagctgtgagccaccatttgagtgttgggaatcaaactcaggtcatctagaagagtagccagtactgttaaccactgaaccatctttccagcttcccaccttattttttttctgagacagactttctcagtggcctagaaccaagtaggctctgctggctgactagtgagccccaaggatctgcgtagacctactcccccggcacagatattatgagtgtacaccattatacctggcttttaaaaaaggatgcattttggatatggaacacaggttttcatgcttcaaggggaagtacttttatcaactcagccatctccctggctacagagtgtcacattcgcagattctttgaccttgaaatcctgtaaaagccaaggaaggctgtgctagaagcgcttctgtctcctgggccatgcatcttccatagctgtatatctcttcaagccattcgtgttccattatgaactaactggctaacataccctgccgtgccttcctatagaatgacttaactgctgtaaccaaagaaggaaaagttctgctcatgaacctgcaagtgcctgccactgaagaaactgtcagttcaagccttgaatgtactcagcacataaatggcgactggcaaactattaaaaagtaagcactcccttcttttaaaagtcacttatattttcaaactaggaattttacattgtttgttgctgttaggtatgaaagtatttctggacctctggaagtctgggaacttcttgtctgggttagtctgcagacagtagttcgcttgcagaattaagttccccagacattgatttttctttgcctgagccaagtgtcatagtgtcatagactatttttgcttataattctttttttcctgtttttgagaaaggatcttaccatgtaactctagctggcctagaacttcatacaaattggactagacttaagcctacagacatctgtgttcctttacatcattactactggattagaggcgtagcaccatgactggtctttgcctataattcattcttttttttttctttctttctttctctcttgttcctatagaggacatttattttgacttgcagtctccgagatttcagtccttgctcacgtgaccctgtcactttgggcccttggcaggacagtagatcctcttggttgggaatgttttaactcttaattagcagcttagggttagctctatacctgcatccacaagcggttatttctaaggaattctttgccttctgtttatcaaggttgctggctcaggtgcatgatatggaaactgcttttgatggattttgggaaaaacatcagctgaaaatggagcagtatctgcaactgtggaagtttgaacaagactttcaagaggttagttaacacagttccttccttgtggtggaggccctcattcatgagcttagaaggggcaggcttcttacaagatgccagttttcagctccttgacttggaacaaagaaaatcttggctaactcccaaagccttcacttcgtccactgagacaaagcactgacatgccatttagtatgacaaggacattctttctctaccttcatgatcattctttaaactttttttttttttttttttggttttgcgagacagggtttctctgtatagccctggctgtcctggaagtcactctgtagaccaggctatataaagtgcttttaggctataacatcgttttctaagaaagtgatacctattgattgtcacataccatgtaccataggtattgccattttcacctaaacattttatttttttcttacagtaagaacattgtcttacagaatcgttgttcagttatcaaaatcactgcgttcaatggcagtataagacctttatgttacctgacatcatgattctaattctatcagttaacctaataatgcccttaaaaccaccaccaactcacacatgcacacacacacacacacacacacacacacacacacacacacatcataaaaaatggcccatcttggtttttgagactaggtttctcattggctgtctggtcagagccttatgtatccttctatctccacctcttcttcactgggattataaacacacagcgccatgccagacttttacaaatatgggttctgagtattgaatttaggtcatatctgtgtgataagcacttttactggctgagctattgccccatatctcattgctattctttttttttaagtgattttgttttaaaagatgattttatttgtttatttatttattaattcattcgtgtgtgtgtgtgtgtgtgtgtacctgcataatcttatctacagcacatttgtggatatgcctgtggagatcagagagtgttgtatctcctggagcaggaattacgggtggtaatgagtagtagcctggtatggatgctatggatcaaacccaggccctctgcatgagcagttagcattcttactgctcagccatctctgtagtctataaaggattgacaaagaggtttatttatttgttgtttgttttgagacaaactctcattcatagccttggctggcctagaacttactatatacaccaggctagactggaactcacagagatcatcctacttctgtctcttgagttactgagattaaaggtatgagttactgggctggagagatggctcagaggttaagagcactgactgctcttcccagcaaccacatggtggctcacaaccatctgtaacagaatctgatgctctcttctggtgtgtctgaagacagctacagtgtactaatcatatatatcaaataaataaataaatctttaaaaaaagacttgcaaaaaaaaggtatgtgttactataccagactaaaaacatttgtttttattattctaaaattgtgtgtatttggatatgtgggtatgtgtaaatcagtgcaggtgcctgtgaggtctttgttaacctctgagccatctcaccagcctttgtcttccaatgctattctgaacttctttgatatttcaaactggctactctagtctcatgatatttgtcaggattagaaaaaaatttatctccttcctttcttgagtgattcaagctcatcttgtgtgtgttctgtcttagtctcttagtctgtcttggttactttttatgggaaatggtatcaaagatgaagctatgggtggaaggtgtgctccttgctactggagtttcttgtttctagggccagttactacatagctggggaaagcatatgcacatatatacaagtatgtatatgtgtgtgtatatgcatttatgcaagtatgttcatatatatgactgcacatttatttacacagtgatcttatataaatcctgtgtgcatggatatctatgaggctatgaataaaatagctgaacatattctctatgtgtgtaattttcttatattggcattctcatttaatagcatttcttatttaatgtgatcattactaaaagtgaatgcttaataattcacatcctcttaaaacctttatttcttgcttctaggctgtgactcaagttgaatttttattaagtcaacaaagagaactgggtgatataacagggaacttagctcaagtaaaacaaagacttaaaaaactagagatcttagatgataaatctcaggtaagataacattttaatgtttgtttatgtttcactagggcttagtaaaaatgtttattatacttagcctctcataactatataattaacacaatcatattaacctaaaatccattgtaagtgtggccctatggagatagtgcagatgcatcatgaagctatagggaactattaagttgtaggatctgtttaaaagctgtctgtaggaaggagatgttaggaaaaaaaccctctatcaagaatgatatataatagggtctcagatacatagtgagttttaggctagcctactctacatgggattctgtctcaaaaaaaaagtttttggtatctggaaattatgaaataagactatgcattgtttaatatctatcatgatacatacagttgaatccattatagacccacacagacagctctacttaggctgactagcaggtaaaatggcctaggaagagcttagcatagctcctggatatatatgtactcaaaggaaaagtagttgtcagctttcttgttcattctaaagtgtagattcatgactttagtacttagtaaactgcctttgctctcctgtcttgtataccacagcaaagcaatgcttttatagatatgttcttagaaaacagactcatgagtgaaccatgaacatgtgcaaatgaaacttacaggctaggggttgcagtaacaagtaaaattattagactttcagactctgatcacaatccacacctccctttgacagcatggaaagagaaggtgaactgatttggaagccagggcctttgttttttttaataacttttcccaatgtgatttaagacgtatggcacagaacttgtcatttgaagcattcagttcagtagttgtcctagtttctgtcccattattgtgacaaaacactctgagcaaaggccgctttggggaagaaaggtctatttggcttaaagtttgagatcacagtccatctttaagggaggacaaggcaggaacctgaagaaaatatcatgagagactgttgctttctagcttccttactggcttgtgctcagctagatttttatacagctcaggaccagctgcctagggatggtgctgaccagggtagtctgggtcttcctacatcaatcactaatcaagacatccttcacaaccatgcccagaggccaatctgatctaagaaagtcctaagttgaagctttcagtccactctaggctgtgtcaagttggcaagtcaaactaactaaacagtagtggtcctcactctgtagtggttcatgaccattctaagggtcatatgaccgtttttacaggggttatatatcagaagttctgtatgtcaaatatttacattatgagctgtaacagtagcaaaatgacagttataaagtagcaatgaaattaattttatggttgggggtcaccactacatgaggaactgcattaaagggtgacagcattaggaaggttgagaaccgccactctagtctatttaaaaatcaattctctactgtaattgtgtgtttcccaatagctaggaaggccagtcccacgctcagctgggcttcaatttgctttattttgctttgggaaacatgtatgttcctactagttttcagtcactgttctattctatcagtagttgatagaatggatgtagggccatgagagtcccttctgatattcactttaggtatgtcagaggcactcaggtaagagggggcactggaattgacatagaaatgtattagtttttattttccaggcgtttactttacattgggttctctgtgtgtttttgttttacatctgtgcacattagaaggcactctttatatcctgagtggaatcaagtgattgactttcattttatactcagaaatttgtgtgcttctgatagtcactgctataactcatcaatatcactgtaagatttttgtgtgtgttttcttttgttgaatgcagaaaaacggcaaggaaatcaatcatgttttgtgaccatatcccctgccaaatgtgttctttaatgattctttccccttgctctcccccctcccacctgttgtatgagcagagatcttacaattatgatttttctctcctctttcaaatcaggaactgttaaccaaggcccggattgtgatactacgtggccacaagctggcatcgaatcaccactatgcacttgatttaatttgccagcgatgcaatgaactacgctacctttctgatattttagttaatgagatcagaacaaagcgggtccaactgagcaggactttcaaagtgcatagactcttacagcaggtaatatga

SEQ ID NO: 614 - DNA, 82325 bp, mus musculus
gttgcctttggaaagggcctcccgcgggttccccttccgttctgcctggcgacttccgctctcggcccagcaacatggacgctataacccgccggccgggcggccgctgagcagtcgcggaagcttccccacttgagtggcggccggcccgcctctctgccctcccgccccacgctcgcctccctgcggccggccggcccggccctacatgggggcgggcctccgcagcttgggctcggcttcctgttcagaggcggcctggcgctaggcggcggccactctgcccgcgcccgcctcggtgcggtcaccgagcccgggaggaggctccagggccgcatctcaggcggttgccccgagccgggctgtacgccgccatggccccagtgcagctggacaaccaccagctgatccctcctggcggcggcggtggcagcagcggcggcggaggcagcagcagcggctccgcgtctgccccggctcccccgccgcccgcagccgctgtggcggcggcagctgcggcggcagctagccctggataccggcttagcacgctcatcgaatttctgctccaccgggcctactcggagcttatggtgttgacggacttgtaagtgctgcgaacccatgcctgcttcccggctcctcacttgcccttcccgccttcaagagaggcttatgcttgccatttactgagctaggctgctgagcgtagaatttggaaattcatggggtttaggttctggggacagggaggaggtaactattggggatctggttgacgatgaaagcacggagactggttagtttcgcatgttaacacttgcgctgaagattgtctttgggatttttgtcttgagttcccaacagaagtgtattaatttctatgtggaatattttctaaaaacctaagtcgaagagtaagcattgaggactacgtagaattcgaactgaacgggattttcaacgaagggaaatgttttacatcttttttgacaatgttttaaatgaaggttgcaattgtttctcttaaaatgccggaggtcgattctgtgtaaaacaattacattataaattctgattctttctgcaacatttgaaagcgtgttaagtctttatggatgtagtgaaagtagaatactttttttctaatgagcctccgggtttcagtctagttacctatgaaatgccttggggcgtgattagggtgttaataccttcagagtacaagccgactacacggatggttcactatgtgaataaaaggtactaggaaaatttgaaactctttagcatcttctacctgaggtccataaaagttttctttttacctattgttaggctccctcaggtttccagggaaatacgttagtatgtagacgctaggatgtatcttgcaatactttgttactggagaattacattgtacatgactaaaagaattagggcgggcttcacttactcttgtaaaacattccctttcagttttgatgtacaatattttattgaatgagacaaagcttaaccttatcaaaagtggtggcggtattactattctccttactattgagacggggtcttcctgtgtaatcgggctggtcgctaaccttcagttctggctcagccgctttagtgttgggattacaagtatgagccactacacctggctgagattttttttttttaacacacgatttcctcatctagtaagagctaggattacaggtgtgtgtacgtccctcaccccgtatggcttctgactgagtgatctgtcaagcttagttcttgtagtaatgtacgtatattgcatgtgttcataagaattcaagacagtttaatatatgtcctgtgcgtagctgtggtaaaaagactgatcatggatcatgtgattggttttctgtaaagaatttgtaaaaatgtattgaattgtgttctatttttaattttaggatttagtttatggagagagatctgttttattgatatagaataatctatgtttagtcccccccccccatcatttgtatgactcctaaacatatctcaagcacagccctcagctgaattccacattctgtgtccagatccttacagctcaatatctaacccagaagctgtgttcagtgaaaaataagagatttgtggcccagggtttcggaaggtaaaagcaagaggatcacaagctttaggccagactcaaagtacaaagtgaaactctagtttcaaaaaagattccatagccaaacatggtggtgcatggctttaatccctgcagaggccccacgtgcatgccagtcttacgtttgagactagcctggtctatatatagccaattctaggacattgagggctacatagtaagaccctgtctcagactaaccacccccccacccccgtctagaaaaaaaaccacagggaaaaaaatgtttagaatcgcttctctatgagagagagcataaaatttgtggctaaaccaggatacctttgaacatggggaaaatgttataaatatagtagtgtatatctgtagccctagcacttcagaggtcaaggcaggagcatcagaaattaaagaacagcccgtaggcaacataggaagtttgatgtcagcttgggttgcctggcattatatttcagtagtaataatgataatgcacattggttagggaatgtagcctagtggtagagcgcttgttaggtcctgactccctctctccagtgctacacattttttttttttaaagatagaacagcaagcctacactgggactacgctgtaccaaccagaacatctttaaggccttgggaactttgccttacctactttacttgtttaattcatatgctaatagtctcattctgttctgtcaaccttcttgctgtttctcatagttcttcacacaatttacaattggataataatgccttttgttctttttccagaaatataagtggttttccttctcttttcctttaggtcttagctcacatagaacatagatcaaagactttctccaagtgctcacagaatagtatttgcacccatcctcctcttttgttttctttttttcctacagtgctcattccttgagacatcattaacatattgtgccttctccttggaataggaaattcaggagaacaaggattttgatttgttttgcttttccacatgacaagaccaatgcctggcatgtacttgggggcttttatttagtacacgaatgaacgaattttcagatatgtctcaatttttttttttttttttgtttttggagacagggtttctctgtgtagtcctggctgtcctggaactcactttgtagaccaggctggcctcgaactcagaaatccgcctgcctctgcctcccgagtgctgggattaaaggcatcagctatgtctcttaaaccattgatgattatgggaaaagcaagtgctattcttgatacttaaaacaacaacaacaacaacaacaaaaccctttccaattaagtgtcaactaagatgacagggttttgtttctgagacagttttactcttctctaggttaggttggcacagaactttgtatatttttctgccagcatatttaggtgatttggtttagcatcaaatttctagatttttttttttttatgcctgttcacctccaacatacaccgatgctttctgccttaatattttaggggcatagattctattctttgctttttaccgcttgtttgtttgtttgtttgtttttgagacagggttctctgtgtaaccctccctgactgtcctggactcggatttgtcgaccaggctgacctcccaactcctgtctgcctctaacatggcctgggattaaaggtgtgagccaccacacctttgaaccttttaaggtcagaaaatggacataaacgtttactaaaatgtggcataaatatgcttgttctgtactttttttctttcatcatttgtatctaagagctttttctccatgtggtgggttttcataaaggaatttaaaatagaagtgtaagcattgggagaaaagggaggcaggcagcaagtcccgtcttttgttttagaaatgcggacctttgttggtgggagctgatcctttcgggtctctggggacaggtaggagctggaaggatggtttctgccttcctatttacccctgagctctactctacccccatcccccaatcctcacttttgtcactcttgagaacaaggcttctctgggagtactgtgagggacttttatcatgtagaggaacttttccagggcctgcttttatttgcaatctttgagactgggtcttacttcacacatctttggctggccttgaggtgtagtcctctcctctcagcctcccaggtgcttacgatcacaggtgtatgaggtaccatatctggttcttatttgtagccttataataggcccttaatttctacttggctttgtgatatactagcctttttagtctctacttagtttaagccttcccctgccccggacctctggcttggtgttcatcagtgtcctaaagcccacctctctcctagaaattgaaccctggaatgtgctatgcaggttctttaccactgacctatacatacccgtactccctgcctaggttctctttcattctgctcatacctgtagcttccatctacctcaatgtcttccctgagaataagacaactcactttagtagtttcccctccctctattctttcctgtttgggtggttgtgtatgtggggggaagaacattaagcagctgggtgcatttttcaggatctgataattgctgggcaggtttgacaggtattcaggcaattgagtcttgcaccatgagctagaagatactggaatgctggggggcggggggggtgttcagaaatctgtttcagacctttccaagcattaatggagtagtataatttatgaaggagaaagttaacataggttgctagcaatcagtactgaagaactagcaaaaaggaaataaacactattggagctacttaaaaatagtataaacccttcatctaaccaccatgcaaagttataactgccataaaaccttgattgtacccttaacttccagattcacctactataacacaacagaatgggattactgctaagagtctaaaagtgttcacaagttcagagacactgacaactaagcactattccagcaactgtagccattttggtcttaaaagatatttttctgcctctggtatttacttattggagacagggtctctatgtcttggaactcactatgtagatcaggctggctttaaactgactcctgagcgctggggtcgaaaggtgtacaccacctaaaaccccaagacttgagcttttaaactgttaaagggtcacactgtatcttctgaagcattttgaatggcaagaaatgttactttttcagtttttactttgcagccatattgttgctaatttatcagtgcagagagttagcagccacttgagcctgtggttactgtttggtcaatttttctgaaacatgaagatgaaacaaaggccaaataaaggccaccattgcagtttgagaaggcatacatatatttaatccacttttttttttccttagattgccaaggaaatctgatgtggaaaggtgagtatgaaaaaacttaaatctgtctccttattgattttttttttttttttactccgtgagcatgagtatggtgctatttattgatgatgaagaacctaggtccaaagaaacttaggactgtgtattttcttgggagcatcagggagtgcagtttttgtgttcttggtacttggatgtagaccctttcttttttaaatctttattgatggctgaccaaggcaagtccttgggaggaataggaaaatgtaactgcatagacactaatagaagttgagtcgactggctttgggcagctggctgttaatttaccagttgctgtaatgatgctgttagatcctgttattgctattttatagttgaaaatttttatttcaatttaagcttgggcttaaaatttaacactattatgtttccataagccaaagaaaaaagttttttaaaaagatttatttacttaatatatttatatgagtacactgtagctgtcttcagacactccagaatagggcatcagatcttgttaaggatggttgtgaagccaccatgtggttgctgagatttgaactcgggaccttcagaagagcaatcagtgctcttaaccactgatccatctctccagcttggttttggtttttttaaactaagtccctggggaggtttgtagtattcattagtagttacctcttcattaccaacaccaaatgccttatttgtagacttacacgggaatcaaaaagatagagctggaagacacaattgaaacttaacctggtttgtgacttgattggttagttttaaaacaaggaaacaagctaggtttattttgcctgttgtggagtaggaatgaacactgggcttttgaagaactgactcatgtatactatcagttgagacactgtggtgtcagaaaactacattagagtagtttacagagaagggcatatttctgatagaggagcatatttagggaaaaaaatcagacaaatcttgctgcttgtggtaagagagggacagcactggaattccaagtcctgaggtcggtggtgtccaggtggttgtatatttgtgttttgtgccttacattcttgagctacaaccctagccctgtcagatcttaatgtacttttaacacttgtgctcattcttgttttctttaataatccttgacagacactgaccaagagccataagtgtgccttggcttttttcttttttgtttctagtattcatggtgttgactgttcttaaggaagctttttttaggttgtgtgtggtcttttcacactctcaatagcagcttgactttgacatattcagtcagtgatagacttcagcaaaaacttacgtgggtgcgttgcatcagggtgatgttattggcaagatggagagatattggttggatgtgtaggtcattgaaaggtcacattaaattaataaatagcttcgattttacttggagttaggttagtattcttctgggtcttgttattaattagtcctggcatgttgaaatttttttccagtgtcttaaaccatgagaggtatgattgtcagttgtagtggtcctgaagaaaagagggctagctaatatgtagagggtagagaatttttaatgatgctcttaaagctttatgagatgataaatattggcaattgctgggcagaaaaagtatagaaatgaatacaatataaaaatagatattgacagacctaccttttaccaatctttaatttgggtaaggtaatatattcaactttgtcatcaaaatcatcagagtttttgtttgtttgtttgtttgttatgctattgtaagttgggaaataactcttgattttatagaaaggacatagtttcaagctttggtaaagagtatattttaactcctctaaccaaaatggtaacttattaccagtaacttcagttaggaagtttatactaactttcactactacatatccatacgtttagtatattttaggaatcatttagtataatagtttcaagttttaattcattgtggaaaaattcctattggatttattgctctgtggtaaaggtatgagaacacaaaaatgagatgaaattaatatttgtgtaaaaattttaggttaattttgttgtgcttgtaaatgaatgcttttttatttagatgaaacaagttatgaaaaataatgtgctgctggttcagatgaagaattgttttattttataggaaaatagaaattgtacagtttgctagccggacacgtcaactcttcgttcgattattagctttagtaaaatgggccaatgacgctggcaaagtagaaaagtgtgcggtaagttaaactttggtttttacgttgtatagaagaactttgagagctgcacattcgtacatgtgcctgtgatcttagcactcaggagtctgggtaatgatgatcatgagctctaggttagagactacatggcaagatgctgtctcaaaacaaatgcctttaaatgttacatgcataacttagaaatttaactttaacatttgttgatttcaaagttattactgatgtcagtaatcatgttcctttatgataatacataatgcgtctatctgtggaaggctagtatttgtatatggacacttgaccaaaaggaagaggaggggatatgtggaagatttacatggggagatggaagatttacatggggagactttagatagagcactggagaaactaaaaggggagaaatggttggcttcaaaactttataattcttcagagcagtggttctcaacgtgtgtgtcaagactcctttggcaaactttcatctccaaatatatttacattacaattcataacagtagccagattaaagtcatgaaatagcaacaaaacaattttatggttagggtcagcacaacatgcggaatggtattaaaggtcacagcattaggaaggttgagaagtactgctttggagttaggaagattctcttcaagtttacttattgattttttgatgtccttatgagaatgacagagtctgtattttctgttttacggatgagatgattaaatttctagaaaatatgtggtttcttcaaggtcacagaactgatgacagcaggtatcagtcagttcagttgcttgttcatttactcgtgctcaaagactcctgagcataagggatggtagggagacttgagtaaagcctcctatactgcctgctttcagggacacttaagagtctttggactggtgaattttgtgtgttttttttttttttttgagatagggtttctctgtgtagccctagctgtcctggaactcactgtgtagaccaggctggcatagaactcagaaacctacctgcctctgcctcctgagttttaacgtaagaatgttaagagaacagcctagaggggccttgggtgagttcactgtgagaacttagggagtatgatttggttttcagagatgaggaacactggctcttgttttacttcaatcgctcctaaagagttatactggaaagggcaattaaatagtgaataaagtcctgaaatgaagacagcgtgcccccactttcattgaggtgccctttttaggctcagctctacaagaccaactatatgtctacctgctgtcaattaaatttgtgaatggaaaggaagtgcagagatataacttaccagtgattctcacattccttttttggatttttttttttggtttttagagacagggtttctctgtgtagcactggctatcttagctcactttgtagaccaggctggccttgaactcagaaatccacctgcctctgcctcccgagtgctgggattaaaggcatgcaccaccacgcctggctccttttttgttttttattctatcctgtattgacatttttttttttttggtgtattgacatttttaaaaggttcctagtgttcatagattaaagcagattaacaaattagatctggctaggttaagtttgagagcttcaaaagttctctgtagcctggcagtggtggcgcacacgcgcctttaatcccagcactcgggaggcagaggcaggcagatttctgagtttgagaacaacctggtctacatagtgagttccaggacagccagggctacacagagaaaccctgtcttgaaaagccaaaaaaaaaaaaaaaaaaaaaaaaaaaaaaaaaaaaaaagctctgtagtttatcaagcttcttccataaaaatcagcagggtaatgatggtgcacccctttaatcccagcacttgagaaacaggcaagtgcatctccatgagttcgaggacagccagggctacacagagaaaccccgtcttgaaaaaccaaagaagagaaaaaaatgaacagctacctgccatgatggtactgtagtatatttattttagcactctgataaattaaaaatggagaattttctgtttgtaagctggcgagggttcttattccacaaaagccctattttacaaagcaatctacagcatagctatatttctggcctgatttctctgacattttcaccttggttttagcctgttttagtctttgcttaacctgtttcactagattgccaaaactttagggaaagttgccaaaccaaaagaaggaaaaagatcataaaattggactttggaaagttctagaatataagtttgcattttgaagcatatcctgttagtttctattgtcagtttgacacaaactatagtaacctgggaagagaaaactcccccagttgatagttgattaagatagataggcttctggtcatatttggagcattttcttgattgctaagtagtatgggaagcccagcccactgagcgtgatcttccctgcgtagtataagaaaagtcttgctatgctatgtaagaaaattagctgaatataagctagtgagtgagtcagcaagcaacatgtctttgtgtcttctgcttgagttcttgtcctgccctcctttaatggtgtattaagatagaagtgtgagctgtacaaatcctttcctgtatgcttttgatcagagtgttttgtcatagatgcagaaagcaaactagaacacagggggaaatgatttttttattgacattagtatgtagttctagttctggcagcttagaccatgagagctgtagaccagttttgtcagacatgtttatctgtctctgagtaagctaatatacccttctctgtaatattgatcaaaagcatatttgacttaggttggccttaaactatcagtcctcttgtcttcttgagtgctgggattacagatatgtatgtaccaccagcacactcagtttttgaggtagagtgttttgtatgttacatctccctttagctgggagggtgggctggagagatggctcaggggttaagagcattaactgctcttctgcaggacccagtttgactcccatcacactcaaggcagctcatagccatctgtaacttcaatttcagggaatccaatgcactctgctgtttttgtttttttttaacctctttgtgtaccagatatacacatggtacatagacatacttgaagatgcagacaaaacacctatgcacaaataaattaagaattcaaaaattttcctcaagggagaaaagtttccattgtctataaatgtgattgggaagttaaaatttgcaaacttttgtacagtaagcaatattcaatgtactgtggttagtgtattttgagtctgtctcattacacagatggagtagtgtaggccggataaactgatctctcagtttatctctcatcttcccagagggaggtctctggttttcttttcccttaacttggtctcaagaacattttctgttgattcttaaaaggcttaaatcgctgggcggtggtgatgcacgcctttaatcccagcttttgggaggcagaggcagatttctgagttcaaggccaacgtggtctacagagtgagttccaggacagccagggctacacagaaaaaccctgtctcgaaaaaaaacaaaagcaaaaccaaaaaaacccaaccaaccaaaccaaaaaaaagccttaaatcagagttaaaaccagttcagcaattgagactattttagtagtatcatggctatgaataagaagttagagttggtgacattgatagaacattgcatcagttataaaaggtaacatttcaagatatacactgggtctaaaactatgagaagaaaacccattttctggttctagcttctctaattattaagctatatttctttggaaaaaggtctttacctgtgaatcagttttctcatctctaaggtgatagtaactatctggttttgttttctagagttgtagaaatgagacaataaaacagctgtggaaaaaagatcatggtctatgtatggtgccttcttacattagctctgggggactggttttaagttgttcaccagaaacctttttgaaggacatgaaagaaaggaatgttagatattgatgtaaaacagaactaaaggtttgaaggagatggttttcagccctgtgatgactttaactgactagaaaactaatagaatgtctgtattgggcagatagttggcttggatctcatattgggcaatatgtaccgtttcctgtgttctaggcatggttctgaaggctagttatgtaataccctcagaacaactttattcattaggttgagaatcatctccattttactgttgaaaacctgagacacccatgggcagtggtggcacatgcctttaatctcagcatttgggaggtagaggtcaaggcaggcagagtttgaggtcaacctgctctacagagttccaggacagccagggctgtctcaggatgaaaaccttaggcatagaacttgtttgcccaagtagacatggctagtaaattataaagttaaaaagatcgaggcagtctgggagtccatgattttaactatttcattgctatccaacactagaagtctgttaggataatttttactcttgatatttcatccgataaataagaagccacatatattaatttctttttaagtttgctttggagtgagtaaatgatgtatttaccctttgttttaaagatgatctcaagctttttagatcagcaagctatcttatttgtggataccgctgaccgcttggcctccttagctagagatgccctggtccatgcacgcctgcctagttttgctattccatatgccattgatgtactgactactggctcttatccacggcttccaacctgcatcagggtaagtgttttgcccctttactcagaaaaggctttgggtttggatagcacagtatagaagaaactgttttgggttatttttcccttaaaaaaaaaataaaaaaggtaattcaatttttttcctctttaagtaaaagtgtgatagtttgaaataaattggggccaattgaaccagggaatctgttttttcctccttttttcttttttctccatttccttccctttccccatccttgttgggagtgagtagatgtacaaatataatttagtgtgtatttcagatgtgaacatgactccatagcagtggtattttggaagtgcttaaaaatgagttgttgctattgtattctgtacatttaggaaatagaggaagtcatctagtgacatttacttggtgtcataaatggagcaccatgcagaacatagccggctttagcaaggtggctgagaattatttacagtcaaatgtatagtcactagttttggatgcagagaacagaaatgagtgttgtggttgtcttgagtacagtaagaagtactcacgtgtacagttgggtgcaggtaaacatttacatcttttgtatattatttaaaaatatttttcatttttttgtaggacaaaattattcctccagacccaattaccaaaattgagaaacaagccacacttcatcagcttaatcagattcttagacataggcttgtaacgacagatcttcctccacagctagcaaatcttacagtgggtatgtacctgagattgtttttgtaagactacttttttaagtgaccttttgggttttgttcaaagaacaagtaaatgaagttttgattttgtggtggttgaacctatgttttgccatccataattgttctctctttggtacctaaaagtaatgtggtgatctttgcactgaggggaatgagtgggattacctgagactggaagagaaaagaggttccaaagttgagcctggaggacatgctttggtgtttattcataatgtaacaagaggtgcctttggtttcttaatgacctggacattggtactctctctgtttgaatcactgacttgtttcaacaccaggatgaaagtctgtttaaaatgtcttataagtgagactgaaacttggaggttagccagaagcttattgtttgaaagcagtacattttcctcttctaaaagcaaatggccgtgtgaagtttcgagttgaaggagaatttgaagcaaccttgacagtgatgggtgatgacccagaagtcccgtggcgtcttctcaagctagaaattctagttgaggataaggaaacaggaggtaagtcatcatagtaatggtttttggcattcttctatttgtgaagtatttctgtgggaaaatttgtgtagcaattctataatttgaagcaaaattttgataagcataactacctactgatggaagaattttcagtgtgtaagctatagttttctcaaaatcttaactcttttttttaatttaaatttatttttagtgtacactttctcagttaatgctatataatgctgacttttctaattaactcctttcttttcttctgccaatggaagatgggcgagctttggttcatagcatgcaaatcgattttatccatcagctggtccagtctaggctctttgctgatgagaaacctcttcaggacatgtacaactgcctacgtatccttctgatatttgagacctactgcttttgtgtctccctcttctacattttctgtttatcctttgtgtagtagtttggtctctccttcccacatcctaccttttttgggtataaatagacattgagagaacatgaatagacattgtgtgaacattaatggtatatctataagatttcaaattttaccactgctttgcagacaactcctaaaagtgattgcttcggcaaggtgtggtacataatcccagcacctgagaggagaggcagcaggatgttgacttcgaggccatcctgtgcaacatagctacttcaaagtcagtctgttgtacataatgagaagctgtctcaaaaaaggtaccattttgatctggaaatatgttatttgttcaatttgtattttccaaacaatgatcaattaaggggcaaacctagacattagttttggttatttaggccaaaattatcagccctttttctaaaattattccacacattctactactactacttgtgatgagtcatttgagaagataattcagaaaaccacaaattctgtcatatttaggatgagtcattagacaaagatgattctagaaaatttctccatagccagctttttcgagatagattccttgttagatgctgtttacctgtgcttagtagctgcgtgagtaacatactgtattttgcttaacaagataaatcagattgtttctgcttatcgcttcaactagaagtattacattcccagacactaatgttaatccgagagaggtggggagaccttgtacaggtggaaagataccatgctggaaagagcctctccctctcagtttggaagtaagtaaaattggttctggtaggtcattgtgataagtgaagcctgtctttttggtttctttcccttgtacaactgacttattacatatgaatagctatgtgcccatagtaatgtgctcactatcatgtagaccacctgagacatccattactttactgtgggctcatgctggattgttcaaaaagctatgagctttgggtgatgctggcgatcaatctagggccttatgcatgcaaggtcagccctctgccagtggagctagatccctagtccccaaaggttagagtgttgagtatcactttgtaaaacatacttgcttatttatcacagtttccccttttaaattgtatctttgaaaacttatttggagaaaattgctatgagcctatttatcgtctttatttcctgtttgaaattgactacgttctgattttctgtggataaatcagagacaaatatttattagacggtttctgtttacaggtttttttttcttttttgtgagtgcatgtatcttatttttaaattcagtatctatttctaaaatgcagtagaacaaatgctgaattggattatgaaatgtcttctcagtattaatgtattccctgcacaaacactgagggcctgctatgttcaaggttctgactcagcataatgcatgtttctatttgactgtaaacgatgaaaagctgtgtttatatgttattctccccctgccccctttcagtcaacaggttctagggagaaaaacaggcacagcatctgttcacaaagttacaattaaaatcgatgagaatgatgtctccaagcctttacagatttttcatgatcctcctttgccagcttctgattctaaattagtagaaagagccatgaaggtaaagggttctcagtgtattttaatattgatttgattaaataaatataatttagcacatataaaacatttagcaaaaattcttcaagatacgtaatttttaaaaccctgtgtgaaacttgttttatacttctgtatttgtttttggtcttttaaacatctaatagaatataacataacttttcatatctttcagtttcagttcataggagaatgctactggttgcatctgagcgtattctttgatgctgaactatgcccctagcctagtttaagttttatagtttaaatcagactattttgtttttaaggtctggcacctgagaactgtgattactgatatgtatataaactctagatttacatttatcaaagtgtagccttggctctcttggaacttgctatgtagaccaggatggcctcaactcatgtagatggagctgcctacctctgcctcccaagtataaaaggaaggatctcaaatgtcacccagctggcctcaatcttgttatgtatctgagaatgaccttggatttctgatcctcctgcatgtacctcctgaatgctgggattatagtcatgctccccccctgccccccagttttcaatgagctggggaatcaaatccatagctacctgcattctgagcactcaactaactgaacccccccccccgtctcctataccttgcaaaaaaaaagaaatttagtttgaacgcttccaatgtaattaaatacaattaaaataattaaaagctcagaatcattaagttatatttttactttatctaaatttgcttatactggataatttccaatactgaaaagaaacatcttaaggcatagttgtgtccattcacacacgtacaataaaaatatttgaattgtacattggattttattgttgctgtttatgcagattgaccacttatcaatagaaaagctcctgattgacagtgtacacgcaagagcccaccagaggctgcaggaactgaaggccattcttagaagcttcaacgccaatgaaagctgtaggtgttctcagttgatactctgctttttcttttatttaagactttctcctgatgtatggttttgttgaggatgctggacatttgttgcatttaacctgaaatctaccaaattagtcctaattttctctctctcttacttagcttgtcttaatttttaaactgtttgcatgttatctctcctaaaaaatttaaacttatggaaatagaaacattttaatatgacttgtaatttagtgtttcttttgacaaagtagtactgcaaatgcttttataatgtatttaaaaatatggctgagtaatgcagaattcatgtctttagttttgcattataacagtattgagtaagaaatgcacatgtaaagagtaattgtaagtcatgtaagacatgtaagtcttccaagttttaattacctatctagtctattatgaactttagaaagcaaactctagtatttcatgcgcttctctatttactattcttacctccccccatgctcccccccaccccatacagggtatcactatataacctagactggcttcaaatttgtggtctttgctacttcagtttctcattgcccaagataacaggcatggaccagtatatccaactccttcaattggttttgaccatagttaccttatgttcaaagttcatagtgtaataaaagtagaaactagtagtaggggaagtacagagcctagatcactccattacactcccagaaaattgacttcttagatatgtactagtaagtgtagattaaggtcattttgataaaagataaaaactctgcccatagcaaagataattttgaaaaatggacagtacatattcaagaatgctgtgttctcttgaatagttagatatactagttaataacaatgtacttgtagtatgtactttaaagtagctacaaatgaagtttttgactgttctcatcacataaatactaaggtgatggatatactaattactgacttgatcattgcacaatttataagttattgtaatatcacataatctataatatataattattttgtcagcaaaacattcaagggctggcgagatggctcagcagttaagagtgccgactgctcttccgaaggtcctgagttcaaatcccatcaaccacatggtggctcacaaccatctgtaatgaaatctgatgctctcttctggagtgtctgaagacagctacagtgtacttacatataataaataaataaatctttaaaaaatattcaatgaaaattaaagaatagatgtgaaaagtaggactgacaagtcaatattaatgcatgaatatattaaaaattttttttaaattagtatgcagaataataggtctctttctttacatcatattttttatgtgtatggatgttttgcttgcatgtatgtctgccctcagatgccagaagagagtatagaattccctagaactggagttacagactattgttaactgccattaggtactgggaattgaacaagggtctactggagaaataggcagtactctgaacagctgagttctctctccagctccctctttcccttccttcactagctttgtggaccagactggctgtgaacttgcagcaatcctgagtcagtgccttctctccttaagtgctacgacaacatatacgcacccttggaatctatatgatttcattgtgacatttcaaatgtgtatgttgtgctttgctgagagtcactcctactattactacctcttgtccccttttctcctctctgatggcttcccttctcccctcaaatagccccacttctgctttcatgtcttgtgtatattgttaaatatctcatttgaattcttcttaccaaagaaaacatacttgtctgagtctgccttattttggttaatatgatgttctccagtttcacccattttttttctaaaaatgccatagatttgttgttgttctttataactgaatgaatttccattgtatatatattccacataattaaaatacattcatctgatgatgggcatctaggttgatttttttcagtcttaactctagtgaatagtgctgtattaacatggtgtacatgtgtgtttgtggcaagccaacttaggctcctaactagtactgatgtagttgggtcatacaatactttgtagtgatctccccattagatgtattaatttacagtccgatcattgccagcatgttttgtttgctttgtagtagacattctaattatatgggatcgcagtgtatttgcatttattaagagccaaggatgttgaacatttcacatattcattggtccttgtttcttttgaaaactctccagttcatttgctcatttatcctttggatgatttttctgtatttaattttttgagttttttttttaatagattctagatactaatttccttttcatatatagctggcaacaatttttttcttgtctttttttaaaagtccagtccttactccctccaagtttgctctttcacagttcctcatccccttcccgcaacccccagtgtccaagaggatgtcctccccactccccaaccaggcctccccactccctggagcctcaagactcttgagggtcaggcctgttttatctcactgaggccagaccagacagttctctggtgtgtgtgtttcgggtgtcttggatcagcttgtgtatgctgcctggttggtggctcagtgtgtaagagattttattctatagtctaacctctttaggctggtaattgtttactgtgtatggaacccgtttaattccatacaatcctgtttgtcaattcttgctattatctcctaatccactggagtcctttctgtaataaaatatttttcctgtattttatttttgcagtttcaaagtttcaggtcttcaagttttaggttttaaaacattttgaattgaagtcttagagatctaatttcattctatacacaaatgttaaatttttccagcaccattttgatgaagtctccccatatgtgtttttggtttatttctggggtttatattttattccattggtttacaagtctgtgaccataccatgcttttgtttctacagaagtactacagtttagttgtatggtttgaaatcgggcattatgatgcctctaaccttaattgtgtgttggggggtgcaggctatgggagagtttggcccttgttctttaggaatgctgttttaccataggatttcattgttttggttttttatttttatttttcgtttagacagggtgctaggatcacaggcatgaatcactatgtctgcttcaacatggatcttgcagttcaggattgatttggttgtttgcctgtttgcttctgaatagattttaagattatttattataattctgtgaagaatggcattcagatttttagtggggtcacattaaaactacatagatttcagtaatataaccaccttccagaattagtcctattggtgatgtatgagcatgttattccgtcttctagtgtggaggttgaatggtggatagatacaggttcttgctctgcagcacagttgttgtaatgtgcaatgtagtctaagctggccttgatcttgtagcagtcctatacccaggttttgttttgttttgttttgtttttttgatttttcaagacaggttttctctgtgtattcctggctgtcctcgaactcgctctgtagaccaggctggtcttgaactcagagatctgcctgcctctgcctcccaagtgctgggatcaaaagcatgcgccaccatgcccagccacacccagggttttgtgtgtattaggtggcacacactaccaatttagctacagctcctctccagggcttttcttttgaagggatgttgagctttggaggcctgttgtttatctattgagaagatcatatgatttctgttgctagtctgcatgttgtattatattgaataatttgcatttgttgaactgtatttgcacttttgaaatgagaacaacttgactaacttgatcctgagcattctttctttttttcttttccaaagttaacaatctgttattattcaacttggacagggttagttcattcaactataaaaacagcacctcccttgagacccaggctggaggtacaattctcagaaaagatttagaacatgtctgtctgcctaaggactgtacaaaaatatgacattctccagtgttgcagatgaaaatatctctacaagcagcttcatgagttggatctgcagcactccagacaacaaaaaatatggatgctttagaaaatgtgaactctgctgtgcagtggtcgtatctatctatccagcacttgggaggcagagttccaggccagcctgctctacagagcaagtttcaaaacagccagggctacatagagaaaaaccctgtcttggaataaccaagcaaattaaaaaatctctcctcatttcaaaatgaaacaagatagtaccctttcttcctcttggctcaatttccatccatttcttggaagaaagacccaagaataggatgggaaacagttgttttcctccctgtccacaaagaatcataccaattgtgggaggaaacagatctctactttctgagctggatttctagaaactaggaaactccctttaagctataaacagggagggtctgagggctccttgaaaggtggttttttttttttttttaagataaaaacatttgaagctgtggtggtgcacgcctttaatcctagcactcgggaggcagaggcaggtggatttctgagttcgaggccagcctggtctacaaagtgagttccaggacagccagggctacacagaaaaaccctgtctcgcaacatttgagatagccttataacctataggtctaacttaaattaagtaaaaataagtagccattgacactatattgagctggccaaaaaggtataggatccttttaattgatgtcatgtgtcttggaagaagtagctatattttgggtcaggtcatctctgttggttagagctcacatcctgtattgcctggagggctcaagtatggaaactgaaagatgagggttgaacagagctctcatgctgtgtagcctgaattttggctgttttatagatggttctctgcgtagaacagagaacttttcagacacttcctaactgaggaaggcttcctaggagccgaaaaccactgcctgaaacaggctactcccgagaggtgatagataggcttcctgtcaaacctcagcagcaactcactggctttaggaggaggtctgtctatatctaaagaatcatctgtctaccgacttggagaggattgaaccgtatgtagaatgtggtgacatttctcattggtgccattggtaagcacccttccacctgccagcattagagctgcagggtagcagatagggttctgaaaaagaaaaaacccaaacccctaaagaggttgtgatttaaacagcacatagccgtttgaactgctcgaactgttcccaactccttgctttataggaattgacttgatgagcccagagaacaagggcaatatcaaaaaggaatacattctttgaaaggcccatgaaaacacatctccatggctaggatgaacaaaaccatctcttggttgacagctcttgacgaagttttccaaattcggctgaggtggaacttgtgcctggatggaaaagcagagcctgtgcacttgagtatgctcttggttaggtcatgactgatccctgttccagactgagcctcacatttcatacttcacacatttggggcttggtatgcgagtgcataaacaacaaatccccttacctttatacaataggttcttcaaacattgttgaggtatttttaattcttttttctttttcttcttctgtttttttttggtttttctgagacagggtttctctgtatagtcctggctgtcctggaactcactctgtagaccaggctggcttcaaactcagaaatccgcctgcctctgcctcccgagtgctgggattaaaggcgtgcaccacccccacccagcagttgaggtatttcttaaagctttcacaaaaaacccttgaacgtgttgcgggctgagtaaagactgagtaaagctgcagtattagtcttttccattcagaccagctagctctttgaggcttgaggatggatggtgaaggaggtgttctgggtccttttgacagaagtgattaacgcacctttatggccttcatcaatgatcaccacgttggttcctttgttgggaactcagggctgaaggcaggtcaatttctctttaggtttggactgaaatagagaatattatcactgaaggtcctggaatcacacatcttttgtgttgctaaatttgacttgcaatcattgaagtacctttatgtactcgggttcatcagaaaatttgttgtgtgttcatccttgtttgatcttggtatcagggtaatattgacttcatggaatgagtctggtaatactccctcccccttctattgttatggattagtttgacgagtgtgtgtttttttaaactccagtacaatttggcagtgattaatccatttgcttcttctgatcttttttagctaagaaattttattcttcagtctcattgatctttgtaggtctgtttaaacattttctattctcttggttttaattttgtaggcaatgtctaggaactttcttcttggtaggccattttttcttggtttttgaatacaggttttcaaagtatttcctaatttgcctctggatttcattgatattttttatattttctcttttctatgtctaatttttctgatttgcttcttttattaacagtatttgccttgaagaaccaagtgtttgtttcaatgagtctttgtttttctttgttttgtttggttttttcatttccatcttcctatttctgccctgagcttgattaggctgttggagaagcatttgttgtttttgtaattttgttctgttgaaatttgccatttagtactggactatgttccttttctttttttctattgaggcaggatttctgtgtatagccctggctgtcctggaactcactctgtagaccaggctggcctcgaactcagaaatccacctgcctctgcctcctcagtgctgaaattaaaggggtgtggcaccactgcctggcttggaatatatatttttaaattaaatttatttacttatttagtttacaaccccatatcagcccttcctctcctctcagtgtcctctcatgtaagttatccccacaatccccccctaatctccatcccccaccccagaatacacacacacacacacacacacacacacacacacacacacacacaatttagtttttattcatgtgcgtggggtgggaaggcatgaatgacaacatatttgtggaggtcagatgacaacttaaagaagtcactttcttctccccttggagtcctagggattgaactcaagtcctcaagcttcgtggtgagtgcctcactagccctgacataacatttcagtgtgcatttctttctttctttttttttggtttttcgagacagggtttctctgtatagccctggctgtcctgaaactcactttgtagaccaggctggcctcaaactcagaaatctgcctgcctctgcctcccgagtgctgggattaaaggtgtgcgccaccatgccggcttcagtgtgcatttcttatttcatgtttttggtaatattggaatctgttatttatatttgtcttataccatgagaatgctagataaaatagaaactctagtgcttttcttgtgttcagagttggttgtaaagcattggaactgacttgcaactttgacagtgcatttggaactgcaaataaatgcgtagtagagtagggatttaatgtttacaaagcctggaagtgcttttaaaaactcagtcatctttctccttcattccatgaattcttaatttggctttttgttatgctgatctatttattttctttgctgtctgatagaatttctttacccttgtcttccatccctggtattgttttctgcttggtttagtctattgttttatttacttatgtaggaatgtttcttgttcatgtttatcatgtgtgtgcctgatacttgaggtgtcagatgaaggcatttgatcctgtagaactggagttaaagactgttgtacgccacgtgtggggttagcaagagctcttaaccactggatcatctccagccttttgattttagtgtattggttggtgaaactttccattctggttttctgtctccccttgcccactctcaaagtctctttttttgctgaactttttatcagtcttgttaatttcatgtctgtatttcaggcctttgaaatctggatctataattgactttcttacttacttcatctgttttgttttctaaaaatatttttactggcagaaatcctttttccagtattggaactaccttaatatctggatttgttgattgaggaattagcttttgtatatgctatgctgatttgttttttcatggttcttgatgcacctgtctgtatgggatatctcttccagttttagtggaggattttttttttttaaactgagaaactttttcttgagggatcaacctccactatcgttcagagaggagaaaactgaggtgctataatcaaacctgatatgggaatacagttaaaatcaatgctaacttgtataattcctatgaccacagaacagaaaataactaaaagagagcagaatacattatcaccttaaattttttttaaagatttatttattatatgttaagtacagtgtagctgtcttcagacacaccagaagagggcgtcagatctcgttacggatggttgtgagccaccatgtggttgctgggatttgaactcccgacctttggaagagccgtcaggtacttttactctctgagccatctcaccagcccatcaccttaaattttattaaggataaaagtaaaagtagtaaatgaacaaaataaaggtcaaaagaaagcagaaccaaaactaagagaaaaagaaagatgaatgttaggaagacaaaaaaagaacaggaatattaaagtattacacattaaagaaaaatgcataaacaaaattagataaatgtaagaagaataaaaaaagtttttctgggagggaaaagctaccattatgtagccttttaaatctgtactatggctatatttttgtgattatttttctgtaatgagagcaactaaaattaaacaagtatttacctgttttgtttgtttgttttattaaaaagactaaagttcacacttaaaatgccagcactgaagaggctgaggctggtggatctggagttgaaggccagcctggactatatagtgagctcaaggtcatctgagctactcacgtaggcaaaccctgcttaacccccaaccccatatatgaagtaaaaataatactcaaatttataataacatgaaacaggtagtaaagatggaaaaaaactaaatggcaaagtgtcagtacttttttctgtatactctaatattagaatcttccaggtaggaagagtatgcaattgaagttggagtttctttttcctatcatttaggagggcgctgagcctggaccagtcaagtgtcagatgtccgacagagctgtcttcattttaggagcttgccttccttgcatattagaaacctcttctggccccttttagatttgcagcctgtggtctatgcaggttatcccatactccagagacttcctagttgaatgcattgggggagtcaagaaagcagagcactgacatctgtactggaagactatgtgtctcagtgctttgagtacagcattaaacacccttcgggagggaggaggctacagaagttgagagaatgctactggacctgagcttcagagttctcagtcccatcagcagagagccttacagctgacaggtggctccagaggttgggggttgcctgctgaccttgggctcatgggctgtaagactctgcatctatcctcagatgaatgcttatcatggattaccaccagacccttcaacgcccaagcttcctgctgcctcaactcaacatgtccacatctggctctcctcctgttcacaactgcccttcactgcagccttcacccaggagctgtggcatgttgcccccccccccccgccagatcccttgacttctgattgttccagaatagtttgtgttttatatagtaggccttttcaatcacagcccttcaagacatgagtgagagaacggatctcatctccactaccaactcatcacacagatggagtcattcccttaacaaatcctgagctaagaacgtaatcctctgctgtgggtagactctccagtcactctatcagggcttcctgcctcacttttttttttttttgggggggggatgaggcgtctgtgttgggtcttgtccccacccaggctctccccaccagggagtcctagcatttctcagaactagggaaaaggaaacgtagcaaaaagtgcaaatgtgagccttagggaagaaagacaggcagggaagaactggggtgcatgtgttggttaaattttatttctgcgtgtatgtgtgtgtgcgttaattgtcagtgttcactaactttaattataagaagcttatctctctcatctttcaaaataaaagtagtgattaaaaagtacaattgaaactaatgggaactagaaagggcagtaatcccccattcttttttcttagcaatattgttgaaatattcatgtacacttaatgggatttttagtatattttgaacagtccaattttagaatatttcagtcatcccccaaagaaccattatatctactagggggtcattctgtattctctctagcttctgacagctactcatccactatatatatttatatgtataagcatttcatataaatgaatcatgtaatgaatgttcttttgcatatttgtttttgaggtctatccatgttatagcatgtttttaataattgttatatatgccatatattatcagttcattgataaacattgtggttacttttaattttcaactattgtgaatatagctgtgaacatttgtctaagttttcatgtgggcttatacttacttgtatatatgcctatgaatatgatggctgggtgatctggccactctaatcttttttcatactgaaactatttcacaacctcaccaacagtgtttaagggttctgccttctccatattctcactgatactggttgttttttatgtttctagctgtcctagtaagtgtgagatttcattatagttttgacttgtatgttctatgttgagcatctttccatatatctgtctgttcagatcctttgtccgttttataattgcatttatcttttccttattattgcatatattttggatataagtccctttttataaattatgatgtgtaagaatttttcccatgcttgataacttttttatggtatttctactactgacttcctccctgcctccctcccttccaataggatgctatgtggtttaggtcggccttagccctgatatgtagttgaaaatggctcaaactcttgcttctcctacttccattttccaactggtaggactaaaggtgtatagtaccatgcctggtctttttttttttttttttttttttttttggagataggctctcatcatgccccctgttgatctattactctgtatacatcaggcaggctttgaacttgaggcagtccttctgccactactgtcctagttctgagattaaaagcatataccactatgctctgccttttttttttttactttaaatggcattcagtgtacactttttttatgcttctcatgttatacttaagaatccatgtcttataaacctgagatcctgaagacatacacttacattttctttaaatgttattatttagatctgaatcattatgagttaatttttgtgtatagtatcagataggtgtcaaagaagatatgcagttgtaccagtaacattccttcttaaggaaaactcttagcattctacaatctttttttatccacaccgagtcaggggttcgcaatgtaactctggctgtcctggaattcactttgtagaccacggtggcctggacagagatctgcctgccttgtcttcctgagtgttgagattaaaggcatgagccgctatacctggctaagcattttgtaatctttatttcttcttatttccaagtttacaaagtagtaaaattctaaaattttgttgttggagctgcagaaaatgaagatgtgtgatgttttcagtaaacaaagcttagtaagtaaaaacctgtcagaatgattgcccatgggatattattttcaaaaataatctctagggctgtggctgcagttcagttgatgaaatgcgtctctagcattcatcaaaacttgaggtcaaccccagcacccaccacataaaattcagtgtgtttgccgatgcctgtaatcttgacagtgggaggtagaggcttagacgtggacggagtgggttaggaattcaagattatcgtcaacctcattggttagcttatattaagccaaatgtagacctgcctggtttggaaatcggtgtgtagtaatttatgtagtgatttgaggatagcctcaagtacagagttctgtctacctctgcctccagtttaaacgtgtataccatcacacctgggtaaactctaaaacacatgttctggtagtggtagtttggtgtactgacttaagttctcagaatttcttttacatgcatattgtagcggtgtctctacctgaatagccggaaggtcttgagttcagctgcatgctctcaaacatattatatacatgctttgagctccattctctaactgtaattggaagtggttgttagcatatcttctttttagatctctagttccagtcgaaacgtgtgctacctcagttacttcaagcccttgttcctactgtcctaggtgtttgagaataatcttatagggacttttgaaattggtcccctcaagtcctgttttatcagcatttttctacaagggaaaaagggtctgtttatctagctttttagggtataaattgtttctttttggtttgagacagtttcactatgtagtcatgattaccatgaaactcagattatcttggctctgcctccaagttagtgctgggaataaaggtgtatgtgcctggcctatagaagaactgtagcccattctttgaatctgttagtgctgttgctctcagtccgttgcatttttccaagcttctagctggaatagcctaaagtgagtaattgagagattagaatatttcaagaaaggcctgggagaaggcacagctgcagggatttgaaatagcacagatagaagcatacagtttgctcagggtcaagttgcctcaagggcaaccaggtgcagagaagaccaaaatagtataaggcagggagatatgatatggctacttttcaataatgtctttgagtcttaggagtctccacccattaggtctgaattggcattatcaggtggaagcagtctatggcaaataactttttaattgtgcttaatttcatatttctcttcattttctcagaaaaccaactaacaaacaaacccaccaaaaatagatattgttggccataggatatattcaaatatatgtattgatgctattttctcttgaatgtatatcttttgattcatgtctgtatgagatcattcattcttgttaattagattgaaattataattgttatccctattggcagttgtacttttattattatagtttaaaaatgatttttgattagagactgcattgttttgtactctaacacaaattataactgtatagaaatgttttaaaattagtaactaattttttatttagatattttctttatatttatatttctttatatttctccatatatttttctttatatatattttctttatatccactatatacatttatatacatttcaaatgctatcctgaaagttccctataccctcccccgccctgctcccctacacacacactcccgcttcttggccctggcattccaagaatttcataaattcattgtttactaatttttaaatcaggtgatgtgattcagcaattgagtataggcttagcatgtttaaggctctgggttctgttcccaaagccacataaacatacacagccagcaaccctgtttcaaaactgaaaatacttttgattctgctgcatagtgtactgtgtttaagacactattgctttaatttcatttgttgtgctggtgttggattataaaatactgtatcaaaaatttttagtctccttcagttttttacctttaaaatttacattacattttgtttgcatagataataataatggtatcttcacccattttaaatattgtcaatttataagaggtgacagaccaattctgtgaatggcggacttgtaaaagtatcttttattcccctggctcagttgttgtcttagaggcttactgtctccatctgctaacctaggcctagtcctggaagcttctagcctccatacaatggaatccaggcctagaatgttttcagcctctgagacttactgctgaattagctcaccctttctagctctttctgagctctggctgcctggttcagatcagctgttctgactcaaaactcttctccaagctgacagactcaaactagcttctttttgctgcttattgagttgctctgcttagcctaaaactaactgtagccatcttttctaatcttctggcttctcctcctccggctctttttgtctttccctgtgtttcaattgttctgtgtggaacccgtgtctgtaacgtttcctggtaactgagaatcccacacactgactagaaagaactaaggtctgcatgagtgttgggattaaagatgtgtacatgcctggacctaagcttttctttccctgaaacttggctctataccacactggccttgaactcagacttcagtctgactctgtcccctgggattaaaggcatgtctacattccagccagatcacatagacctagaagtctttttatgtgtgatctcttaccagagcagtcatgttctgaattaaacttaaaatttctctacagtggctcatgcctctaatcccttcacttgggagactgaaacaggaggattgctgagatggaggcttgcaaggcttccattgtgagtggctacacagttagaacccatcttaaaacacatgtgagtgaaataatgtgcttttctcatcacgccataatcaggcctggccctgtgtcagtctgcaagacgagtagggtggtcacggatgacttttttcttacttgtttgtggccagaggactttgcttttgtaggctccaccagtctgagcccggtgtgctttttagtgctttgagttcctaggttgcctatttgagggataagacgacaagttgatagggtctggtggaaataccaccaaattcttagatttattatcagctttagaggtttgaccatagccattgtctacattcttatctcctctaggacttaaaaacaagaagaaaaattcccatgtaataatactgaagagttcttaagtgttttgttttttttaaaacatgagctcggactggtgagatggctcagtgggtaagagcacccaactgttcttctgaaggtctgaagttcaaatcccagcaaccacatggtggctcacaaccatccataatgaaatctgactccctcttctggagtgtctgaagatagctacagtgtacttatatataataaaaataaataaatcttttaaaaaaaaaacatgagctcttgatgtcagaaaaaaaaaccctgatttttttaaaaataaaagagtacattgaaaatcttattggagtatgaatttgtgttctaaaatatttttttcctgatatctttcagctaattaagaaaacttgaggtgggcactggggactcacacactcctttaatgcttgggaggcagaaacagatctctgtgagttcaaggtcagcttaggctacagagtaaaaccctgtctgaaaccaaaccaaaaaaggggtgccgggggcgggggcgggggcgggggcgggatttataaacattggcttaaacctgacttattgaatggaaagaaatcagttaactgctaggatcgggctttactagatagactaactctcttgtaatggaatttcagatttttcctgtctttttctatcctttctctctctctatatatatatatgccttttgtgtatcaactagtaaatgctatttttccttttcagctgctactaattagcattgtgatccagttccaaactttataaaattaagtcttctatattcagacttacctttgtttctactcattaaaaataattttgagcaaatgttcagatagaaaaataatttttaattctcaactgtttagcttccatagagactgcacttccagctcttattgtacccatcttggagccttgtggtaattcggagtgcctacacatttttgtagatttgcattctggaatgttccaattgatgctttatggacttggtaagttactaaatgtcgtcactcaagtaagtgtgtgtgtgtgtgtgtgtgtgtgtgtgtgtgtgtgttgcctgtgtatatgcatgtacaccacatgagtgtttagtgcccctaactctatgaggtcagaagaggatatcagatctcctggaattgaaattacagatggctgtgaattaccatgtcagtcctgggaatcgaacctggattctctgcaatagcaacatgtgcccttaactcctaggccatctctctggcccaaggaaaattttgtaagaaagcaaattgaaacttaactactataatgtgtaggaaggggtggtgtgtgcagcgtgaaagtaagtatgaaaggaataatgaactgtttgacatctcttccttggaatttttttgagtcctatctgaaatttttttgtatcagaagataatttttttttttttaaatatttatttatttattttatctaagtacactgtagctgtcctcagacactccagaagagggagtcagatctcgttatggatggttgtgagccaccatgtggttgctgggatttgaactcctgaccttcggaagagcagtcgggtgcttttacccactgagccatctcaccagcccgataatttttttattatgtaaaaataacagtgatgactgcttttagattatctgctcaggagttcagtttttattttatcactaataaattgacatataaatgactagtaggaattgctagtatcctttgtgactagagaaaatatttgtgacagtatatctacataatgacctggaatatgtatctatataatgacttagaatatggagccctagaggaattgaaagtttgctttctagtcaagtgtatggagtgaactacattcctagcccttatttcaaggtcagcctagtctacagaggacatccaaggctacacagagaaaccttgtctcaaatttttttttttttttttttttttttggtttctaacttgttcttttattgtgtgggtattctcaaatgatatatatttactaggaacaaaagtgttttcgatgactgctcaaacaatagtcctaactatggtgtatatactctatttagtcagttaatattaaacaaaagaaattgattaaaataagggatttttgattctattatgtagctataaaggtgagttaaattttattattatttatttaaaattgtttttgaaacaggcatgtagctttgggtggcctggaacttgctatgtaacccaggcaggccttgaattcaaagagacatccctacttatgcattctgagctgggattaaaggcatatacctaccacacgtggctaaaaaggtagaattttgaaacatattggcagctcatggaaaataggactttgaatcacatatttattataggtaaatgacatacatatgacagtggtttgttttttaacttgctccccccctccatttaacatggaaacatcacttatttgttgctcaagtatacgacatagttttacgtaacagcagacaatcccaaggaaacactgaaattacctcatctggttaatactaacatttccccttatcatctgctctctagggtagccatatcttcataggcttcagaaaactttcctttctccatctcttccctcatataccagtttgacaagggcaaatttggcacacatcaggtcagacatggtccaagtaagcccaggccttagcagtgaccggtatttgtcagtttacccatagctcaccgcatattggctaggcccacaagctaccttagtaggatgctattaagtatgctaatcttgaagctagtgaataaccaagccaaactggatagtacagttagctttgaggcagcaatgacaacactgacatttttgggaaccatgtcactgtggtatgacaagaattaagctgtgtatttatcatgccttggctgaccatattgttggctggattagcaagatgatggttgtttagggacaggaaaatcaatatggcatggggcaccatgaaatggctcataaggaaggcagtcatttgagtcagaggtggccagtaagcataactaaggttagttaatatatcaatcattcaatagaaaggatttgtgatggatatattgaggtcctgatttttcatcatgaaggcacagagtgtaaccagttggtatgggcagtaactggagagctaggtagagtcctctagcttagacttcttgctgtgatcaacccgggcattccatcaaggcagtgacagacacagtcagccagttccaccatcaaagctactgaaaatcctgaagtcctatttagttaacatattggggacaaattccttgctgttgatgagctgccagggggtaagagccaatattaggtggcaacacaaagttcataaggaagcctaggttattcaaacacaactttgggttcatgtctgccactccccatcctcctatcatgtacccactgaaaacggattaccatagtgatcctatctctcgtacttgaccatctattaaataccatattttattagtagaacaggcaattgcaattaatttggaaactagcctagccagtgtggatggatttgcacgcatatgtgcacacatgtttaacatacatgacgtttagatttctattccacaaggcaggagagaagtggcctactaggaacctccactgagatgctaccaaagtctgagggagtagaatggaagggcagctggctctgaggggttcagtatattgcacaacacccccagctgggggcagccctcaccagccagtgctgctccacccccatatgcctgtataccttttgtttttcaaaaccctttctttagctattttctcaatcattcatagtatacactcagataagcacataaaaatgaaaagggatggacagtaggtttttgtgcatagaagtcaagatgctataagaacatacagtagaaatgtattttgtcaccgttgtaggggctgcagaataagctaatgtcagtggagttgatttcagtgcgggcttcacttctgactcctaggcttttctgaccatgtccttacaaggggttgcacacattcctgtagggcagtgcttctcaacctccttaatgctgtgtctctttaatgcatttccacatgttgtggtgtccccactttaaaattattttcattgctacttcattttttaaaaaatattttatgaatgtgagtgcactgtagctatcttcagacacacccgaagagggtgtcagatcccattacggatggttgtgagccaccattgtggttgctgggaactgaactcagggcttctggaagagcagtcagtgcttttaaccactgagccatctctctggcccttattgctacttcataactgtaattttgttactgtgagaacttaatgtagatatgtgacatgtaggatatctgatatgcgatccctgtgaaggggtcattcaacccccaaagggattgccacccacaggttgagaaccactgctatggaggtgctcctctcttcgagaccccttctgcacttagctacctcaaaagtctgcctttgaactgcatcgcagtggagataaggactttaatatataagttttgggaggcagggactgcaatggcttccttttttttttttaagatattgatctagttagttgaaatcatttcgtgccttccttttttttttctacttaactaattattttctactgccattaaaattttggactggcgtttattagtaagccagtcatttttggacaatgacttgtttggacaatgtttatgcttgagatcatttgtatactgttcaaagcaacattttaataggcagtgatttttttttttagttaagattctaagtctagtaattttctgaattttaagttgaaaatggtatttaattcttataatacaggcaaagaagtatttctgcacgtgttccttgttcttgttagtgaaatgtgaaggaggaaaagcaagttgctgacagctcctggtggattgattttattctctcacatacaacatggtttaaagttgggttgcatagatgaaggttttgcttgtgtttaaacagtggtgaatgaattctttattctgtagacccagccactctggaggacatggaaaaatctttgaatgatgacatgaagcggatcatcccttggattcagcaacttaagtaagctcaagactcaaaagggaaacctatcctgacaatatttcttttcttctccataattagtcttaatcagtcactgcccttaaagtttgtgacatgaaacctgagcacctttggtaccttgaactctaaattgccttggaatgtgtccagccaggatggctgtcttcatctcagattcccctctagatacaatgttggtctgaagggcatgacactacattttcattggtcatattttctccagagcaagtacttctcacaaattcgtagtgaatttttatactgtgttctctaatagaatccaatttgtttttgttcagaagcagttactgtccgaactgttgttcccttttctctaacattgtcatttagtttgtatcaaaactaccttgttaacagaaccagagacagttatctgggctttcctttccatttgggctccactgaggtagcattatggcaactttaccaagctattcttacttacttctgtttctgagacagggtcccatacagctgaagcttacattactatgtagctgagacaagttttgaactcctgatcctccttcctctatctctcatgtcctggcattatggacacgtgccaccacgcccaactcaatctttgaaatatttcataagattattaacttgtactaagttgaccacatttgacagctgttccaacgatctagttgtacagcattgtttttagtccctcttctgttgcctatgtacagttaatcatcgttgctagccctgggtaatcacaaatctagttctctaaatttggtggcttggtttttcactttttatataaacagaagcacgagctgtgtgatctgacgtgcttcttccacttgtattttcaagggttatgttgtagcatctatcaatattttgtccttatgctttaatgctgaatggacagaccatgtgttctttattttataataaatgggtttacagtaagtggagttttagcacttcttcttggctgttgtgtgaacttccattttcattttctgtggctaaaacttagcagtggaattgttgagatagagagtaaaaattatgttagacttttgatatatattcttaaacttctttttaaagtagccatgccactttgccattcaatcagcatatgagggtttctgttttggcacagatactcgctattgtctttggtaggaggaggtatctcatggcagtcttagaatattttgcctctaatggctaacgatattgagcatctggtttatgggatatttttgtactatggaacaaaaacagattctatttaaagaaatgctgggcatggtggcacatgtctctaatcccagtacttggcagaggtagaaagattactgagttcagcctgctctccgtggtaacttttaggttagccagaggtatatagttggggtcctaatccccaaaataccaagccaaactaaacaaaaaccccaaatgagtcacatataacataaaccccagcttctttactatttgagtcatagacataatgttacatgtactccgataaagaaaatcagacaagcctaccctaggaaagtaattaccgaagctgcacaattttcagtgtttataggaagttagtgtaaagctcacctagaaatttatttccagaatcaaaacaaaaagtgaaggatgaaataacatgctggacatgtgttctagcctcttgtcctagctctcaagtggttgagataggggattgcgaatgggctacattgtaagactttgtcccagggacagaaagaaaggagaaaaagaaatagtattcccacatatactttaaaagactaccctatatattatttattttgtttggtttttcaggacagggtttctctgattaaccctgcctgtctttttgtagacttggctggccgtcgaactcacagatctgctgggctaaaggtgtgtgccatcacacttggcaatatttaggatttttaatgtaacagtgagccatattttgtcttgtacactatgtaggtagtctgaggtaattaaggaggctgtgtatgttaatgtttatcttgttttttttaataacattagtagacataatagtctcaaaaagatattttgattggaatgaattcattttcaactcttgccacaaacgaagcaaaggatacatttttaacgttcatctttatagtttttcaaattgattctttaacgttatgattagatggttgtgacagctgtttcctcacagagatcccactgcctctgcctcctgagtgctgggattaaaggcgcctgccactacaccccccctgaatcactttggttttcatgattaaacaaaaaaaatttctaggaatagggagggagggagggagggagggagggagggagagagagacagacagagagagagagagagagagagagagagagagatacagatctatgagtttgaggtaacctgatctacatagtgagttgcaggcccaacaggctacatggtcagagtatgtctcaaaaaaaaacaaaaaaaaaaaaacccagaggtccccacttcctatttcacactgggggagctgtccaactgcttttaagatgtactatattctgacacagtttcattgcacatgcctagcatactatttgtaccacatgtagtttttgcaaactgacctataccctattggataaatggagcaagcatgctctcaatagttgggccactttgtcactatattgctatggaagtgcttgtaccttagctcattgtgcatcagtgagtctgagccagtgcttagctcttttttcacatagatccttatattttatcctagccacaaggatgatcatacataaacccgggaggagtactatagcaaactcatcaaagtaaaatcccaggtctgacctcaatgggaggagggaaagggtagttaatgccagacgctttacacatactttttatagaaagtggtgctgacatcttaagtgaggaaagagaaataaagtgtttttttttaaaagattaataataaaattaataaataaatctttaaaaaaaagaaaaaagatttatttacttattatatgtaagtacactgtagctgtcctcagatactccagaagagggcgtcagatttccttatggatggttgtgagccaccatgtggttgcttggatttgaactggggaccttccgaagagcagtctgcgcttttaaccactgagccatctcgccagcctgaaataaagtgttttatgcttgcttgtttagttgtatgaatactttcgattattttttttatttttgagtttatactataggtccctccaaaatatgtatatacattcatattcctaaatagagccagttgttccacatatgtatgttttcagtgctgactgttgggcactgaacagttggtgtgcttttcccactttatagtttttggtttggttgttttgtttttagtttttctctgtgtggtcaatgttgtcctggaacttactctgtagactaggctgacttcaaactcacagggatccctctgcctctgcctctgcctcctgactgctgggattaaaggcacctgccactacccccctgaatcactttaggtttcttatttaaagctgttgagtttagtttgatctgtctttaagcatcaggaatcttccattccctatgctaaactaagctactaccttagtcttaaagttcatttttcctcacaaataagctagttgccaaatacaaaactggagcaatgactcagtgatttggttgtatgtcagcgtttctccggctgtcctggaatttactatgtataccaggctggtctcgaactcacagagatctgcttgcctctgcctcccaagtttaggaattaaaggcgtgagccactactgtctggctttttcagttattcgttagtgttctgtaatttatttgtatatcagtggcatatagttaaccagaaaagttacgactttatcatgtggattatcttttaaattaaggttttggctgggacaacagcgttgcaaacaatctataaaacatctgcctacaataaccactgaaacgttgcagcttgccaactattcaacacatcccattggaagcctttctaagaataagctgtttattaaacttactcgccttccacagtactacattgtaagtatgccaagcatgatggatcaaattcagtaattttggatgtatgcagaaagctttcttgtctagtttcccatgcaaacgaattttccttggtgtctgactttcatatagggatttcaacccaggggtacgattaaaggaagaaaagtcaaataagctgctgaggagtataaggtagccttcacctctcaccctagtgcctctgccgcagtgaggcctcgcttgttgaggaggctttgtttacattagacaaggaaggcttaggttctaattggaatgaagtgtctctttggttagatacaaaaaataatgtagagtgaaactaactataactattaagaagatttggagatatttggtatcaagacaaacttgctttgttttagttgaactagaatttggggaaatataggctgactaaagtagattcattttctcctttattgaaggtgtattctattttgtggatggcattcttttagtgtacaatgagattttttttcttttcatatttccattcttcctaggtttttcagatatttgacttttcacatgtttatttttcattttggtttttgtttgttttgtttttgagatctttgaattggttagaattatttttaagaatttactataaatatattttcacatttaaagtagtttctctggacagtaaatattttcgacaaaaatctatggtgcttgaatgttttaattcaagatttctggttgaaaggaataggaatgaatttttaagattttccgatgtaccttttaatcatactatcttaaagtgataccaggtaccagctgatctatttagttaataggttagtaagtcttatcgctgatatggattttatcaaaattcataaaacctgaatcagccagtgaacatatttagaactttgtgctcagtcataccaaaaataaaattgaagtaggtgcatactgtttaagtttctggttttatttggtgtcaatgaatagcttttagtgtcagtgtcctggtaataaaacaaaaattcattccactgtaagtcattctccttcccttagatttgtctctatattcataagcagaaaagtaactataaccatagtcattaagaataggataggagctgtgaggtggtgccatatgcctttaatcccagcacatgtggcacagaggcagtgtctctgggatatctgaggtcaaggccaaactcgtctacatagcaaatttcaggatagccagggctatactgacaaattctgtctagaaaaaaaaaaagacagaaaggaaaggatactatataattgattacctcagaatttattttctgtgttgtaattagatactgtgaaaatctgtgcttttcagtctcttgacatttcttttttgggcggtgctggagattgacttcatgctagaacacatgctgggcaagcaatttgccattgagctcttcttttttatgttttaagacaatgtttcattaacttgctgagttcgctttgaacagagctctgtagcaaggcgggccttgaactcatatatgtgttttagtgttgattgtttctttggtggatgtttgtgcaccatgtgtgtatagacagaagagaagatctaacccctgagactggagttatatatgcttgtgagctgccatgtgagcgcagtgaatttagcccagatcatctggaagagcaatcagtgctcttaacctctgagtcctttctccatccccagaccttaaacttgtaatgttcttgccttatcatctgcaatacctgcgattagaggcctgatccaccaggcctacaacaaactttttatttttgtacagtatacattttggtgactgaatactattgtaacctctatctgagtaatgatacagatttatcatgccactacgtgtcctcatgctctggcttttagctagatgtttacatttgtaaaatgtgttaactgtgacagaatacacaaatagacaaggtgtggcccctcaatggcactctcagcaggcacttacagtgcttgctcactcatgttgtgcccacagaaaccccagtttctagttcataagtcagggttcagctggatgtgttggcaacaggggtttttattcccagtctgtggaaggtagaggcaggaggaatcggctcacagtctgcttgggctacttgaaaatctgtctcagaaacaaaaatgagaatgcatttccccttgtttcccaatgagaggtgggtcaggcctctaatcccacttgtttttaccttggctacaataattgaggttttagggtatattcacaggtaagggaggtaaaaggcaatttaaaattaaagggcaataaaagattaaaatagataactttatagaagacctggtatattatataaatttcaaggataaccaatgacaatactttatctcatttcttgtgtttactgtctacaaactgcacttgatgtaagatggacaatgtacaatggttcttattctactgggtctcacctctttctgatttgtgtcattttaggttgtggaaatgcttgaggttcctaataagcctacgcagctatcatataactattactttatgtcggtgagtactgcagatcgtgaggacagccctgtcatggcactgctgctgcagcaattcaaggacaacatccaggacctgatgtcctatacaaagactgggaaacagaccagaactggtaccaagcacaaggtatgctcacataggagttagcagacaatgtttgtgcaacccccttcccattttatttatttatttatttatttaaatttatactattttggttttttgagacagggtttctccatttagctccacctatcctggagaactggctctgtagaccaggctgatactaagctcatagatcctcctgcctctgtctctcaagtgctgggtttataggagtatattaactgtgcctggtttcattatttttaagtgggaaagagttagatatagtttttaaggtacacagcagcaatgaagcagctatgcacattttctgtaaaaggtgtcttcctctttggagagtaggggttggtgatagaagtggaccccagggctttgtgcactgcaggcaagcactctccactggtccttggcagcccttgtttgtttcttttgcagacagatgcagagcttttcatgttccgtttctttgtagccctggctagcctcaaccatagcattcttctgtgttttgcttcctgagcaagaatttgaccaaaggcttttgtttgaattaagaacaatatatcattaaccacaaaggaacttgctaaacacaaactacttgctacttagttacttgtgcctgtgttatgagttgtttaatttgttactaccctgtgttgaaaggtcacatttgtttgggttagccccaagctttgttgtagtgcttccattaccttagtgaatcacaagcacacgtaattttttttcacacattttttaaaaattattttctagttgtctgatgacccatgtccgatagactccaagaaagccaaacgatcaggagaaatgtgtgccttcaataaagttctagctcactttgttgctatgtgtgacaccaacatgccatttgttggtcttcgattggaggtaagttgggaattttcatatgttaactcaaattgcatggcaccagcaggagtagtatctggcccacacaagactattctttttttctcccattccactatctcatagtcttctccttagattaatgggaattaaattgttcccagttaaagaaggtggacaacattgtttaggtcttatcagagatggctgcttaataaagcatggcattttgagttggtgaagtaatgtttgagcactacttacactggcatcctttctgagaagtaaatcagaaaaatattaaactaaatgttactttgatgttgtggaagaacatcagatgcagaattcatgtctttcaagagtatggcgttgtgccgggtggtggtggcgcacgcctttaatcccagcacttgggaggcagaagcaggcggatttctgagttcgaggccagcctggtctacaaagtgagttccaggacagccagagctacagagaaaccctgtctcgaaaacaaacaacagaatatggcgttgtagggttggagagatggctccctactagagcattggttgttctttcagagaacccaggttcagcacccacatgacagttcaacactgttgtaactcagctccaggggatctgacctcctcatatagacatgcatgcagacaaaataacaatgcatataaaataagtcattaaaaagattgtgttgttatatctaccatgatctctaaaatatgaatgtaaagtgaaataacaactggttttttggattttgctttttgaaaaaggggcttatgtagcctagctggccttgaatttgctatgtagctaaggataaacttaaattccttttgtttttgtttctcctttcctatcctaagattacaagtcatatgccatcatgcttgctgaaaccttcaacttttccttattattttttaaaagatttatatgagtacactgtagctgtcttcatacacaccaggagagggcatcagatcccattacagatggttgtgagccaccatgtggttgctgggatttgaactcaggacctctggaatctggaagagtagtcagtgctcttaactgctgagccatttctccggccccatttttcttcattattattagtactttttaagtgtattggtgttttgccttacatgtatttctgtgtgagggggcctgatccgcattgtttctctcttggatgttatttcaattacttatagaagtccctgagttactgtttgggtgatgggaagagtaggcacatgattttggggcatgcaatgcattcctgtctacctccctgtgcgttggggaaaatggaaagacacgtatggtttttgtaggtgcacatggttcttatactctactcagatgtttttgtctttctcctctgtgatccatacatgctatacacacacggatcttcatacaatactttcttgaattcattcaagctcttaaaaacttaactacaatctcctctttaaattgatggataatattaaaataccagctcattttcttcttataataatgaattctgagctgtgaataactacatgtaatcttactggcagtgtttttctctttattgattgcaagttgcaagtcattttttgagctgttctagactttagttccttttgagtgtaaacttgtattgtctatttggtcatcagctagctttctaaactttcttcttctgactctcaaagtcaggctagataaatatttaaataatttgtgggacagggtatgtaagaatccagtcatagaagccatgtcattgtttactgagggcaaggctttctttcctccatcagaggaccttctggcctgccttcctaagatggactctgccagatgagtttcagcctgtccctacttttgcctgacttcagtttcattttgacgaaacagtagaatcacaaatataatcagttctcgtttttagttccttcatttgaaaccacttgaactgattctggagtacttacagcttgtagcaaaaaatgggagcatactgtgaattttgaagatttccgtattgcggatattctctttgaagcgaaacgccgaagcacctgtgacttgtacttgctttactctagtttccaagggcatctgagaacaggaagactgctcatgctgatacactgtcactttgacaaagattgcccttagaaaagatgggatcaagatagataacaggcagagaaaagctgatttcttttgtgaatttagcagtttaatacccctgtgctttttctcttttcagttgtctaacctcgagataccacatcagggagtgcaagtggaaggtgatggcttcaaccatgcaattcgcttattaaagtaagcttgtgttctgtgtctaacttggcgctacttgttgcagtcacagtggagaacagtttctctcctatggaacagcgtaaagcagtgctcacagtctgtgtatgtcgtagatttttgtgtagaattacggaggtccaggggaggttcttttttgttcatttggtggcaatccagcaccatctggcattttagggcatcatttgttaaccagataatctagtcagtgtaaatgtttcaggtttgatttttgtaaagccctccaggatgccttgggtttgcatagcagggaaatataggctacttcaaagtcaaggtgggaattcccaggaaagtgccagttgtatatgcagactgaaagagtgatgagaattagccagacgaaagggagatggggttagagtagaggtcctaaccagaagaggtaactgctaatatgaagggttggaggtaagaaaatgctcagcatgatggatctgaatgttgagcaacagataaaggcaggtgatagagatgagcacaaaggtgtaagcaggaatgcctagagcccgtagagtcttttttttttttttttgtcattaagcaatgtagaccttatcctactggtactaggaaaccatctgaagctggacactctattctagcacattcctcacaatatcttcacaattattcaagaggctgatgacagaggatttagaccagttttaacattacagtgaagtgcccattttaagacacaaaaacaaccccaaaaagaagccaatatgattttaagtacaaactgacatcattagaaaagtttttctggaaattgaaccttatggcaatatgcagaataaaggagagtgagattgaagtagcaacaccagttgaagtggttcatggtaaaattgccgttagtttggactagggtatgttcctgtaaggacttaggagatgaaccagtcaagggttggtgattagatagatttcagaggtacaggggacggaggcagcaaggactcattaattttgtcctaggcaaaagatgggtgatggtttgaagtagaggacaccacagtgtgaaaggacttttctaagtttgaggggcctacagatccattgagcatacacaaatgttctcaagctcacggtaacgtttggacaggtgacaatgtcaccatcccagtggtagtaagtgagctgacatagcaaattagatgaataggaatgtgcaaacaaatgaagttgggtgctgggcctggtggtacacatctataactccagcacttaggattcggatgcaggaggatggccatgaatttgctttcagtctgagttagatagtgagatcacgtcttaacctcccaacccacacacatacaagagacgggaaatcaagctggtcataaggtttagttttaaatggacagaagaaaaaagaaccaaatgatgctggaaagtacaggtagtgggtggaaagctgaacatgagaaatatgagataaggatatgtcctaatgaactttagtagcacattaaaaattaagaacacttggaaagggggagctgttactctaattcacttggtagaatatcttcttgatatacatgaggccatgtatcaagcttcagcagctcataaaccaggtttgtcgcatgcctataatctcagtactcagaaggtggatggagaatggaggagcaattcaaggtttgaattgctttgcataaaatagattacaaaatcaacaagttccatttgactaccacagataaggagatgataataacatctgtgttttattcgttttagttttcacaatcttttgaagcatcttgtcaacatttttcagagagctttcacatttgtctctgatggaaccagggcttgagacatgtcagatgagctgcattccagtaccctttctacttgaactcaagcaaactctgaagtgtccttcctaggaaagatgcattcttctttcctctccctctccctctccctctccctctccctctccctctccctctccctctccctctccctctccctctccctctccctctcctcattaggtattttcctcatttacatttccaatgctatccaaaaagtcagcatttttgttttcttttttaacttcatttcataaaatttaagggaggtctttaattctccctttcccctctatatttacaatgtaaagggaaaaattcaaaagttgatagatttaaagacagttttccagtggctgttgttatcatgctagggtatttaaagggaagaatgataaatgaggatctttatgattgtttttttttcattaaaaccttatactgattattataaatataatcttttactaactgttctaacacatttgattttgagaaactcttctttcaagcatgaattaattttcaaaaagaatgagtcaaccttttcaagctcttaagtttgggcacatttttgctttttgctgaaaatatgctctgttcttattccagcttttttaactctttgaaaacctgaaataaaagtatcagttctatcacagtaactttcttcatctgctctgcttcactgacctgttaccttttgctgaatttaaagacccttgttccttcagatgagatacagaacacgtgctaagaatgtatgctcatgttgcttaggttttgagccttgggtaaacttcaattttcacccgaactcacactgtctcaggcgtgaatcattgtttttcatacccccatgtgtttcgttgcttcttatagccaaggcctggcagataggcacaactcactctttctttcttcctttcttccttcctttctttctttctttctttctttctttctttctttctttctttctttggcaagtcttgggacttgagttcctactgcatgtgcatgtatgacctttagaaaaacctttccccttttgttttctgtcatacttgaatcctgactttactcttagctccctgagtaacctttccgcttgttactctataatatatactttttgatgtttgtttgctcagacatacatgttaccctagagaagttttgtctaatttctcaggttattcaatgctagagaaacatcacgaaggagtagctatttaaattaaacttttaaaagatttttgggaagttttcaaataaggttaaccctctttattcatgaaatagtgtcctcagttcttattcttttttgtattaagatattttttgtatatggttatttcatctgtatgaatatctgtgcaccatgtgagcgtgcatgcactaaaaatgacaaggatgcactttgacagatctactgtagttgaggtcttaaatgaaatggagtcttagacttcccttagttctcactttggaaatgtgtaggttctgtgctttcattttctctccagatggatgtgatgtaaacctaaggtgaacagaatatgtgtctccacttatactccagactcaaggtgaaatgtccgtctaaattagctgctttagagctccccaagaatgcctgttgtgaggactaagggtgggcaagttgaagatcatttatccaatattggtgtggttctttgaaaatggttagcccatagagagtagcagtgttggggtcccttctaattaagatgtagaactctcagctcttccagtgccatgcctgtctggatgctgccatgctttctgccatgatggtaatggactggacctcagaatcagtccagccccaattattaaatgttgtcctttataagagttgccttggtcatggtgtctcttcccagcagtggaacactgacaaagagtcatgtcagttaacttttaaagttgaatggattaagtggaagtcagcttttagagttttctttaaacatcaagctctagttccattactttatgccaggtaaacactatataactaatgtttcaaaataattaaaaaaggggtatgaagcagttacattcaattaattttttggagagtccatagaaaactgattactacagatacagattgagctagctataacacggtacactcaatttcagtctcaatttggactgtgtgttcattatcagtattaatgccaaaacagatcacaatttgttaaaagaatcatattgttgtccgtcttcactggtgtttatgtccatttgtctctgtatgtttgtgtgtctgtctgtgtgtatgtttgcgggtatattaaattctaaatatacatctacatgcaaggaaaggtttttttttctaggaggaatttacaggaagtagtttgggctatgccagatgacacaaatctctccacaacaaggtgcttgtctctcttaatccctagggtccccatcatggaaggagagaactgacttgtgcaagttgtcctctgacacatataccatggcatatgtatgctttgacttacagaataaatacatttttaaaaagaaactattttaaagtgtctaattttatgatagtaatctgttctcacagcagtcccagttattggtttaaaccaattaccacttttctgatttggcaccaacattatccctccattgtaagcagtcgggcatgagaaaccagtggtagggttaactattttcaggtttaaatactacatgttgaaataccccatccaatatgattgtctggctctgactgacagattatatttggctttcatgtggcttctaaacaatccctgacttttgacatggataaagagaggccactgtggaacagagtatttgcccatctaccaaagctgcgagtgaaagacaaatctagaaaatatttccaaactttgtcatcttattatgtttttggactttgatcataaaagccacacatatcttggtcatttgcctatttcacaagttcctttcaatattgccatacattctgagaactttgcccattttttctttgtgacagtgttttatgtagcatatcctagtcttgaacaaagtagcaaggcgattttctagtctcttggtccctagtgtaggacttgaattgcttttctactgctggccttataagcacgatatcaagctcaacttttataatgcattttggatggaactatttcttttcaatgtattttccctaccactattctacatcagcaggatctatgtgaatcagagttgctcaggctgggtttgaatttgagatcactttgccttcatcttaagtagctgagatcacatacacacttgggccaccatacaagaggagtcatgttctcttgtctacaacagtgcctatcaatagctagatatcttgtacatttttatttttttccaccaaattctagagtttcataagatgtggagttggccctatatatctctacagatgctagaaagataatgcataataaatattatgttgttataaattattttgttataaacttgtgacctttttacaaaccctgtactaggtagtgcttcaacatttaccatctttctgctatgtggcccatacatttttcttggtattgaagcagttttttcatgacagtgtttattactggttttatttttttactggttcctggaggcttcattcctcctacctggcctgtgaccttctggttcctccctactttctcacctgccctcctcacttgaggttgcctatctctgttcctgccctcagctaactaccagtaggaggtcaaggagcctggtgcctggcccaagcccttccattcctgccagtccacttttgaagctgccccagaggccccagtgggtacctgaacagtgttgctcaagctctgcctctggaagccagcaaagatgcccaccaggagccacatgcttacgtctgctgtgtactctttggctcatggcacctgccagccccatgggccttacccctgccctcttctttctgatatttttctttttggctaactttatctggtgatgttttggttcctgccaataatttcaaaactcaattggattaggcatgaagattgctgcaaattctaggcccgcctggactaaaaataaaccaacaaagcaaaaatctgcatgttgaagagaaaatgtgtttaaagcttcaatggagaacattgtgatgcaacattttaatgcaatatatttcacttttgctctatccatatatttaattttttgccacatgcaaaaaataaaaaaaaaaataatgtctcttactgtttttcagttccaggtcagcggttttcaacatggaggtggggtggttttaccctttaaggaacatgaagggcaatgtctaaatatacttttatcattacctaagcaatcagggtccgaagtgctattggcatctagtagattgaggccatggaggcccatcacagctccccacaataaagacttgtccagtcaaaatagcaatattgcccagaccgaggagtccattctgggtattctgaataagaaaattgaaacaagtttctgtatttccagatattgccttgataggaataattataaaatctaagatccaatctgtgagttgagagatactatataattaatgtagcagctgttatttcatctactactgaaataccagctaaaatatattgttcataacattgtatggtatggtaaatagtctctaaagctgtagaaggaaaatagaaacactgtctttgggtttgggggttggggggttaaaatgagagtcctaatataggttgatgtcatctgatgtgggctaaatattaccaattgctgggaactgttgcattgtagaagggatctagaagccatgttggacctaaagctctgttgtcatgtcataccctgtgtgtcatttttactttgtgctttgtctttgtgcataacatacatctcatgtgtcatctttcatcacaggattcctccctgtaaaggaataagtgaggaaacacagaaggctctggaccgctctcttcttgattgcactttccgattacaaggtagaaataaccgcacttgggtggctgaattagtgtttgcaaattgtccgcttaatggcacttccaccagggagcaaggtaagatctttcacactgtgtttttgcttatgtccatatttttaaaagtattggttactattagttttttcctttgaatcctttaggaccatcccgacatgtttacctgacgtatgaaaatttgttgtctgaacctgttggtggcagaaaagtagttgaaatgtttcttaatgactggagtagcattgcccgtttatacgagtgtgtgttggaatttgcacgttctctaccaggtacatgtaatagtcttccttttaaatgaaaatacctccttcatgtaacagaaaaagtaaaacctgtacagtgttttaaaaaaatacagccaaaagtatctaaggaaaattgtcttctttaccgcagtgtatagtctctctttctccggcggaaaaactgttaaatttcttttatttctagaaatttgggcacatagacagacttgtgagtaatatacttttgtgttataatatagtcctcatctactgtgagcatgcaagctaataaacattgtgctgtgtcagcatgataccactctaagaggacctgagagaatggagccaataaatgaggcagactttataaataataaataataaatagccaattttattcagagcatcatattatgtataccacaagggttagatagtatcatataagtaaagtatacaattacaatggaagtcacatgtggcaaaacatgttttccacagaggcacagaaacaacaatagttggaacgaataatctgaagtcaactcagatgggcacaaaagcacattccaagaatgatgctgtttttgaagacactgaggtcataacactcagaattctcatacggctccattctttgattgtgtcccaacactagcacatttaattgcacagctacttaggaaatagctatcccctattttacagatgacaaaaacatttcacagagacttaaaaacttcactttgtgtaagagcttttcttggcatgaactgagagcagagaaggccaggacagagaaagtgccttgctgtattagccactgtgctagaccttttccatggctcaccttctctgtgctggctttacatgcttttgattctgccactgccttggcaaacaatcaaacgggcatggtgatgtgggcctgcaatcatgacacttggtagggaaaagcagcaagatcgaggcgtatatccatcacccttagtacacagagactctgagggacaatgtggggttcaaggagaccgtatcacaaccaaactaggcatatgatttgccaaaatgctctacttttcatacctgcttcttaaacatgtccgtgtccgatcaatatgcattttgtttgtttctgcttagaaatacctgctcatctgaatattttctcagaagttcgtgtttataattatcgaaagcttatcttatgttatggaaccaccaaaggaagctcagtaagtatatgaattaaaacatggttgttctgtggcctggagaaataaatggcttagtgcttatgtgcactgtcagtatttcagaaaacctggattcagttcccagccagcccccatatagcagctcacagcagtttgtgttccaagatctgactccctcatccatgcaggcaaaatatcaatgcacatgaaataaaataaaaataaatattgaaaaatggaggttcctttcttatttatcttttaaaaattaagaacttaaatgatagttgccagacactgcagcttggaaaagaaacaaaggaaagaaaactgccttaaataaaggctcgaggaacatcaattttaaatgctctgctgaaataaaagtgtgatatatgcttaattctttaaaactgaaaaataaattatagtgtctttagagcatatgatcttgattttaaaacaagcactcttgacattttttccttcacagacttcaattgggattcatgtttaactttatatgaatggctttgagaaatacagtttgtctttggtttgagttatacgaaaatattcagtctttattcgtatcttaatcctaagtatattccctgtaatctatacttcttttccttaaaaatgagttgggaactaaagagaggactcagtgattgagaggctgtactggtctcatagaggatccagcaaccatctgtaactccagtcccagggtttctcggacaccagccatggacatggtacacatagagacttgtacaacacttgtattcgtttctctctagacacttctataactagtaatgtctgaaattattagtaattgaatgaacatgtgtttgaggattttccctttttattataacagtgcttgctaccttagttgatggcattgagaatatgactctgcattgaaataaatctttaaatctcaagagttgcattttctatttaaaagatttatatttctagtttatataataaaagggagatgatatgtatgctcataggctctgttgatctatataaatatcatatttggagattgggagcaaatcttagcacattactcatttttacaagaagccctcctttgatgcttgctgacttatctttatcatggtttgcacctggaatctgttactttgcagtttgtttcacatgtgctctctttgctctagattagtattcagtggaactccattcatcagaaatttcacattgcgttgggaacagttggcccaaactcaggttgcagtaactgtcacaataccattctccatcaacttcaagaaatgttcaacaaaacaccaaatgtggttcagttattacaggtaattaagttctctgtcttaagatgtactagtagtatgctatgcaaaacacctaaaattatctgcatttctcttttaatgacgaagatggatgtttttgtcttacatggtttaaactctgcctggagaacttaattaaaatgatctagtgcacttcaaaagaaacttttctagaatgtcccagaatgttcatttgtgacaatgagacagaaaattgtaagttttctgcagttacatgacaactgggtgatatctctgtttcttccaggttttgtttgatactcaggcaccattaaatgctatcaacaaactccctactgttccaatgttgggcttgacccagagaactaacaccgcctaccagtgtttctccattttaccacaatcatccacccacatcagactggccttcaggaacatgtactgcattgacatatactgccgtagtcgaggcgtcgtggcaatacgggacggtgcctatagtctttttgataacagcaagttagttgaaggcttctatcctgcaccaggattaaaggtacacacttcctcgttagggaataatagaataaatatattctcgaaaaccattcctttgagggagaaatgtcccattcgaatttagtaagcaatacagttgctatatcttctctgcaacctcattttggaggagctagggtttgcagtaagttctgtgtctttgtacatgaaatgttgggaagccccttgtttcctcattctctggttaataagtttgggaatatgaaagagcataatatttgcttattgggactttaaaggaagactttattgcttgagatcctcatgaaagatgtttggagagtcaaatagttctaaaggctgcttctgaaaacttgctcccttaccctactcctggtgtgttcctgctcctcagagaaaactgttgtcacttgtcagcacttgtcaggtagctgctactctttgtgtttatatagctgtatctctgagtaccaaggtacgctgtcacttgttgagtaattctcaccctcaaaagggagtgcttacaactttgaaaacttggtttcacttactctttcttccttcaggctgctcctagtatataagtaaatacattggcctttctcctggttttacaataaggttatgtagcaattgtgatttcgtaggggtttgtttgtttgtttgtctgtttgtttagtattcttgttgttctgaagatacttgtccttttgggcctccacatggaactgcactcatgcaaaaatgtgttctcacaggtctacatgcaaacaaacaaaaaaccctagtcaaaactcggttgggattagtgtggctcctgggaacacatgagagcaggagcttgaggtgtgttgctctgttgtgctcacagtcaggaagcagagcaggttgcttcctcctttatttagttcagtctcccaggctccgtaaaatctgttactcacattcaggatgtgtgatcttaattctctggaaccaccctcagaagcccattcagaagtttgtcttctgtgtgactctacattcctcatgctaacagtcaggttaaccattacacatcccatttctttctcttacattgctgatttttgtagtatgcctgctatagtagctgcctggaagaaggtacataggagattggttgaagtccatggaggttattggagaccttgtatgtttgacagtgtttttagtttaccttcatttaactgagagtgcctaggtatagaattctagactacgatcattttttgtagaatgtttgaagctctgctgctttgttttctacattggattgtgactggcctgaaccaagtgcctgtaagccttaataatctccttgggaggttgttttgtcttttttcctcacagtactaggtttcaaatgtaccttgatactccttacatcagtgctggggttcaagcaccttatcccctgagccatctgcccagcccagaagcatgttctcatatggatagatcactttctcttccctttcatctttcaatcttaactccatttcttttgtagaactttgatctctttcatgttggtgcctttcttcgattattaagtaattctttactctctgctcttatttataggtaaggtttggagactctggtgttcatcccaggacaatctgcatggccatactgccaaaatcagtagctttaggtctcttgttgggccactgcgaatttgtagaaatgttgtatatctgtttccccatttgcaaaaggtcaaaggagaggatgaaaaaagtcttaccagctttaaatatatggcctttaatacccattttaagggtggtaacctttttctggattgctgctggatccagtcttcctgcccacacagagctgctcctttagaagctggtgatgcgtagagctctgggagagtagtggtgaattttttattctttgtatagtttttgttttgtttaatatggatggatgtttggtgttaaagagaagttatttaatcccatcttggggtttctacccatctttgaccatttagttccaggataaaagagacacacaacctttttgtttaaaataagccttaaacagtataagagttggacagatacctacctgctgtgctattagaatctactttgctattgataaccccaaattattatttactacttactgtatttcatttgggctgcttttatctctaattgacagccctcagatccatgtttttatagttcacctaactcatggtgacttctccttcctcctcctgcaccctttccttttcctatgatcccaagcccgtgaaatgtaaaccgtaactatgtcttttctgcccagcaattggctgttggcatctttatttaccaatcagaaataacttggaggacagggccacttgagtccacatgcacactccaggtcttgggagcccacacttagcattatagtaaacagcaagaccaaacctcaacaattctcctttttagttcaatattaggctcattttctctcagatatagattggatacaattatatagcaattaggaaaattactaggtatgatacacatttataataggtattttatcatctatcctaacttaatgagtttgcagttctgtacctcagtcatctttgattttaacttgtattaccatctgaaaccaatcgtttacacctagaacatcttaaatcctaaccaattctgagactggaactatctagttttcagccccatcagaggtttaagaaggaataaatatttgaatattcaggaacacagcttccaaaatttaaacaattgacagctgacaatttggacagtctctaacatttcttataacattggagcatctttctgcagccttctggcccagaacaactgactgaagagaagtatgaaggacttatgaaggactagctttagcttaccttgtcttggcagagcttagtagttgactatcccgcgtctgtttatctttttttggatagcattctgtctgcagatgaagtcagggcatttcttgcctagtggctagctcgccacaaatgaagcaacttcacatggaggtaatgatgcttaacattttctttgaagtggaatggggtatgctgtcaggaacagacacatgttttgtagtcaaatatcttttaataataaaataaccttgaatgtcatactctgtggttctctgatgcctttgaagaccatctacctatatacagcataactaaattgttaaacattattttttatctatttactatttgagtgaccttgagaacattttattgtaattatctaaattagactttaataaagtttgactatctgactatttatttgtattacttaatttttctaaacagtttataataggagctattaaaaggactgagtctaagccttgtattcttaaatgagttgcacatgcacaatgcctatctaagaggaacaatagtaattttaaattctgtgtctataaaatattctgtatcagtgtaacaaattataacttcaattttgcatcaaaatataaagatctctaccattgttagattatggctataaaattcttttatttagccgggcgaggtggcgcatgcctttaatcccagcacttgggaggcagaggcaggcgcatttctgagttcgaggccagcctggtctacagagtgagttccaggacagccaaggctacacagagaaaccctgtcttgaaaaaaccaaaaaccaaaataacttttatttaagagtaaatttaataattcatccttatttgtctaatttcttatgatatttctatatctatttcttttcaaccccttccctttacctgagaaagaaagggtagagaagaaggaaagatagaaatccctcagtgtaagccccctattttatttcttctgtttccgagaccataattatgtgtaaattatcccttaaagtgacagtatatttataattcataaaaaacaaagccatctactccaacttaagggactgggacaacagtattctaattattttctgctgaattgggttgaagaatttctaacctacaaggaaactgaaaaaattgttaagtcaaaataacgctagttagcatttgttgtccagtcttcctgtgttgagaacgtgcagggcttaactgaagtcctgtctggaacagtctgaaagactggatgaaccaaggtcattgggattaagcagtcttttctgaagctgttctagatgcaagtctctggaaacagcattagttgaagtaggattaggcagggagctgaaacaacagataatctcagcacccctgaggttcaatgttgtcagagatgtactcttgttatttcattctttaatatatgaaccttataaccaatattttgttctataaagatatttgtatggaatgtgcacggttcacagatcgtttaaggattaatttttactccttgttaagttagtttgatcagtaaccaattataataagtcctcattcatgtcatgaaagaatggcatgatgaattttgaggattctgtagccaacaagatttacaagctatgtatatctgaagttctggctacagacatttttatgtctcagccagtttcagggctgttcccatgtagaggggatcaacaaatcatgttacctgtcctgtttggtttacttgatttttttttcccctcctgtctgcaactaaactcatcaaatcttatcctattactaaggaaggtgtcctattaacagagatagagcctctctctcaaaatagcaacccaaagtcatcaaaatatagagtaattcaattagcagacttaacaatttggtctacatatatgtctgtgtaccatttatgtgtctgcatcctgggaactagagtcatagatgtttgtgagctgtcatgttggtgcttggaaatgaacttgtgtccctcaggaagagcacccaaacctcttaactgccaaggtaactggccctgctactctcaaagtgtcttgagaatctggatggaagtacctttgcttcttggctttcctggtggcttccttaggatatgagtgttctaattgggtagttcagccatctgctttagcagcttctaggagcttccagcaacttccatggtacatcgctgtttttttttttcttcttctctaatttaaaagactatgttcttttaataatcctctaatgattttgatgaaataatgacatgcctatttgaagatgggaaagcggtattaagtggagaatcagactgcaaaggtgactcgatggataagagcacttgctatgaaggaaagaaaatctgaggtcaaattccttgcacccatatataaactaacaagccaagcatggctgtgtgtgactatgccttcattgttgaatgaagacaggtggtttattgcaatttactggccagcaagcttaagtggagagcttcaagttctttcagacacgccccccccccaaaaaaaaaagaaggaggaggaggagaatacaagacccagtcacgcagtcagtcctctactgacctgtatctgcacatagaatccttgcacatcctgagagagccatacacagaaagacatcgcttgagacataaactctagtagtcttgcttacgtttttgataacataccttatttgaaaaggctttctcactccagatggttcaggattaaaatgaagcagtctaaaacaccaaaagttagctttgtgtgtacaagcgtgtgggtgggtggtgatggggtacatgtttgtattgtaggaatgaatccctgtgtgtgtgtgtgtgtgtgtgtgtgtgtgtgtgtgcatgcgtgcgtgcgcgcacacgcgcgcacatgcgcaagtctaagccagacgttgatatcagttattttcattctttagtttactttttgagatgaggtcgtttactgatcttggagttcacagatttacaagagtagttaaccagcatacaccccttctctctgcccctccccagtgctgggattacatctgtgcagtgccacagctagctttttaacagaaatcctcttcttgtgtagaaacactttaccagctgaaccatcttctttgtgtagcgctctctcttttttttttttttaaataaggtcttgttttttttggtccaggctaggctctaatccaacagttctcttattcctgcctcctacatgccgtggttattggcatgtgtcaccatgctaaggtaatgcacttaattcctattcatctttttaaatcatattttctagattaaagtgtgagaccttgtgcctgtcattgtggccatatgcctataattgtagcacatcaaggtagatatctgtagtcaatgccagtctggtcttaatatatagtgagtcacaggtcagccacgattacatagtgaaatcctccctcaatatccccctagccccccccaaaaaagaacaaaggaaaaagaagccctttgctaatgagaaattttatgctgatgctcatgtatatatggcctgcatttctgggtgagagaatgccacgtgcttagagctctcagggtatttagtttactggactctttttactgtttacaggttacctcaatttgctctcttgctccagaactcaaatatctcattagactgtctgcatagcatggttgtgttacaatattctcaatgatcatacatattttacttaggttgtaagatgtctcagcaggtaaaggcatttgtcatcatgcctgacaacccaagtcttggccacagaacccacttgatggaataagagaattgattcctgcaagatgttttttagcctccccagatacgccattgaagatgcatacacatgcacacacacaagtacacacatacctaaacaaatggttacatggggaaaaaatattttgctgaagtaattaaattttgtgtttatacctgtagactttcctgaacatgtttgttgatagcaatcaagatgctcggagaagatctgtaaatgaggatgataaccctccttctcctataggaggtgacatgatggactctttaatatcacagctccagccacctcagcaacaggtaaatgtctgcctgcaagtctactgtcccatctgtggaacagcttctataggtgtcagcatttctttgttaaaagatagaatgtctttggaagacctaagaagcccaggaaacccctattaaaaaattgtaacagagacaacaaggagacctccattggtaggaaatgagcacttgaggtcaaggctttttctattactactcatttctaattgggaaaaaaaagtctcttgctggatgctgggcaaccttttgtgcagcagcctcactgtgtctttgaaaggcagctgttacacatttgctgttgttcattaaggtctctgccaagccagccagttctaatttcaagggttcttctatccacagcttcaccaagtcatgcgatcacagctccaaagctttgagcactcttgctgactccttcccttgcctagttgaacagcccgcaagccagcctcaatttgttctcactttgtctctcttgaaatagaaagtagtcactcattgatcttggactcctaaaccagtgccttatgattcactagcatggaaaagactctgtgtgtcagggtacaaagaaccttttggctggagcctttagcagttgattttagttgtatgtgaatgcacaacctgttgccaaggttctgaggcgcatccttcagaggcaattttctgaagtaactcaccgctcctccttcgtaatcttttgtgaaatagcacagtccttgggcttcctcgcttctggcctggctacttatgcttagtaagtccaatatgctggtgcttgtgtctttcatcgagtactagactcttaacagcaggagtttgtatattacacctggcaggtatttagcttttttccttccctgtatttggttttcttgctgacataaaaatacagggcagcccagtaagacccaatatgaatacctctgtacccagagtggggctgtgacagatgttgacttagatgagaagattgtagaccatcacaatggaggaggaccttgcccagcaatgccagaggagtgctgttgctgctgctgctgttcttcctcctctccctcctcctcctcctcctcctcctcttcttcttctctgctattatttattttgcgggttttctttttgttttgtttttttttacattgtaaatctctccttgaattgatgttgggaaagagtaagtcacatattctaggaaagcagtgattgagatgggctagatagtagccacagcaagtgtcatactgacaattaatagagaatctgttattcccctctccctaaataaatcatccattggctgctttccaagaattttataggtcacagaaaaatcacactgtagcttattaaacattctggttttgctaagagttctatgtaccaataactttaatacttgatatgagatttccacctgggagaatagttagaggctaaaggattagaggtgggtagattaaggaaaatttagcatggtctagtgatgttaggaagattcatcactgttacaactcctagattctttgtttctgttttgtttttcttgtttctttatttttaaatcaaatgtctgacagtgtcactcagaatacttggggggtaaaaaaacaacaacaggaaaaaaaattaccaccaccaataaaaattgtgttttgagacagtatcactattagtcttggctgttccgggaactccctctgtaggccagactggcctcaatctcacagagatcagcctgcctctgtcttccaaagtctgcattaaaggcatgtgccatctcatctgcttaatgtttttaaacatttatcaaatggtacatttaagaagtgttgaaggcgcatgcacagagtcagaaaatgaagcaacatgaagcttttaagtaattacaatactgttctatattttgctatatgtgattaatacctcaactttaaaaaaacagacttggaaggtaaatgtaaaatatgcttgcacacatgtgtgggtgactgtatcactggaaaatggatcaggaggaagtgtgctaccatggaagctatatctccagctacatttaccactttttatttgctgcaaatggaggcagcaattaaaggaatgggtattgaaagattcaccctgattttacagatgttaacatcaaggatagaaataaaactggcaggaaaatgggggacggggggacagaattggtgatgttgaagcaggtaagaaatgaggggcttgctggttttcaaacagttgcaagccttccttcttccagacttcctagtttgcatggtcgacgtgtatttagaatagatctgtatctaaatggtttcctatatgccaaccagtggagcagcaaagccttatgttggtctaatgaggaaaaactacacatatattctctgtggttgaccagcatgccaacattaactttgcttttctttttttcccaccagccatttccaaagcagccagggacatcaggcgcttaccctcttacttcaccccctacatcctatcacagcacagttaatcagtccccctctatgatgcacacacagtctccaggtaagatacgagttattctctgttcttgtctacctcaagaggaagcattgcttaggtgacctcaggtgtcacacaggtttttacctgctctctgtctcattatttgcctacattcattggagcagtgctgaaaaacccacatttgcagtactttaggagcattttgtaagatttgttttaagtgcctagagccagacttgtggcaccatttccaagattgctagtaatctgatggtctgcattagaggttgacagtcataggccttaagtaaacaaacaaatgaaacaaagccatgtcaacttatgtggtattcatgtctgctctttttcactctttttttatatatattttgaggctgggtctgatattacccaggctggccttaaactcactatgtagttagactgtctggagatcattgatccttctctgctttctcctccctagtattggggttaggagtacaccaccatgcctgactgctttgtgatggatggccttctacccctgctccatatgtgaacctttgggagatgtggcagtgatttgttctccagctccctggagtcgggcacatcatatcttatttgtcctgaccaaatggctttgttgggcagttctgtgcactgtaaagtgtgggtggcatgtgaaaattttacttttgactgaatagttctatgaaatctcttgagcctgaagttcagcaggaaactaggtcctagcccctggctcccatttgccatctaagaaatgataggcatcagatttcttaaggaaaataccctcttaccttgcagtttccattctcaaattaataggataaaaaatttaaattgttatattacaaaagaagtattaggtaaaatataagaagttaaataattttgccaggcctggtgatggaaatctataatctcagttattttggaggctaggggaacaggatcaaaagcttaagaacaaaaaaagaaaaaaaagggggggggtgaggagggaaaaaaaagtttaagaccacaaaatctgaaaaaaatacagaaaagtctgggccatagttcagtggttgagtgcttgcttagcatacatacatgaggcccagtgttcaattcttagtagtacaagaagaaaaaagcctttggtttaatgcatggatcaaatagtgaatgtcttcatcgttagaggatgctctgcgtattagcttgatatgtgtgtgtgtctgtgtgtgtgtctgcatttgtgatactaaggatggaacccaaagtctcacatatgctaaacaaatgttttactagtgacatctccaaacccgaagagttttcccattgtaaagtagaattggtattatatgttttttcttttttctttatatattaatttcctaaaatcccttaatacagatatgtgtgtattcgtgtacatacatataacaaatgtacacgtacccacagatcttgctaatctgagacacttgtttaacccactcattccatttgtaaatgagaatagcataaaacactggctattccagctgccacctttcaacccgtctcatcatggcagcctcttcctcttttgtatgcctctctcacagccactcagattgctaaagggatttgttgattttcaagtcggatcctgggggaagaatgccacatccttgtttttagaaaagtctttaaatgtcctactttttggaggctctatgtgtgtgcatggttctgccctagagatgcttctttgcctgcctccttcaccttgactcggctcaagatgagacttaaaggatgccttggagaaggccaaatgcaaggacacagactaggtgggtgggtattccaggcacacccccacaccatgtgtgtggaacctgtggtcccagagtacactgtcttgaatgaccagaatatggatatgtgagactcttcaagaatttggtctttactggatcagccatccatatttggactttattagggtaacaaaggggtattattattattattattattattattattattactataccagagaggagctggtttttagtactacagaggtctttaaattctttggttacaaaagcctagagatttttcaagtctaagtgtgctgtagacatttggctctatggaggcctgcagcttatcagagagtgaagaagggtatatagagtcattccagactctaattgccacccaccatgtgggacaaactatctgtccttagagttgcctctaagtccacatgtggtctggaactcacctttaaactctgtcatctcctctcaggccacccttcttcactcttcttggaccataggttgaagatttggaagttatcatccccaggatcattaaaggctgagtgggtgggagagcttagtccctatgaataccagaggtgaaagtcacagctggagaggatataggctctatcagatagatacccagaaccccaggggtatgtctctaggaaaagcagagactagtgtttaggaggaaggggaaaatgcattttaagtaattataatagtagacagacatgcttgctatgactatgccaagcccaattctaagcactttactcatttaatcctcacagcaaacttatggcataggtcccattattattcccattttatggagaaaaaccgaggcatggagaagttaagtcacatgtcagatcatacagctaaataggtaaatataacacatgtcaatttggttgacatatttattgagaacacgatattgcttaagtattttagaacataaatatgaaattatcctatactacagtaaagagtttgaaacctgctaatattgaatgataataaagcaagtattaatatgttgagtttattcttaagttctccctttgaagtcctttaaagttaaaatccctcccatggctttaagtgccatctttaagtgcctgtctcccagcttctgtatgtattttagatctcactttggaactccagcctttgattttctaattatctattcagtacttctacctaatatctagtggcttgccaaaactcaccagggctgaaactaaattcctagtttcccagtcctgtgtcctgatccttgtatggacaacacactcagaaagaggcagccccttctttcatattccttggcatattctgctcatatcagagatacacagaatatgtttgcttatatgcccatattgagttatttaccaaatactattgaccatgtcctgtttttaaactcaaattgaagccttttgcagtaccccaaccagtcttcagtcaccctagcagctcataccagccactagagtgatcctttctagacagaagtttggtaatggctttcattccagactctaattgccacccaccatgtgggacaaactatctgtccttagagttgcctctaagtccacatgtggtctggaactcacctttaaactctgtcatctcctctcaggccacccttcttcactcttttccagcactctggcccccttcctgtcacacaaactatccgttctttgagacctttggattggctcatttgtctgcctggattatctttctccctgtgctgtgtcctgcatatttcttcctgtctggtttacacatcaatttagagtctttagctctgccaccacaaggaattcttttcctttgcactggtcttcccctagcacttgtcattaccttctaggttaatcgtgctcattttagtagattacatgctccaggagggcagaaattgtcttatgttaactatgtcctttgtgcctagaacagtgcctggcaagaagctggtaatctcacctatttgtagacaaagtatgtaactaaaaagtgcagtggttatatttctttgcagttagtgagtataagagttacaatgtggatccatggatttgaactttcttgtaatagagaggtctttccagttttccttcctgctatttatgggacttattctgtctctttagtctctagggagtttttttgttttgttttgttttttgttttttgttttgttttgttttgttttgttttacttgtgctccttggacaggacatactatgtgtcctgtgagatcatctgtaattattttcctttattaggaaatctgcatgctgccagctcccccagtggggctttgagagccccatcaccagcgtcatttgttccaactcctcccccatcctcgcatggaatctcaataggaccaggggccagttttgctagtccacatggtgagtccatacatggaaatcgctatagcatttagagcgtgatggaaaagtaatttttgttaaataaaattccttattgaaaactggtaatttattgaggagtagcaaaaatacgacttgagcaaaaagacattttttcatagtttactcacacagaggcactgactggttggtctgtggctgtcttcccctgcttgtcctttttgtcacctgctgcttgcttgctggccatcccgtacctctgtgattgctttctagttattggcctgtctccctcagatacctcccctaacctaggtgggtaccttcccagatgagtggattctcagtgggatcaaataaacattagaaggaggtagacagtgaattgtccccctgtgattgttgtcagtttgttttttgagatcttgctatatagcccaggctggcctccaagttgcaacagttctccaccccaagtgctgagattagaagcagcatacaggacacccgacttaaatgttttctttcatgtcaccagacagccaccttacctcttttctcaaagtcatttgtcttactggtttctgatatattctttattcttatattgctaatttttggtgtatgtgtgtgagtgttttgtcatgtatgtatgtgaatcatgtacattcctagtgtccctgcctagaggtcagaagagggcatcagaacccctggaattggaattacaagtggttgtgagccaccctgtgggtgttggaaagcaaaccctggtaaatcctaatcactgagccatttctctctccctccccgggtttatagtcttacagatctgttttacacacacacacacacacactacctcctccccaccttacatggcagcatattacataacctgttcacttaaacatcgtaaacattgtgccacattagaacataaagaacttcttcagcctctcagctgtgttcagctatgaccttacttcttattaatactattgtttttgaacatttgtcagtgaatattcattatcatactacagagctttataacatcccgtgtctgggtataccataacttaagtatagttctattttgaatgtttacgtattttcacaattgaaaatgctgccataggtatccatatgatctccttacataagttccgaaaaatgtcattgaagtcattcgacaacattgggcatatttcttacctgaagggctggaccaatttcttgtagcagctggggagaatgcctgttgtcctcccacatagccaacatgggatagtaggattttctaaaagtaactgggccacttttctaggtgaaaaaatttggcattttaatattagatatgtgtttcttgattattagtgaaatttcacttactgaattcacacttttttgaatgcccatttgtcttcagtgtctcttttaataagtcaagaccatttattcactaaaacaatcagtatactttctcagtgtttcatttgaggacaaagggatataaacaatatatcaaagatagttttgtggtgaaatttaaaatgtcaaattgttaaggaagccactgctttcaaaacttgattctcagttatatttcttattcagtgtagccgtcactgaataaagaaaatgtatagtttccttcccttgtccttctctgagaagaatggaaacataatttttcagagctggtcttcctttcagcaaagcttgatgttttcattaaatgtatggggccttctctggaggaaaattcatcccttcttagtctcctcacttcctaactctgcaacccactttgaaagtacagaaagcctagcagggcgtggtggtgcacacctttaattccagtactgtggaagcagaggcagatggatttctatgagttcaaggccagtctggtctacatagtaagttctagggcagccaaggtgatgcaaaaagaccctgtgtcaaaaagcaaccgaaaagaaagtaccaaaaacgctacaaaaatagagacttaggtgtaatgtgaaacagaacaacgaaaatgactcattctttaaggcgctggctgttttcacatactttagggacattaaaatatgtgttttgagaattatgttttattacacctttttttttcaggaacccttgaccctagttctccatatactatggtgtcaccaagtggacgagcaggaaactggcctgggtcacctcaagtgtccggaccctcaccagcaacccgtttgcctggaatgtcaccagctaacccatctctgcattctcctgttccagatgtttctcattctcctcgagctggcacaagtgagtgttgtcagcactgtttttccaaagcaaacgccaatgtctgactccgccttcacatttcaaagtcacagtgtatttctctaaggagaatttccaaaccttaaccttttttcctttacaaatcagtctgcgatattaattagcaatgtcatgaaaaatgtattaagaaaccaagtctctgcacctctgtcaatgtctgctaacttatgtcttcaatattgaaccataaaagataccttaagttaaccaccaaaggcatagaagttaatataaggccataatactgatgaaagactggacagttgattgtaaataggattttctagactcggtaggtggaaagaattatttttctttgaaggaaataactttttatcatggtaattttgaaggatgattcctatgacatgttcatgggggaatgtggcttttacaaatcttgtattggttataattgttcatatcttcttttctgtgttgacttcattattcccatggtattggccttttaaactatgtgcctctgagtctttgaatttataaatttgttatcttaataaatattgtaaaaatgtaaaaaaaaaaaagattttaaaagtgtatgcattccataactttcagtgcttaaagcaacaaatgctatgttagctcacaatgtttgctctgataactctcctgagctagttgacttgtccatagcctcagctggcatggattctcttgtttacccagtggatagagcacatgacagaggacatgggagtcttgtaagtattccagcatcccttgcaaaagcaggtcacaggaccaagcagagtttaggttgagaagcagaacccagttccttgaaggagtccctacaggatcatattgaacctgaatacaatcagaagattcactgtagctgattctgctatctgagaactgacatatgatccttcataacaaggactagttacaagagttacaattacctggcaactgtctgatgaaggcaaagcaggcagcaatggcatggtgtgtatgcattcataattgaagttacctgttttccttcccaaaaggttcccagacaatgccaaccaacatgcctccacctcgaaaactacctcagcgctcctgggcagcatctatacccaccattctcactcatagtgccttgaacatcttactgctaccatctccaacgccaggccttgtgcctggcctggcaggtagttacctttgttccccacttgagagattccttggatctgtcatcatgagacgacaccttcaaagaatcatccaacaggaaacggtacgagtattacgcaagtttctaagtggtcggtcattgtcaagggcagaagacaatctttgggagggttaccttcttaaccatcctggtagaattgggcttcaagcctttacctagcattaaagatgcgccccacttaatctaatcagatcttagattagagggttgtacagtttactgttctgtgattttagataatgtggtttaccagggccgaggaacagatgatcacactaaacagattcagtgcacataggtctgacggcgcacatacaaatgactgtttgctctctgatgtgcttttgtagatagactgactttgaagtcgagtcctcatcaaaatcaaagtgttgatcataggcattagggcttttttaaaactgatgagtaattacatttgtttaaaatcttgcagacataggcatctagccaaccttacggtgataacattctttatttatatttaccattattaccagtagatacatgtgttaatgaagtagccaaagtgtttgtttgtaataaatactatatacacttgcctcaaagtcatttcataatctttatagtcagatatatttaaaagaatgtaaaaagtattttaatttggattgtgtaaaatagtgggtttcatttgatttttttttgattttgatttttttctttaatgttaattgttaattaataattcattaataattaataaattaagctggttactaagtttttattaatgtgtatgggtggttttgccttcctgtttgtgtaccacatgcatgcagtgtacaggaaggccaaaagaggccatcaaaccttcctggaactggaattacaggcgtgagtcctagggtgctgggaatcaaacctgttcctctggaagagcagctcctactttaatgtttttctttttctttcctttaaaaaaaaagatattatttgccttatgtatgagtacactgtagctgtcttcagactcaccagaagaggcatcaaatcccattacagatggttgtgagctaccatgtgggtgctgggatttgaactcaggacctttggatctctccagccccaatgtttttcatatgtgaacatacttatgcatactctcccccattgccctctcttttcactgtacccctgttcaatattaacatatgttaattaaattgccattcagcttagagaggatgagagctgtggtgcagcctcagttctgctattcgtggtccctgtagcattgggctttgtgactctcgtcagaattactggatcaacatgttttctattgagacgattctgtcagctaagtttgtgtctttccctgttgatttgctgcatccttgttttacagttgcagctgatcaattccaatgaacctggtgtaatcatgttcaagacagatgccctgaaatgcagagtagcccttagtcccaaaaccaaccagacccttcagctaaaagtgacacctgaaaatgcaggacaatggaaacccgatgagcttcaagttttggagaaattcttcgaaacaagagtatgtgtttcctaatatatgcttgactttagtcagtgaatccatgaagtcgaagtagaatgaagagtaaggtgatttctttgcccctaccccctgtaggttgcaggaccgccatttaaagccaacacacttatagccttcaccaagctgttgggagcgccgacacacatcctccgggactgtgtgcatataatgaagttggagttggtgagttgctgagaaacacaaacttttctaattgggtctattggaagagactgtagaacagtacttatggtctagctcactcactttgcgtatcattccatttctcctaaaattcatttcctttaagataataaattttatctatttaataataattactatttagtactaaaatattaatagggacttactatcctggctatcctcaaatttatgtgcttgcctctagcctctaagtggggagttaaaggcttcaattcaagaagtatattctgtcgggtgtggtgggacacgcctttaatcccagcactctggaggcagaggcaggcttagtggttaagagtactgactattcttctgaaggtcatgagttcaaatcccagcaacacatggtgactcacaatcatccataatgagatctgaccccttcttctggggtgtctgaagacagctacagtgtacttagatataataagttaaaaaaaaaagatataacccctctccagccattctcagcaagcagagttcccagaagctaacttcttgcagagatggtttgatgaaaagagcaaagatctctcttgtatttgtatctatttccattatgaaacactttacatgtatttctttcccctgaatatctgtgaagcctcagtgttgagtcacacagagcaggtgccagaagggcagcagtcatcgttagcgctctgggtatctgttcctgcttttgtttgagccttttcagggtcgctgctgggcttctacagcttggttttcatttgtatttgggtttctatagccaggaaaagaaatggctactagcagaatgatttaaaacaatagcagttaattcagtcttaattctagagagaagtcctaaatcaaggtatctttgaggacttgctctctaaaggctccacaggaggatatgtgtcttgtctctcacttggtaattcagcttttgcttctataccaattactctgacttatgcatccccatgtatgagggctctacctgataatctcttcctaacttgcttatatctgcaaagacctcattttcaagtgagatcatactgaactggttggtcctgagaataaggacttcttatcttgttctggcacacaattcaacccataacaaccccccagtatttgctagtgttcatgagagagaccatttctagaatgtcctgcttaatctcttgccagaaatccactgagtaaatcttggagatcttgccacattttagagcataaaatgtttcccattttcaacaaaacgaatgttcttttaagtcagtgaagtaacatggctaaatagccactcctccctaaccttcattcctaccctagactcaaacccagaacctcacgtgctctgtcattgagctacatccccagccccacagtcttctacatttaagtattacaaaaggacacaacaaagaacttctaaaaaagaggttttgctttgtctgtagtgtcattttttaggacaaattggtgaacgaaaggatatgtagatgtcattaggcaaattattctctctgttgaggttaccccagtttatgttcccacaagcacccccaggtcagttatcagttagttttcccccctcattttataccattgttttagctattataaacctttgctataaataggtattttaaacctttggtaaatttagctagttctttttattgttatttactttttcttgttttttcaaaatgacttatttttctgtaacggttacctgcatgtatgtctgtgcccacatctgtgcctggtacactaggaggccagaaagcgctgtcagattcccttggagtggtgttagagatgattgtgagccagagcctgagcctttgaatcactcagtcatcttccagcactttttttttatttcgtgtgtgtgtgtctgtctgtctgtctgtctgtacctcagtttatgcaactgagagcagtgctcatggcagccaaagagatcattgaatcctctggggctggttgtgagtcttgacatgggttctgggaaataaacacaagtcctctgcaagagcaacaagctcccttaacctctcagccatctcggcatcccaagatggatgttcattttactttgcatgtctatatatgtgcattctgtgtatgctatatgcacatgagtgctggcataggccaaaagagaaggcatcggattcctttcagctggagttaaagttggttgtgagctaccctatatagatgttagcaatcaaacttgggtgctctggaagagcagtatgcatttttaacctgctgagttatctctccagccctatgttttaggtgtttcttaaaactatatagtttgagcctttatgatagatggtgtttatttgattaacctaatacccccctcctccttgttgccattttaatatcaggtttaaggaagcaaggatttttttttcttgtttttctttctttttggttttgtttagattttcatctgataggatataacagacattataagtcagaaagatttctttgagattttgaaggagtaaatatgtatctataaaagcacctgtgattttctcttccaaacgatcaccatggcttcagtcgtttatttagggaagcagttagaaaccaaaatgaacgtcagtcagcaagaactttaagtgacatgagttgatccttatttgtagaagggagcagcatatgtcagagtgccactgcatgttcgtgagcgagattagagcctcactcaaaatggggcactggctgggatgcagggaggaagcagtgaagtcccgagtgttgatggctttatgaaaacaatggggcaagagttggtgtcagagacactgcagccactggccttgggcggaataaaggagaacatagcgcccaaatttaccccagagcttttagttagttgtttcatggattttttttaagtaaaagtgcatgctgtctggatcaataaatgtaaggtgaagttctaactcttcagactccatagcagatgtaatttttaaatgttaagaggtttttgtcattatttttcccctttaaaacagttcccagatcaagcaacgcagctgaaatggaacgttcagttttgcctcaccatccctcccagcgcaccaccaattgcaccgcctgggacaccagctgtggtcctgaaatccaaaatgctattttttgtaagtatcacctgacatcgtctgtgcgtgtagagtttctgaggaaaaagccacatgagcattgtagaacatcttttgagtgagctcttccctgttagctatatgtctagggttttccactgttagactgtggggttcttagctcccttagtaacaacagagatttattcaaggttgtaattgggagacaattataacactcgggtgggtctcacttttttcctcatatttaattttcctgtacttgctgtatcttattctgaaagtaaatgatagtacctctcacaaatcgagacaaatatttgattttctgtttttattctctttatctacagcttcaactaactcagaaaacatcagtccctccccaagaacctgttagtataatagttccaattatttatgatatggcttcaggtaccactcagcaggcagacattcccagacagcagaactcttctgttgctgcgccaatgatggtcagcaacattctgaagaggtttgcagagatgaaccctccacgacaaggtacatgagcagtagatggtattttgttgcatatatgttataacacttccttttagagagacctccctcccgttccctctcttctccctccttccctactctgcatcccaatcctagcactagtactctgttgccatggccctcttagttagtgtctgcctgtcgctttctttctttctcactggttcttcagttttgtccatttctctgctgcctggacttttttgttagcaaatgactattgggactgagccagttgccaatgccagaagcttgtatttatagcacacattgccacaaagccctaggttaggatgatagacttttccggggctgtgaatccctgccttgccatcagtacctgccgctctgtacatcacaaagttggaatgcatgttggtttctcatactccatggttcgatcatgaatagaatactattatcaaaagttgtgtatcttctaaatgttttgtgaagaataaaagctgatacaaa

SEQ ID NO: 615 - DNA, 82325 bp, mus musculus; identical to SEQ ID NO: 614

SEQ ID NO: 616 - DNA, 91667 bp, mus musculus
caatccattcatgcactgaagcgcgtgcagagctgctgctcgctgccattgttactcgcgggcggtgtgggagcagagcctccactctggcgagagataaatggcctctgacagcccctcctcgccaagagagctcctcggatttcaccgcgcggcggctctcaggtctgtgccttgctcgcttcccggtgagaacctttaaatcagcctccccgccctcccttctcccggactctgtcccccccgccctctccggcccggccagggcccccgggggcgctgcgcacaggcacgagtcgcctccccagccgggggttacgaagtggggacgccgaagggacccgggggtcgcgggtggggagaagcagctagcgccccccacccgggctccgttcctccgcccgaacgccccgcctccgcgcccacaagatggatcaggctaccgtgcggagagcgggctgtaaatattttaaaagtctctcgcgcgccggcggtaatggctttcgcagttggaatgtgtgctagggaaagaggaagggcgacgtttgtgctgtgttgcgggttgagagaattgtttctataccctctccctaggttcggggtgggctgtaccgccaggatcccgggtttcccgccccgccgcgtcccgagatagcatcaagaacaccagtcgttagggaacttgagtctatatcagggcgacaaaaggcccagtcgaggtgactccagagccactttcttcttcgagggaggtctctcaaggtcttgggtctgagactggtccaaaacctctggtccaggtccgcttctcacgggtgatccggggagggcgggaaacgcacaaataaaaacccctcgagtttgcgtggccactaaaagctggggcttgggtttctgcagcagggacaggtcccgtttgcgtctttggtccctttctcaactcccctgtaaagcctctatccgctcaaaaggcgccatccgctttgcatttaaatctgaacgtagctttgtggctacttgggttcgaaacctgggtaggggagcgggggaaaggtcggggcgcagagaggttaatgcccaggcttggtggcagtcatgtgtgggcactcttctgcttcctcggttagtctaggcttggaatctataaggctgagcccagccggataggagagggtgggggaggggattcagtcttctctgtcgggagagacttaataggcccaccacagggcgtgtgtgaggtgaggtggtctcctttgccagcagcagcttcctggcagggcaggggcgccgaggtgcttggagctggggcaggccaggcacaccaggttctcgtggagggttcccggagcgtgggcctaggctaggactgctcatctctatcctccacctggctctctccccgatccgccagagagtgggtgcgggaggcctttcggggcgcgccagggctgccctagacggtccagtgcgtggagctctcagctctggcagctcctcttccaagggcttgtgttgcgcccttctcgcttgtttgtctcgtgtgagcctcgtaaaccgccctgatttattacccagactaaatgcttaatttgtgaatatgaaacagattaaaaagggcgggggtagggggcttgaggtcggcatattttagcaatcagaccaaagcagcccggcagatgtttcaaatttgtcgacattttcaggctcatgtggaaagccagtcagaatggtcaagagatcctttttccttcctccaacctgagaacttggcagtgatcaacaggaggtgattagtagccacacacacaaaaagacaccagcagtcaaggagttaacagaggctgagctcttcacctccaggatccgggtggagggaatgggggcctagggtcacaaaggcaacctgatcacaaagcctggaggagcccagctaaaaaggcccaagtattagaaggtaactctgaagaacaaagtcgagggtccattaaaagttaattcagcaaataaacttcagtggcgataaaacaaataagaaagatggcaactccaacttaaactaaccaacagataatagaaaggagtggctttgatgtggcctaaccatgtgctttccctttaagcaggtccccacagtgagcggcccaagacgggcctctgtggagcaccctctttgaaaagaccccatgtgtacaggcagtgctttttggcgtttgtcatttgggagcaacttcacacatcaaaggcgaccacagtgttcttttcagctccctggttccactcgcccagtgaagcagatacaatttctataaattggccttctcctctgggttttgattgatcatcaccatatgagattattgaaagtctaatgtcttatttcactttctccaaggggtgaggaggggaaccatttattggaagtcaggccacgtgaagactcccgggttgtgcaatagtaatttccattagcctggatttatcaacctcttgaaactcccatgcgtttcctgtgggtgcctcatttcacctcccttcccccaccaggcctgtgcttctgtggctgttcacaggtatagtccagaaccttccaattgggaaggagaaaatggatattgactacacggaaaggaacaaaagatgtatttctaagcatatttattccaatgctccaaattccttctttggcctttgttttccactccaaacttttttgtccccctttcgcctggatgcgatctttcatttatttaaagttgattatggcgcctctgtcttgtcctgcgccagacaaaagcttagagaaagtcaaagaccgcgttaattatatgtttcttgtaaactgacttttcatgtccccctaacacatttagctggcttggtgtttagtttaacactcaagtgctgcaaatatgctgcttaaaatgctgtctttattaaaacaaataaatgaattcaaagacctttctaatttcaactcgtgtgggctagaaacagaagagaaaaatggtaggaaagagtatgggctagggaaaggtagcagggagactggagagaaaaggcacacacatgcatgcgcatacacatgcacacacatgtacacacacaagcaagcaagcactcgcacatgtgcgtgtatgcgcacacacacacacacacacaggctgcattccttctgccatccctccctgcagccatgttaaactggtccatacaattgtccctggcttagccctgcagcttgccagcctgccaggattttccatcacttggtgcctaaggcaatcattagctcagaatggacagccctctacctgctagccgccagtcacttatcagccaggggtaggctggctacatcaagcataggtcccatttgttcagcctgagaggggtccttggtatttgcccctgggtgagttggtacctaattaaactctacccagggcagcttacactaaatatatgtgggttgagaggaggctgggaggaaaaggcagtcattacttaagcagggaaagtgacttttctgagagcgggaagaaagggagccgtctgatcactttgtttaccctaagcagagcttcagacaccacatcaatggccacaaggaaataaggggaaatgggaactaagggggaaatccagagaccacaggcccctaaacccaggccttgtcatcatctggaagcaagagggaggtttatctgagctctagacaacactggctgcagggggtggggagggggtgcgggggtgggggggagatccaagtgccctttgtggctttggagtcattgctcatgtgccacaggcctgtgtgtgtactcaggagctgggactgtataaatggccgcggagacagaaaggaacagatgtgtcaaagaatccagtgactgagtgtgtatggtaaagttaccctgacgaggcacgggagaacaagagaatgatcgatcagctgaagcctaggcctaggtggcaggatcccgatgatcagaactagggctaaaggactagtttgcgaacaaaggtggtggttgtggatctagaaagatcttggggtcttctttaagccctcatgaattcagagggtgaaaacatttgatcaactggacaaaaagtaaaaccaagtaccaagcacttctggttggtaccaagagttagagcacttttggttggagaaagggtttctttctggctcactattttaaccagttagcatttattaagcacttgccttacgcaaagcagtatgctggacatctggggccacaagtgctagactcctcaaatgacccagcaggggcgactccttccttttatgtgcaaaataacaaaggacataaaggactgtgggtgagcttctgaggacgtggagaaggaaatcagccactccctgagcgtcactgttaccctgcccctgcgcctgcagctggattccaggaggaagatgaggctaccagcctcttggggccagggacctctctgcttccaacctaaacccggaccaagctccagggccttccagattgttctgtttggatggtggcaggggtcacatgggtcctttacttcccccttccttggaaagcctgcctaactttatttcccctgggggccaggccagagagattttgatgcaaatcaagaaggcagcttttcaagtcaggactagcctgaccgagagactagccccagaccgagagaaaagggaagcttgcactgcccccctccagcgctctctctctctcctctcctctcctctcctctcctctcctctcctctcctctcctctcctctcctcttctcccctcccctccccccgccccccccccgctctttctggaactcgataagggaatactgcctccctgaacaaaacaaacttggaaatctccaaggtttggaattgtgagggagtcccccagcagagaatttgaactggcttaaatacatcccccttccctgggcacactccctctgtgccccctagattcgacttgccccttggggtgtttcagtgtgatcacaggtgccctccttcgagccatctggcctgggcccagcctttgctcttggtttccctacgcactggcgaaacgcgctggaaccttcaaagcgcattcctaaacactaccggggaactgtggggaagtgcaaacaaagaggctgggagtactcaggcagttagcgtactgagtctgtgggccaacagggctggcccaagttcagtcagactccctggctctgagccagctagagctggcagtgcgccctctccagcccactactcagacctccttgcccccaaatttgggcaccccccctcctcagccagcttaagtctaagccagccctcctgcccctccgcagtcctctgagaacagtacttcctcattctggtctggtggatagttgcaggcttctgcgcgagctctccgagagagagtaaattgtcaaagagcaggagcccttcccttctttcgagtggccccgggactgagcatggcctgagttccctgactggtagctttgggatttgagtagtggtgaacacttggtaacttcgatcctatgctgaataaaagtccgatcgtgctctgtgttcccttacgcaagcagacgttccctagaaatacaaataggaggtggggggggatgggtgtcaaatcacatgcttcttcatgggtcaccggtgagcagagtcattcgcccactacctttagctctggtctctggtctgtttaatactactgatggctcttgcaagggagtaggagtaacacctcaggtttccaagattctgcttcctttcacacaaaagctgggagaaagtctttgttggggggggggctcttagctcttagcccaacctgccttagaattagatcctagcccaggctattgttgaacttaagtcctggggttacatgtcaccctggcctgctcatgtgtatgttttgaaacagggtcttgtgctgcccagagctcagtcctcctaactcagcttgttgtgtagctgaaacagcaggctacaactacagaggacttttttatttctttctctttttccttatcccaccgagtactggaggattgaactcagagtctcatatatgctaggtaagttccttaagcactgagctgtagccttagtcacttttatagttttttcttttgagacagggtctaggctggctttgaactcagaatctccctgcctcagccattttagtcaaaggcgcagggcgatacactcggtttatatataggtactacagatctaaactcagacccctgtgttgtacaacactgaaccctttctcaaccccaagaattttttgggcagggggaggttggggggtctggggtcagttttgaggcagaatttctctgtgtagccctgaccgtcctggaactcgatctgtagtccaggctggcctcgaactcacagagatctgcctgctcatgcctcccgtgtgccgttactgctcggccaagactgtatttttttaagctataattcagtggtgtgtttttatcgatgctccacttacatacaaacaccttctgcccaatcttctaagtggggacttgggggctggtgtcctatgttttccttccccaagattctgcctagataactagatcatattaattgaaaatggtagggggtaacacctgcacgtgaccaaaaaaatgtcattgttttcagatagggtctcatggtgctgaggttggctttagactcctgatccttctgcctctacccactgaatgctgggattacagatgggtgccagggtagcatatggcaaaaaattctaaggctatcaaagtgtgttgagggaagaccgtgactctctcatccatctctgcttctctgcaggatcactgctcccagcttcctgcgcacaattgtcagcataggtacaaagaaaaaggaaaaaaaataaaaattctgtccaaaaaagagagggttggaaaactagttttaccttgaagaagccaaagcccaaagaaaaatcaaaagacccagtggtcttaatgaacatctatatcagaaggcaggctttcaaaagcacaacatttatttaacattcctattgcaagggattcagcagcctttcagaggtctgaatcaatttaacttcatcttaaactgttacagagtaatacattccccacttagattgtagtgatttcttattccctccatccacccttctagagcccagtgtggtcggtagctcatgcctacaacaccagcattctctaagctgaggcaggaggatcacttcagcctgagaccttgtctcaacacctccaccactaccactcaaaagcataggcatagtgatacatacttacaacccaggacttggagctagagtcctgagaatcagcggctcaaggtcgtactcgctatctagtaagcttcttggtcagcctgtgtttcgatataaggtccggtctaaaaccgaacaacaaaacaaaacaaaacaaaacaaaacgccgaaggaaaaagggtaggtgtggggtgctgcagcatgagactgctcagtaaggaaaggcactcgctgccaagcaggacagcctgagttttagcctcagaacccaggtggtggcagttgtcttgtgacctccatatttacctatgtgcactagaaataaacagaaataaataaaatgtcaaagtaaagactatctgaaagtttgtctggggaagctagggttcaaccgctgcctcggctggttgcctaactgtggaactaagcagttactctcagctcacccacggaatgggaagtatcaacgtggcccatcccataatgttgccattaaattagttggtgggcaaaactgacttaaaaataataccttgcacccagaaactgatcattgggggttagggagacttgagcctcacacacatctggttggtttcaaccttgctgtggtatttgtgaataagctatttgtctttgagtctctgtgtctctgaagccttgggtgtttgacctgcaagagacaggaggaaccccaacatgctactcgcctgtgatactctcagacagtttccagcatatttttggtttcttcactgttaatctgtactgttaggacaaaaaacactggaccaaagccctccaccctcaccattctttttttttttttttttttttttttttggtttttgagacagggtttctctgtatagccctggctgtcctggaactcactttgtagaccaggctggtctcaaactcagaaatcctcctgcctctgcctcccgagtgctgggattaaaggcaagtgccaccactgcccggcaccctcaccatttaagacatggggcaggggtggtgatagtgtgtacttacctagcatacatgacatccccagcagtttggtccccagcagtatgtaaaaaccaggtatagggctaatgaggtggctaagttggtttgcctcagagcctgaacacttgagttctatccctgggactcagtgattctctagaggtggatagatgagactatatttaaaaaagaaaaagacaaacattttgatgggtaggagttgctactcagaggtagagtggtatcttatgcttagcttatatgaggtcctgggttctatctatccccagtgctagaaggaaaaaaaaaataaacaagacgatggagtgtgtgggggggaggtcatgtgactcccacccttccttagtctgaccatctgctgtcctgctgataagagcttcttagaagacaagaacctgttgttatgtagagatccaaaaagccagatcttctccctaggggatatgcctaggctcccaaagaggctggggatcacaaaattgagggttggtcaggtgtggtggtgcaagcctttaattccagcactcaggaggcagaagtaggtggatctctgggaggccagcctggtctacatggagagttccagaacagccagggctacatagtaagaccctgtattggaaacaaacaaaaaagcacagctgaggatcagatagaagaagcgggtgactccatgaaacctctcactgtcctgtgagttagagagttttgttcggaccaccccctgcacctgataaaactgtccgggatatactttcataggacatgctgactggtggaggccctgacagcccgaggaaagacaaaggaatttgtttaaaggtatactttgctctgtgctagaaaacacctctcgtaatgttaggctttggaggcaataatatctgctcttgacattgtggtgtttctgccatataatttaattaacgtgtgatgcaggcacaaagccagagtcaaacgttctgacagctcttggaagccacctaaatccctttgaagttccttactacaccccagtaacacacagacaaagcccctaaggttgaagacagcccctgatatggggtgcagaattttatcagcaattccaatatctgcaaacttcctgatatctttttccctcaataaaatgttttatctggatgaggtggcacagtccgaactataggagagactgaagcaggaggatcgcctgagtctagattgaagactaatatagacatcgtatgatgtacccttaagtcagtctgtctgtctctctgtctttgtctctctgactctgtcttttatctgtctttctatttctctctctctctctctctctctctctctgtgtgtgtgtgtgtgtgtgtgtgtgtgtttgtgtttctgggtatctcgctgtctttccttttgagaaagggtctcattatttattatggttcaagttggctttgaacttgctgtataatctaggctaacctgaaattctttgacatcgtcctgcaccagtctcccaagtgttggtatcatagacacgaaccagtacacccagaaagatcatcaccctttaaaagaaatattttcttcttcgagttcacctatcacaaagttcctgagctccacacaaatcagatactagacttactaagaaggaaaataattatattatctgtataaaattatttaatgcctactaccctcctaacaatgctttgggcacttggcagtgtcttggatgtcatcaaattttattttactgaaaatggagaataaatacatgaacaaaaaagaaaatactgtgagttgtgctaaattaaaaaaataagaagggcaagggaataaagagagctagtatattgaaaaccatatattattctaaaaagaaaaaaatccttctagaaagaatgtagagagtgcattgtgagtcttgggtaggccaaggaatatacttaggtggtgttctcagtcagctcttgctgaaagaaagctgtgtaagaaaccacccaaagcacagagcagcaattcattttgggggatgcgtctgttggtcacgtgggtttggttgctgagcagaggcttgatcataagtaggagctgggtccaaattagctccatgtgcctttcactctccagggacgagtgggccagttagggccatggcaaaaattgcaagagcaaagaagaacaaaatggctcgggaagtctcccactcaggacttgccattgtttcttttgcttacgtttcattggctaaaaggaattctgtgatctgatggcagtgggctggggaaataggcctcacctctagtgaaatgagttgcagaatcaccatgtagatagggagggagtatggggcagtgagcagggtgcggagtagcccaatctgaaacagatggctcaaaccaaaactgtgtatctctagctatgacatttatatatacaaatacatatatcaaatgataaaaccgcctttggtggaattgtgtgttttagattaaatttaaataaacccatatgataattacacatcagcaccccctgaggtggcttatggatctttgttaccaacttcaggaaacctgggaatctaggacataggtcttgccaatgctgagagagaagtgtgtcttttttttttttaacatttatttatttattttatgtatgtgagtgccctgtagctgtacagatggttataaaccttcatgtggttgttgggaattgaattttaggacttctgctcgttccggtcaactccactcgctccagtcaactctgcttgctcaggcccaaagatttatttattattatacataagtacactcactgtagttgtcttcagacacaccagaagagggcgtcagatctcattaggggtggttgttagccaccctgtggttgttgggatttgaactcaggaccttcggaagagcagtcagtgcttttaactgttgagccatctcaccagtccccgagatgtgggtcttgagggagacttttcttatctcctggacttctcatgcagagtacagtagtgggggaggaagaccagaggagaccccagaggcagtaattgctcctgctgacttctgtgcctgtcttggaatggtagcaatctgggttttgctctgctgccaacaagcccttcagctgctctccatggctgcccaggacccagggctgggatggagattccagtagctccttgtccctgcgcctaccctgccttgtcttgctgtcctttaggttttgggtattattattattattattattattattattattattattattattaaagtgatcattgctttgtttgccttccttcagtgaattcctcctgggctctgcagccagccaaagctctggaagctggcccttcactttaggaaaggtcgttgttcaattgattcccgcagctaatggaatctaatcaccaaagcctggagtgattgcaatcagaggaatccacctggttgaaaagaatctaagttttccttttgtaagctgagagagtgaggtgctggggcaggcatgggctctaccaggctcctgtttggatgccttgggtcttctgattcctgcctttaaagtcatgtgaagtgattggccgcctgggagggaggaagcctagccctgaagtggaagtgggattgcttccaaagcagccagccaccttcaggctggagcaccgggcacactcacacaactgcaacttgagctctgagctcactggcaaccgcggtttggtttcgatgggttcaccctgaacttagcactgtttgaatctcccactcatctgtgtgccccacccctgaatccgtctcagttcttacgcagaggtcttcctgtgctttcagcctgctttccctattagatgctgctgctgctgctgctgctgctgctgctgctgctgctgctgctgatgccgatgatgacaggctgggagaatatttattttcagtgaaacacggtagctgtgcagagaagcacacacatcattagcatacagccagatcagcacactcgcctaactgatacccacatcaggattcagacagatcctcctcaggcctccaaccagatatctcagccttccttacacactcatctttaaggcacattgccaccctaccctgattcctaatagcatcagttagcctcctctgatttggtactttgtagaaaagaagggcatgggagtgcactgtgtgtctggcttcttttctttgcagtgtggcagtgagatctgtacacattatgtgtagtgcaattggtccattctccttaaggtatgagtacacattttatttatttctgtttcactcttaatgggcatttggatagttttgatgttgttactaataatgtggctgggaatgtttcgtgtacatgccctggagcagctgcatttctgctatgtgtgtcttaccagaggttgaattgccagggccataggttctgtcagcttttgctgttgttgttgttttgtggtactgaagattgaactcagggccttgaatctaagttttctatcaccgagttatgctcatagcagtatagtcagaattcatagataaggctgaaaagcatcccagagcagatctgagcgtggtgatgcatctgtaatcctaccattcaggattgtgatttcaaggtcagcctgagctacacagtgaattccaggctagcttggaatagagcgagagactgtgtctcaaggggataaagtcttttttttttttcttataaaatcctgagccatgatggctcagtggataaggtacttaccatcaagcctggccacctactagatacacacacacacacacacacacacacacacacacacacacacaaacacacacacacacaaactaattaagtaactaaataaatgctaaaattttgtttttacattttctcaaactgtacgtgttacatcagcacttgggagtccaaggtggaaggatagctctgaactcggtaccaggttgggctgcatagtgagttctaggtcaccctgggatagagccaacccccacttcccaaaaagcaggtcctcgcagatattttctgtgaccgtcctagggacatgctatctgcagctccgagaaacagaagactggtttgatttaatgttcaataaaatcaaaaacttggtccttgatctttagtgacaataagttttggaaactgagaatataaaatttcaaatcagactggagaggtggctcagtggttaagagcactggctgctcttccagaggatctgagttcaagtcttagcacccacctggcggctcacaagagtctgtaactccagtttcagggaatctgacacccctcacactaatgcatataatttaaagttaaattatttttaaaaactcagatcaactcctgcctctcgtctagtacttgggggcggggggggggtgttgaggcatgggcatcgctgcaagtttgagtcaagcctaggaaggtgagtttaagctagttttagctgcagactgagagaccttgtctcaaaacaaacaaacaaacaaacaaacaaacagccagatcatgttatacttccgtggtctggtcctgccccactctaagatccccaattcataggcacaaggtgacaatgtcactgtgtatttctgctacctgccattttcttggtgagtccatccagagctccccctgcagtgatagccctgctcctcccgcacttcttttgttgagcctgcgtttcactaagcacccagctggcctgggactcctagttgtcttaggtctcacagagatctgcctgccccccgactgcctctccaggaagggattaaaagtttgtatcactttgcccagcttgccctaatttgtaattccaggtgtcacctttcccagggagtactgtcccccacggctctgtcaggtcctgtctgttatctttgtgctgattgtacagccacaaaacttagcacagcattgttctgagaaggcctggtatctaagctcctctttagttgagttgggtgggttatttgttttgctttgtttacatgtttgttttgggctttctgacagagggttttactaagtagcagaaggaggatgacccaggctggttgaaacccaaatcctcctgcctcagtctcttaagtgttgggcagttttagagggcaggggccacagagccaatatgaagtgcttataacaccaattctgtctcttagtctggcatggtggcacataaccgtctcagcacttgggaggcagagagaaggatcacgtgcataggccagcttctactacttagcagctagctgggttctctgagatcctgcctcaaaaccagaaaacaatcccaggccttgggaggcagaggcaactggatctctgagttcgaggccagcctggtgtacaaagtgagttccaggacagccagggctacacggagaaaccctgtcttaaaaaaaaaaaaaaaaaaaaaaaaaaaaaaaaaaaaacaaccaaaaacaaaacaaagaacagaaaacaaaacagtctggaaagatggctctgcaattagagcactggctactcttctaaaggacctgggtttgattcccagcacccatgattgtctataattctagttccaggggatcaaacaccctcttctggcctcctcaggcactacactcatgtagtatacaaatatatattcaggcaaaacacccatatgcatgaactaaaacaaaaaaataaacaaaagttttctctaagttgtgtaaggataaaaagggcttgccagggtctgaacaagtaaatgctgtcatttgtgacatttgtgtatcagctacgcattcttaggcgagcctgggtaacacagtgagagactccatttctgaggttgaggccagcctggtctacagagtgagttccaggacagccagggctacacagagaaaccctgtctcgaaaaacaaaacaaaacaaaacaaaaaaaaaaaaaaaaaagaaggggactctaggctccgcctaacagttacttagcagcagtcaggtaggagcctggctcatatataaaaggtctctctctctctttctctcttcctccctccctccctccctctcctctcctctcctctctctcttctctctctctccctctctgtcccccctctctctctgtcccccctcccccctccccctctctcctctccctctctgtcccctctctctcttcccatcattgctctccccatgtattcctggccagcctcttcccttctttctctctcctctctctttttgtgtccttttctgtcctctttccctctactctctctccaagacccccttcccatgtcccaaataaagttcattttatactagacccatcgtatgactggtacctggggaggtgggggaatgcctcagcatgggcctgcttaaggcacccttttccaccgcatcatggcacagcattacaaaacatatcagggagagaaaagaaaaggtttacactcaatatgatgagcgtatccgtgaatgactttctgatctcttttggttgtcttatgaataatctggctgagaagggcccactggctggttcacacaccaatggcctcagggttgcttgggatgccagtttagaatacagagttctggccccatgcctgaaaattctcagtaggcttggggtggggcctggagctctctatatttaacgctctgactgtgacacatggccaggtttggaaactagagagtctaaaaagaatgctttcttcttggatgtgaggaaataccaggggccctgactgggatccagagaccaggttcacatcttcggtctcccaccagatatgttatgacttacacaaccctctgggcctcacttttctgtgaactgggaatcacacagtagatctatttggattaccagtgctgggcaacaaattgccctagaacttcacttaaggctgttttggttttttgtttgttttgagacaaggtctctctctgtgtaggccttgctggctgtcctggagcttgctatgcaaaccaggctatcctcatactcaccgaggagatctacctgcctctctgcctgttgagtgctgggtttaaaggtgtgctctatcatgcccactgaaggttgatttcttagtaacgttaggggtatggtacagggggatggggacaagcaagccaagaagcaaccatgtagccttttctgacttaagtcatcatctcacagtgtcacctctggtacattgaaaaacattcaaaagcccagctaggtttgaagatgtacaccctgtctcatggtaaaaactgtgacactcaatgtctcatggtaaaaaccgtgacactcaatgtgcaggagtgtttggaagcagcacagtacgtcttgagccgtcaggcagattcagcgaggtcagcttttaacataccctagactgacacagctccttccaatctgaggtctccgaggtcccagcaaactcaataccaggtcccacctttccactgctgggtgttggtgtcaggcgcccatagaaaagtagaagagtggtcaacatttctcacttcccagtcatctctagtcactttggatatagttcaaggcagcagtgggataccatctgatgccggacaccttagctcctcagagagggtggtcagatccaccaggcctctgttggtcccttgtgaccccgatatcaggcctcttcctatgcctactctcaactggcagctgtttggcttgggatggagattccaggccattcgcatattaagggactccgggacctactggtgctagaatgatggctagagtaactttagtagcatgcttctgtctccctggtctcttcagacttgaatttccttactgcaggtttggtgacactgagggaagatcaagtagaaacctggagggctgggggtggggttagagtagggggagattgggggactctcccagggaggaaaggatgactagtttctaggggatacattttacaggcctcatctgaggcagcatgaagagggatgtggggctctccgcagtgccagagtgggcaggaaaagcagagcagcagaggaaggagccattctgggcctggtcctgtgtgctggcatttatgaagggggccattgacctctttgaaaggggcagagaagagtccatgttcggtgttctgaggaagctgcttttcctcctggggctctccagctgccacatcagcacccctcctccactggcatccatttagcaactgtcttgttcagagctcctagggaaagagctcacaggaatgtggaagttagcgcacccctccccgtccccgcccaccatcgtgtacactccttgtatttcatggacatagccctgatgcctagagatggttgctgtgtgtgtatgtgtgtgtttcagataaggtcttatgtagcccaagctgacttcaaacttaatatgtagccaagagtgaccttgaacttcggagtcttctgcctctacctcttgaatgctataatcactgatacactcagccatgctcagtattgccaccccaccctcaccatgtgtgtgtgtgtgttcattctggggttctaatgtagctccttatgcttgccttacaagcattttactgaactatttccctagcccctttgcccagttttatgcagtgtttatgcagattgaacccaggtctttatgaatgctaggcaagcactctaccaactgagctgcatccttagccctctttctgtgttgtcatggataaacacacaccacatgtcccatggtaagcaccctaggaattcatggtgaaagacaaaatgtgaggactccgccatgtctgactcaggaaaggcgacaccccaaatcaagaaatggtcttgatgcaaactgcaagaggtttttttgggaaagaccagtgcactggggatgactcatatcccacgcaggggtagaaaagccaaccacgagctcaaggggtaaggggtttataaaggcacaaaaactgcaaacacctggcatcctgaaacaatggggcaacttctattccctgccattagtgaggtctattttggacataggtctaggggcttaaaatttttttcactctctctcagaatctttcaatggcaaggaaggcagggcgaggagtaacacgactggctatgggataggctgcctattctcatctccgtgcctcagtttccttatctgtaaaatgagggtaagggggtaccctcctcgtgaggaggaagtgacgggtgcctttaacaggttgatccccatttgttagggattggcaaaactgggattgtagaaagcaaccagcatcatctagaaggacaatctgaagccaagaggctagaggtgggaactgtatttaaacagcctccctcagcatcatatagggcagaggaaacaccatgactgtcagagtccactagctctgtgatcttaggaaagctaccaaatctcagggtctctctgtttttgtttttaagaaactgtttcgataggtagcctagggtggccaaccttgaactcctatgtctctcaggatggtttagagctttttggattttaatttaattgaattttttgagacagggtcacagtgtgtagctttggctggcctgaaacttgttaggtagaccaggctggcctcaacactcagagatcacttgcctctgtgtcaggattgctgggattaaagaggtatatcaccaaactaggcttggctttgaatttatgactctccttcctcagagtcccgagtgctaggattataggaatgagccactgtgcctggccttaagcctcagttctaccacctataaaataaggttgtggccatgtcttcttttaaccagacattcatgaagtcacataaaggaatgcattaactgtgcatctcagtcttcataggtaaatgaaggcttgttccctactggctcagagctgtgcatccagagggtgttttgttgttgttgttgttgttgttgctgctgctgctgccgccatgctgaggactggactcagggccttgtctatatcaggcagctgctttactactgagctataggctagctcctgggaccaggtttgatttatagatacctggagatctgacttctgcaggcttattagagacagaaatggtggcacacacctttaattcagcactccagaggcagaaggtagcagatctctgtgagtctgaggccagtctgatctacatggagttccaggatagccaggaacacatggagagactcttgtctccaaacaaaacaaaacccaagaaagaaagaaagaaagaaagaaagaaagagagagagagagagagagagagagagagagagagagagagagagaaagcaagcttgcaagggctgctggagagatggtttaagaaagaaagaaagagagagagagagagaaagaaagaaagaaagaaagaaggaaagaaagaaagaaagaaagaaagaaagaaagaaagaaagaaagaaagagaaagaaagaggaagcaagcttgcaagggctgctggagagatggtttagttgttaaatacaatcagtgttcttccagacagctggggtttggttctcagcacccacttggtgactcacaactgccttaggtacacacatttaattgaatctctctctctctctctctctctctctctctctctctctctcgctcaatactgtcttgctatgtaggtctgtctagcctggaactcagtttgtagagcaggttggcctttaactcaaaggccttctgccttctgagtgctgggtgcatgtgccaccacacccagcttgcctctcttctttaatatgttccctgatggcctgtgtattgttatggcaactgaaaacaaactaagacgtggacatatcctcacagttgggtggttgtctcgtcagttcttctgctggatatatcagggctagctagctcatagagatggagtcataactgtcagggagaatagcctggcaccttagaagtctcgcagtaccgctttgggaacattcctggtgttcagagcaagttattaaggctgcccaaattctagggggcagctataggtttcgccctgttctgatctgctcattggtctgctcatacttccattggcagagtacctgggtgctggtgatagacccagtggctttgaggtctggaaatcaaagcagagtgtcaatgcgcttggttctttgtgaggtcttggcttgtaggtgggcaccttctaactgtgctctcatggtcttctctctgtgtgtgcctgtgtcctcttcctctaggacagaagtcaaggtatattagggtctaccctcttgatagcattttagcttaagggccatggtttcccataaggtcacattctagggtactaggacattagcataaaaacatactctcttcctcccttgccaggaggttctgtcaagaacccatgccttcttggatggactctgaggtgacccagtctctcaccttggatgggatgcaactgtgaatacaactgttactattgtaacagttgtaactactattgtctcatctgcttacctgaaggtcagtgagaaaaacctctgactaggcctcacatcctccattttcaatttctcccgcaagcaggaacttttcccagttagccgctcaagtgtctgttgtctgtaagatgtcattgctgggcacacagcaggcttctgggaccacctcgcctatctttgctacctgtctttccctgggctcatccattgtaagtggagtttgttgtgttgtctccacgaacgggacagtgcagactgtccacacctgcctttgtcacctcccagctacagccctccatattccatctgacttcctctctctgtctttccagagcagtctccttggaatgagcatctcagtccttcgcagacacgtacatagggagtgtacagaaaatagttacagagcagaactcatttcagaatcttcacggtcctttcaggtcctagttcagaagcctgcagtccgaaatttcaaagaaccctattaggattctgttgttgttgttattgttgttgtttttgctctctctctgtctctctgtctgtctctctttctctctgtctcgctctctctctctctctctctctctctctctctctctgtgtgtgtgtgtgtgtgtgtgtgtgtgtgtgtgtgtgtgtgagtgtgatgtggacagggcacccctgtgcatgatgctcctgttggattcccattctttccttctatcatggattctgaggagtagactcaggtcatccggttgtgaggcaggtgttttcccggactgatcatctctctgtcccctccacagagattctgaaggggtttcccatcagaacctctcttcaaggaccatgctccttcctcattccacagctgctcatgtaaataatagtaacagtaataatactaatactaataataatttgagacaggatctctgtttagccctggctgtcctgaaattcactccatagagcagactgactgacatagcttctctgttctgttttgagaccttatgctgagctagcttaccatccttcctccactacttgggcactataacgacaggtgtgagataattacagggacttggtacgatggaccatttttgtccctcctatatccccccaaattgtctccccatcccagcctctgtctccttccaggttttattctagccctcctgaagccagggaaatcaaggactgatagcatgagtttgcagacacagctgccccaagagaaatgagaaaggggaagaaaagacaccaatgcaaatagacggcatgcagaggtggacatcaaatggccccacttctgggtacggcccaagggaagtagctttggtagcatcatcaacaagcacagtcgacaggagctagcatgtgctgcagcagcgagacttctgtacagcagttgggttctgcgtgggttccatcctgagactccattaggctttccccacagcttgtcagaaacctccagtgtgttcagctggctggagcaagccgccattctatagcttcagccctcccaccgtgctgtctctagtggtgccaaggtttcatccagaggtagagttcactgggggctctgaggagaggacccagccagggattagtaatgcccacaccccttattcagttttgcagctagactcatggtgggtatctttgaaggaagattagtaagtgtaagagacatgcagacctcagagttgcctcaggccccaggaatgaggtcagacgtgataaccgctgtgctgtggccagagctcccaccatgccatgcctctctgctaaaccagagcatgttttccaaacagtctggccggtcagtcaggcctggggcagcggtgggcagcaacaggctaagtgtgtcgctgggctgtgccccaaagcttgggcttcctaaatcagcacgttccctgttactcagtactctgacttgtgtgcctagaaatagaaaactcccctgcactggagggggcagggagctaagccctagtgacaggggactttgaattctcaggatggtgaccgaaggctgctaagaatatccagcactgaccacaagccagttgacaccctatgcagtggcaatcttctgttgcccttccggcctgggaggaaggaggttcctatgacatcacagctcatgaagttgtcccttctggtaggggtatgtagacatgagagtgaggagggaggggacataaaaaggcatccactggatcctgccttcaaggaatataaaactggaaaaccatagacctattgtccatctcttacaaaaatcatggtcagtcatccagaggggaccagcagctagatcaaggggtatctgaggcctagcagctaaggaacaagagccagggagactctagactcacacactccaatagctagccctgtttcttcgggtacaaagtcaggggcttggattaacgttttacaaacaaagaaatatttgtgtgttgttggtctcatgagctctctgcagtagaaaagaggccacatatacacgaatgcaggtcgcctggactacccaaagaagtcaagtaatagccctagtttgggtttagggtttagggtttgttcttggaggccagtggagggctggaaaaagcagattaaagactgagcaagaaagtgactcagttggtagactagttgcctggtagagcctgggctttgatccctagcaacacaccacacacacacacacacacacacacacacagatgaggtgctggcgaacatctatgacactgagaggtatagggagctgtcaggagagtcagaagttcaaaccagcatgggccacttgagaacctgtcgtccccccccgaaaaaaaaaacaacaaaaaacaaaacaaaacaaaaaccttagccaaggagacaaaaccaaagtaaccaaacaacaataaggaggagcagaagaggaacgcccatgccttcggagtcttgagagtggagcttattgttaaaaattcatgcttactatctgtgaggccttcggtttcatcctcaaccaaatatgaggtgggagaacaggacagaaacatacgcgtatatgtgttgtttgtatgtgtgggtgaggcaaaggttggcatcagtcatcttcctctgaagcccctggcactcccgacagcccaccatgcagaagaatgagcctcctaatttagcacaagctgggtgagccaacctaggaccatgagggcagcgctgagaggagggggagtgtgaattggtgccactctaactaggggcctggacagtggtctggagaagggctcttggtaaccagtgctttcagaatagagccctgggtgactggacaaaggggactgagggaaagtgaccaggaccagcttctaggtgggccccaaggtgactaggggctgaaaacaactcttgaatgaaggtctggggttgcccaggagggctggcagaggcctgttatctttatctccagtgaataccttgaatcactataaaattctggccacaggttctgcctcccttttcccctggtccttcctcctattgtagtttttattgtagtattgttaggatcctaggcccccaccccccaccccttacttagagcaagcatcctcctctgacagcatctttgccctgcctgtgcctgtgctgtctctacttttctgcaggatttcttcctgcagaaatccacttgactcacctcctttcacttttttccaccttccttccattccgggtctggaaaaggccttggactggtgaggtgtttcagtgtgcaaatggagcttgctgccaaactgaacggcctgagttcagtccctggcgggagagaatcaatgctggtaagttgtcctttgatctccacacatactctgtggcctacatgtgccacctccgcactctggatcacacaaggcttcctctggtcacctcagaatcatgccaagttctacttcttacatgctcttcatgtcctctcgtgtcttctgttgtgtccattgtccaccatctctggatgacctgctaccttgattatttagctgccatctgtcctgttggaagacacgtgtcctgaaggcagctatttggtttgtcccctttgggtagacagtgcctggactggcctctgcacacagtacatgtgtatcttgtaggtggggtataagccacgggctgcatggtggggagtaaactataaaggggcagcagctgaaagagggaggcagtcaggcagccattgccgcagcattgagagaatgctctgctgggcaggcaggtcactggatttggtgcaggaggagcagtgaaaggagctggcaagatcaaagattctggggctgcattactgaacagttggtggggggccattttctattgctgcatagcattctggagaccaggtacgttataaatagaaatttaagacagacatgttggggcatgcctttaatcccagcatttagaaagtgggtgcttgaggatcaggagttcaagaccaacctgaaatgtccagtagacctgtggctagtctgggtgtcctagcagtggaaaaaacagaagacccaagatggctcagcaggtgaaggaacttgcttgagtctgatttctgggacccaagactcctgaaggttgtcctctgacctttgacttacaaaaggaccacatagggggcacacacacacacacacacacacacacacacagagagagagagagagagagagagagagagagactcttagggtttctattcctgcacaaacatcatgacccagaagcaagttggggaggaaagggtttattcagcttacacttccacactgctgttcatcatcaaaggaagtcaggactggaacaaacgcaggtcaggaagcaggaggggatgcagaggccatggagggatgttatttactggcttgcttcccctgacttgctcagcttgctttcttatagaaccaggactacaagcccagggatggcaccacccataatgggccctcccctcctgatcactaattgagagaatgccttacagctggatctcttggaggtatttcttcaagggaggctcctttctctgtgataactccagcttgtgtcaggttaacacacaaaactagccagtgcgcgcgcacgcacacacacacacacacacacacacacacacacacacacacacacacacacacactgaatgaataaagtatgtattttttgactttaaagaatgctgggcagtgatggcgcacgtctttaatcccagcacttgggaggcagaggcagatggatttctgagttcaaggccagcctggcctacagagtgaggtccaggacagccagggctacaggtctcagaaaacgaaagagagaaagaaagaaagaaagaaagaaagaaagaaagaaagaaagaaagaaagaaagaaagaaagaaagagaaagaaaggaagaaagaacagtttaagccaaagaaagaaaggaaagaaggaagaagggaagaaagaataacagtttaagccaaagaaagaaagaaagaaagaaagaaagaaagaaagaaagaaaaacagtttaagccagaggtgataatgaccccctataatttcagtcctcgggaaggtgaagcagggagattgcagaaaatacttagcctggattgagggagggaagtgtggtctatttaggcgtggcttatgtgcttagtatgtgtgagaccttgggttctgagggagggaggaagagtggaaagaaaagagaatctaaccaccaccaaacaaacagaaaataggagacagggagtgagggagagagggagagagggagagaggagaggagagagggagagagggagacagggagtgaggaagagagggagagagggagacagggagtgagggagagagggagagagggagagagggggagagggagagggggggagagagggagagagggagagagggagagagggagagagggagagagggggagagggagagagggggagagggagagagggagagagggagacagggagagagggagagagggagagaggggaggagagagggagcacagaggttcacagcttgcaattctgaaggctggttggtaggtgcaagggtgtggtaggtgctggtgggcatctggtgagggtctccctgacacatcccaacaggtgcatggtatttcccaaagactctcccccaaatagcacgcacagttgtgactaatgggggttatagttccaacatatgaacattcactgtgggctccagtggaagtccctgtggaaaaggcagctggactggaggagaggcaggacagagtgggcatccggagcagagagcctccataacatgtgctgttagaaccaactgggctgtactgtagagaagatctgttcatgaaattttagggtttattttcattctttgagacagggtctcacactgtgcatcactcagactggcttttaactcactgtgtagccttaagctggtcttaaattttcaaccctggtgtcgggcttgcacgcatgggccgtcatacccagctttctcaggtaatttgactttattatttaaaattctcttcattgttccgggggccgtgccacatggaagctgttctctccttccacctctgcgtgggttccaggaattaaactcagggcatcagacttgagtggcaaatgcttttactcactgagccatctcgccaagatttgggcatgccattttacattttatctgcctccttttatatctaattcacactcagttgtttatttgtagacaattatgtcaagaggagagggagctggggaaatcagttagcactagggcatccagtaccctcttttggcctccacacacatacacaaacacataaaaataaaatagatcttccttttttaaaaaaatcaatttattatattttgaatttgttatcactttattgaggtatggcatacaaaatgtatacatctgcatgaccaacatccatatcaacatatggaacattccagaagtccctacagtggaagggaatctcctagtccaacttctaacaccttagctctgttcactttctgaaaagatgtcaggagactcctataacacgtgattctggggacagatttcctttggaccacattttatcagttagctgcatcatgccatctgtgcttgcgtcttacaaaacagccttccagcagggctgagccctgggagctctgttctgtgggctacatggagagacagcggtggatttgtttttaatttgagcggggcagagagaatattaggttgtggccttctcaggcttgtctgcggctggctcaggctagactggaactcttgatcttctttccttcctcctctgtcgctgccacccctggcttcctatcagtgttttaaagcaagtgacaggctgggctttgtgttaggtgctgcttgggattttaaagtggaagatgtagttgagaagagtgaagaggagataagcctggcttgcaggtcaactgggtgcttaagctgccagaccttgcctcttctctaggggactttcttcatgccattctggcctaaagatgagaaatagaaccattgcttcaggataggagataattcaagttctactgtctaggtcatgtaggaatgggtgagagacagagagagagcaaagagatgaaagagagagacttacttctgggtttggatgtggtttctggaacagaaattctttacaagagcctctcatgctgttggattattgctggtttctgcctctcacattagagggaatttcagaacccaacgtctagaaagggtgaatgctatggcctgggtgtggtgtgactcccccccccccccgccacacacacacacacacacacacacacaccagacacaacacaacacacacaccagacacacaccagacacaacacacacaacagacaaggattcaaatgctggcaccttgatctccaatttagcggtggtggcaactttaggtagtggggtctcttaagaggtaattaggtgcctgggtcctaagagcctttctgaagagatgcaagcgagtatcaccagagtgtattagctttcctgaaattgggttgcttcaaagcaaaacttactccccgactctctcttgtccccttctctatgtaggtactatcctcactgcttccctgccatgctctcatgatgcaggcaggggtcccttaccaagacaccaatgtcacactattggaaacttccagccaccagaggtgtgagccaagtaagagtttttacttcctaagatgctccgtctcgggtattttgtcctgccgacacaagcatcttgcccaagatcacacactaatatagccagccttacaaagcagatccgcatcctctgcaagctcctcccagactgtgtagcaccctccccttgacaaagagcctagtgttgccaccaaaagaacgaaattccctcattttgaaaggcgttgtgaattcagctccattgtgtagaatggagcaaagatgtctcgagccagcatgacattataattcacgtccctctcatgttatttatctttgcttgggtttgtgtgtctttggaagcagccttaaatcattattggaacaaagtagagagaaaaataataatatataattacaaatgaggaatacaccgtatgatcctattaattgcctcccctgcaatctttatttttggcattttgataataattaaaggattaggcttcaattggtggcagtggcgggttagccttgaactctataaacagtagcagtaccccctataggagtaatctggtaccatctgccacctgggacccggtcgagcagcaccagggctatgctctgccaggctcatctgaatatttactctgctctgaagagaaactgtggcaatggttggaaaataaaccccaaagcaaaggagaagcagaggagtaaggagactgcacgctgcattaatcattgccagccagcctagagaagaggaccatggctggttcaagaagacagagcgaaattatcatcaagattgatttcccctccagattccctgtgccaacaagcagaccaggagggtcccagtgtagccactggcactgaacccatgaaggtatcctactacaccttgtcaaagagcaaggcaaagctaaccaccaccctctgcctgtgggtcattctggagtttctgccagttccacccttggcttcacaagccacaggagtggggcggtgtgtgtgtgtgtgtgtgtgtgtgtgtgtgtgtgtgtagccctctcctagggacctggcagataaattcactgcaggacaatgatgtccttaagggacatcatttgcatgccaggatgcagtgaaggccactgttctgagcccagttctgataagctgagggacctagccaatgaatgaagctgttcacaggtcctagaaagtatgcaagttactacccatgtcttaccacaagggcagaggcagagatgacttgggtagcagttggatttggtgaagagtgtctctaagcctcagttccctcatctgtggaatggagacggtagttttctataaggaatgagatcagtgaatattgtgtttggcatataggaaaccctttgtaaattagctattctaatgctgaagaaagcaaatctgctccctagatctcaaaagctcttcagaagagaattgtggtggtggtgggggggaggacccctttccatagcacatcgcttcccccccccccagtccccgtaatgataggggtggcctttgtttgtttccagggctagcaatggaacccacgggcctcacacatgcgcagtaagtgttctaccattaagccagatctccagtcagctccatgagtgacctccatggaagctcaaaaccagagaaacttggcccgggagtggggaagggcaaggcaggttataatgtcgccatccaatgcagagcctcaggggcacagtgaggtttttctaactctgttacagggtctgcttgctctgtctgaagtttttaccttgagtttcctggccccacacatatccaaggcttatctggaagaaaggtactcttcatggcgacactcgggttcccatggtgacacctgctgatcctggaaagaaagaaactccttggatgctatttactgcagttggcaaggggccaggatgacccacgaaagacatgattggaggattgggcttcagaagtatctggtttgcagaagcagtgtaggcgcatggctgacatgtgccagatggccgtgaagttcagggagcaatccctgtggccaccccttcctagactgtctatataggagtatggttttggggggagggcgcatttctaagagctttagtctcctcggctgtaaggtgaatggtagtgcctcagggttcttaggaggcgtgcaggagactgcatggaaatgtacctagtaaagtattggaagggagcgaaggtccctcaataaacactagctatttttatcctgtacaaattagtcaaacagacttgcttgcatggtgacacagttcctgttagttcatgtcaaaggcatggaactgagagacaaactcaattgccccgtgccagttataaccatagcctacatttatggttcctggggctcttgaggagaaggagcctgcatcttctgtcaccaagtagcagctggattagctgagcgtggtagaggaacttgtgatcctgggccatacagtaggaccctgtctagagtggtcaggggtaggcaaagcacaaaaaggaggctatgcatttggttttctctggctcttggctaagggctcctgctgtcacctcctgtggatgattttctgctgccctcgggaaggctaggacacctagagccttccagaaacatgcccatgcaagtgagccactcggctcctctgaccaagaaagagctttatcttcatctcgtgctcccgtgggtctttcccgatggtatcaactcttcatgccttgtacttcactttcctaattccttctgccttagtcttccccagaaccacagatccactctctgcaccttagcaccacccctccagctgtcctgctctctcacagtgctcccctttctgcctcggcaacagaatgagaatcaggaattcaatcattcagtcacgaatttttggagattgagtctcagtatgcaagccttgaattcactaagaaggcccagttggacagagacctgcctgcctctgcctcctaagaatactgtcacagtaggtcttttgttttgttttgttttggaaacagggtctcatgtggcccaggctgtctttaagttctcagtgtagccgagaataacctttaatttcttcctttctctctttctcgctatcttcctttctttctttccccacaagaaatcaaaggatttctttgtgtaacatcggcgttcctagaactagctttgtagaccaggctggcctcaaactcacagagatctgcttgcctcttcttcccgagtgctgggattaaagagaccttgaatttcggatcctcctgcctccacctcttcacagccccccaacccccttttaatggggttgttggggatagaactgggggcactgtatcaattgagtgacattccaaacccttgtttgtttttgaaacatggtagcagccctggctgacctgagcatgctctacagcacaggttagccctgtctctgcttcccaagtgctgggatttctggagtgtaccacccttctcagcccaatagtgtgtgtgtgtgtgtgtgtgtgtgtgtgtgtgtgagtgtgtgtgagtgtgtgtgtgtgtgtatacacgtgcactcagtgggtactatgataggctctaggaagacacagtgaacagcaacagagagagcccattcaggagctgacagcagcctgctcagatggtgggtagattgcatggaaatggtagagaacaagttgcttggtcagagagttcaggattgttggtttgtttttagagacatgacctcaccatgttgcccaacctagcctggaactcgatatatagctcaggctggcttgaaactaaagggcctctttcctccgtctcccatctactgatgttacacccggataagaagtttgaattttgttagcatagcctgagtgtggagatcagaggtcagtttcctacacggtggacatggagatagaattcaggttcttaggcttggcaacaggcacctttagcaactgagccaccgaaccagcacctagttggttcaatctttgaaacaaggttttgcattgtagcccagcctggctttgaactcataatcctaccttctaaatactgggattccaggagctcagcaccaagcccagatgtgcatattgtacaaaggcctgtctaacaggtatgtggagggtagattggacaagcatgagaaatggtacctggaactaaaatcttcagtaataatccaagcaagagaatgcggtagcctgttctgtggttaatgcaaaagcttggaaactaggtagaatattgaaaagtagaatcagttctctttgccagagtgctgcacgggagcatggtggaaagtgaagggggaaggtttgtatcgttccagttttagtatatgtgctgccacagcgagcactaagaggaggttttgtgtagggctgtataatggtaggttacaaagagcatgggactctgaaaagaaagctgcctggatttgaatcctcttgtcacaaatttccttgagtgttttgaagtcctttacttcaatttttcacgtgacccatagctggtgcccttactggatagttgaaagaattcatagacaatttctgtcctaggcttgcttacttaaacatcactgggtaaatgttagctgtgcttactaagctagatatggatcccaaggtgagctatccggtctgccctttgatatgggggacctggaacctggaaacaaacccagaatcactaagtgaaggattgaaacttgggatgaagttcaccaaggaagcggggggaatacccaggcccaaggccactggagggccacagaaaagagcccagcaagagactgaaagtggctctcagcctgacaaaaacatcagtaggtcctaccactggaaacacatacaagggagcagggtagcgaaggcaaggattgaaaacagttcacaaacctttgatctcagcactcaggaggcagaggcagggggatctctgtgagtttgaggggagcctggtctacagagtgaattccacagacagccagggctatgtagagaccctgtctcaaaaaaaaaaaaaagaaaaagaaaagaaaaagaaaagtaaaccagatacttccccactcagcataaaggaagtgaccggttcccagcactttctgcagaatgcctagggaggatggatagaatagtttgaaaaaggacgtattatacaatgaaattgcatgaattttggcacaaacaaggaccattgccttgtgctgattgagtcacctgctacctgtctgtgcctataaatccaactgctagggaggctgatacaggacgattgcttgagttcaggaattgaagccagcttgtgtaacctaaccaggacggacacacacacacacacacacacacacacacacacagtatattgggagctgcaaggtgtggcaagaagtttcctgggtaaggagcagaatagttcatgcaaagaaattcggcttatgggcactgctggaggtctataacccactgcagggaaagcctagaatgtaagggaagctacctaacacatggcttaaacacacacgcacacacacacacacacccctgcaacataactatacacacatcctgtgcctgtttcttctcttaaccacagaccctggaagtcttccctattcgtaaacaaagcagaacatttcatgaaggtgctatccaattgttgctgggcaaattacattgtttcggatcctatgctttcacaaacaaagctgtgcttaactagtatcttaaacatacagacacacacaagcaacaataacaaaaagaaaactttgaaactgatgagtaaagaaatgagactgctatgctggcaaatgcctttaatttctgctggggaggcagaggcaggtggatctctgcagagtgagttccaggacagccagaattagatagagagaccctgtctctaaataaaataaaataaaataaaataaaataaagaaatggaactgttgcctggatgtagggatctccatcaagaggtgaagctgtcttggaaaacagacacataggaagctagtcccaggccctgaaagaactattacattacaggagatgctttgaccaaaggaagagagcagagtcagaaagaagagcccttgctgggcgggcatggtggcgcacgcctttaatcccagcacttgggaggcagaggcaggcgaatttctgagttcaaggccagcctggtctacaaagtgagttccaggacagccagggctattcagagaaaccctgtctcgaagaaaaaagaaaaaaaagaagagttcttagaatttgagccgggaggcagctaggaagagactggggactatgtgaactagtgtagagttgactttaaagcatcagtaagacgttctgggtgctgtggtgaccccaggaatgggtggttggctttcagcaagcgggtaagctcattttacaaattacctgcaatagtgctaaaaagcaagtctgtcactaaggagcaggatctgggaccttactaatgagactttagcttgtgtgtgttggggggaggttgtctgaaatttgtgtatttttcccccataggaaatgacatatatgtactggaaggctttggaaactttgaaaaaaattcctagaatttatagttctgatggttttgcaaattgtatatttaatcaaaggcactcgaatgcctctctctctctctctctctctctctctctctctctctctttaactattgaagagccatttaaatgtcaacataagtgattccctaccaaatagtgctggttagacattagttcctctaatagaccataatgattcataaggaggcatttctcgactctaaattgtaggcctattgaaatataaattaagatgataaataatttgaccttacctgagagtactaagtatttacacgtgtcaaatacgaaattaccctgaatatcacggcccctaaaaaggcagccttcgtctcagtaaataaaacgggttaatgaatttcccttggagagcgaagggaaagaggaatacacaaaaggctttgctccaggggctcggccctcccggccctccagacttgcagtggggctggggagaggcgcgggccaggttcccccggagagccaggcgggtgctggcggccttcggcgctcggcgcgttcccttctccccctccttccgcaacggcgctggagtttcaaaacatggagtttccacaggaactttgccaggccgagctcgcagccctcccgggttcccgcagcggcactcgcggcagcctccccgcagagagcgctgacccggcggccacccagcgcagcgcaaagctcagcagccccggttcactccctggggaggcgcagagcgccgccctgccccccccccgccccccaaggtcctgcagagaggactgcgccttcggcccggagccgagcccatccgcccagccagtgtgctggcccggggcgggagtcgccgaggcgatcgttgccgggtgggcacgccggcagccggctgcccgcggtgggatttggttttgttttaaagccgctttgcgcgccggggctgcggcggcggctgtggctctgtgtgtgtgtgtgtgtgtgtgtgtgtgtgtgtgtgtgtgtgtgtgtgtgtgtctgtgtgttgggggggtagcacattgtcaatgagaaatttcctgttcgtaagactcagcttgcagtttctgtcctgcccttgaactgacaagtggatctccgcggcgagagtccgggagagcctcggcagccgcgcgcgggggtgggggcgggggcagcggcgccgaggccccgggagcggggctgagctgggccgccgcctgccctcccgtttcccccgcgcacccgtgagctctgagccgagcggtgactaatctgtggctccgggcctcttggcgcgcagcccgggctcgcctcccgcccccttgtccctcctccttccccagcccctgcacgcagagctccgcggggtgaatcgtgcgggccgccttgccttgccttgcctagagtgtgggaagcggctcgaggcaggcgacttgggaactgtctctttcgacccgggccccgagtgtgcgtgtgtttccttccccgtaggcactttgatcagcatttcctctgtgccgcggaggagctagagcgaactgaggctctttaaccctctgcatgccacatccactgaaggcttcagggggaacatgcttcgggagacaggtccacccgatcgaatagatttggccaagccggagttatgtggagccgggctggatcccaggaatttgcccctgtgtggcatactcttctagggacagcaggccgggaagcccaaagccaaggggctgtgcagtaacccaacctgcccggcgaggcgcggtgtagcttgaaaggcccagcgggctgtggcttctggaggagacagggaagacttggaggaactgccttagagcagttcgctggcacagagatgcctcttagtctagggtagggagtcctgctcttgccccgcgctctgggctctggcccccactccctcccttgactcggcctcgctagggagttaatgattgatttactggctccgagaggccggcgccctcccaagctatttgtccacgctgaggagttgctggagagaggcgcagaggcctagggagcagggtctcgcctaggaggggcggccgggctaccgacgggaaaggatgagcacttggttagcttccactgggaaactctagccgtgtccgcggcgaacccgcgggaggccctgccaggacgaagaagggtgccttgggaagtggcacatgtaaatggattggcagctggtgattaggccgcccggttttatgagtcataataggccgcccgcctggccctcaacctgctggttgtagacttggtgtgttggggcccaagcggtactctactcccaaccgcgcagagcgaggatgctccagggggccctggctgccgtaagcattgcacaggatttcctctcatttctcgcagaaggcaacacaaacaccctaaatcaaactgctccgacaaccgaaggctccacacagacacatcaataaggatttcgcctcccgcgttcgaacgcactgaaacacttgtcctatttttatgcaaatgacaccacacaaatagatctcgcaggccctggagaggggcgggaggaggagggacgcgggcgccccaccagggggcggggggggggcgtcaatcccgcacctcggggcccgcgctggctccggtgcagtggggctggcactaaccaggaggcccgccccgcgtgcggtggctccctgccagcgccgcctagtcggccgcgtccccaggctgcctgcagaggcggattagggaaggagcgaagcgagcctgtgactaatcgcggggcctcggaccggagcaccaaggccatgtgcgactgacaggatcgacactagccgaggacacggcgacgcctcgcttaattgcaggctttaaaaattgccgcctgagcagctccaatgcagaaagccacagcatacgcgtgggtctggggagtgcgaccgggggtgtggggggggaggggttgtcccgatttctcgcctgaagaggggaaggtttggcatctcctgaaccgagggagcaacactgagccccccccccccgcgctttgcaaggtcttcccaaaggcatgctaagtgagtgtgggtgaggtggccagccaccggggacaaggttttctgtcatttgtcctttgagtccatgcttccctcttgttgccccgtactctataaagaaggcctacagtaaatgagtaaggttccagccagccttttgaaaaggagaatcacacgctaaacactttacttcgatcctttcctttattcactgactgagaaacagggccccgaaggaccagacgaaagccaagtcaagtcaacgcaccaaggatcaaggtcattgagtgccaaaagtctggggtcacagacaagaaccctggtctcttcgaaggcccgtggtcacagtccctgtgtcccaggccttcttcctggagcgctggggcctctcaggagagaagcgtcggcggggcggcttgtctgtgagtggaggtgggggttggaaggcggtggcggggaacccagcaagagaagtttccaccacgctctgctctgttgctgccaaaatcccctggcccctccccgcccgcactgccttccgttgccaccacaagtttggtttaacgagagagctcgggacaaaagcaaaccttttctatagaccctgaaaacaaaggggaaagagacgcgcgaggccgcagagaagcggctgctagcgtaatggtgccaggccgaaagcagagcattagaactgcaaaagccgcgcgggcgggaggaagtgcgaggcaggaggcgggagcgccgggagggcgggcgggggaggggcgctgcgccatgtttccgtgtcacccgccgagtcgccggcgctgggctcggccgccggctcccgcctgcctccgtaacggcagaaagcgtgcgattagcagccagacaggcggggactccgggcccacggggccgccgcacacgccgcccgcggtcccggcccgcgctcccctccccctcccgccgggtaatcctcctcctcgctgcagcgctgtgtgcactctcattagagcagggtggcttttctctgcgcactcgctcggctcccgctggcaaaacaacgccttccccggccgggccctgggccaggggagtcggggagggccggacgggggcggggtgaggctgggacagcctcgcaggttagctccgccgccggttcgaaaagatggggaggaccctttggccctcccccacgcgcagtgccaaagccgaaggtccataccagactctctgcccctcgggagaggggggagatgctggtgccatcctgacctactgccgtccgcggcacgaggccagaatgcgtggggcagatgagggtgtctgggttgaagagcgggagtggacactggggaaggttcccacaactggtttttgacccgtgtggcttgctaacgacctcttaaggccagaagctggatttcaggtgttgttgccctaagaccctcagggagatcagtgccctttctggctttggggttgaccgcccaaaatgagtaggaaatgggtggggggagactccagtgctccggagcgccccatttctgttccgcgatctctgtacacaacagtagacagcttctccccggcacctcgcgcccagctgcagggctcgggagcaggtgttcctgcctggcccaagtggcggctcagcgcccctcctgtcccagctgcggggcccagagaggagggaggggaaaggcgtgttggtggcggtaactgggaggggggggacgtctcgccggaccttgcctaaaatgggtccattccggggtgcggacaatcgcctggagcctggaggaatctaggaggacagacggccagctcccgtctaggactgccctaggggccagcactggccgttcggggcggcgggagggcttccggtccccgtgactgcggcggcggggcggcggggaagttcccgtcgcggccgcgaggagcaccctcccctggctgccgccgccgcgcagctctcggagcagcgccctaggaaccccggggcatcgggcgacgtcgccctcgccttgtgaagggatgggggcttcagggtgttcctcgatccccgccccgccccagggacctgaacgcgggatcggggaccctgcgggatcggccgcgcgcctcccagcccctcctcgccgctgccatggcgggcacgtgaaacgcagctcggcgccgggagcccgccggggagcggcctggcccgcccgctcctcttcgcagcgggtccagggacgcggaaccaagtcgggccgggtcccgccgagctctccgcggccccgcaccccatccctgcccgaaccgggccttgaggtcacgccagacgactcgtccaaggggaactcgggctgactaatgggacgcttgtgggcctccggagaggccgggctggcagcagtgcccgctcgctctgcgctgacgctgcgaccaggctcttcggggaagggcgagaggaggggtttccccgaccggtggtttcggctccctggggacaatccggctgcggatggctctgggctttgggtcctgtagcctgatcccgggcccgcagactggaggtgcttacgggaagaaggtgcctcagagctctgagcctgttgtggggtctcctttgcttgctatcttgggccagcagctttattgggggggacggggggcggggagttgcaggtcaccttgagggcgtgggcttagataccaaaaccttcaacaaatagaaagtcttccggaaatccctcagtgaggagaaaacaattgataaaactcagggagagtccagtttagttgggagttctcagggtctgggccctccccgccccccactcccgattacagggtcttgtgaaaatcaacagagttttttttattttttccaacgaacagccacctcattgttgacatagttattatatggccctcccaaatatagctacctgtttgttttagtttcagcacatcctctcgatggtgagacagaaatatagaccagtaataaaagataaacatgtgtcagatgcagaataagtcctcatcgcgcatccctggttttgagtttaattacactagaaatccagtcctcccacgagaaggcctgaaaccctgcagtagaggtgcgacttttcctggagagcctcgcctttggagaggggttgctggtggaaggcagttaggttttaaatgtcacttccaaatgaaaacgctttccgtcagcttttttctttttttgatgcagttttcgaaaggagcattttttcgagataagaagtgaccgatcaaaatcgctgaggggaggttgtaagcagccgctttgccccagcttagccttatcttatctttcacacttgcatggcggaaaaaaattggcttatctttatccccaccccattctcgccttaattgctaaaaaacactggtgtgttaaacgggcaggaaggaggtctctggattgtcagcagaacaggaagattcaaaaaactgtgggctcctggggaaagaagagggtgacagagtgtattttcccccccccttggcctttcttgtacagtgtggagggtcctgtcccagctggaaggcaccatgatcagattttttttttctttttaaaaagaattaaaaccagtatggctttggcttgggcatcttcccggagcctcttttttttctcgacaccctgtttaccaacctctctccttcatcccctccccctccaaacaacaacaacaacaacaacaaaaaaggtcagtgggtctctgattgagactccctaccttcatcctctctcttctgtgttgaggggtgggggtgccgggttgggacgtgcagcttgctggaaatcattaaaatatatgcgggtgtctgcaaacacacacttttaaatcatggcgttccctctccatgctggtatatttaaactccagagcgagctggatccccttcctttcagtcgtttgtctgtgtcaccgacaggccgctaatggctgggcttccaggcgctgtgcattatgcattaacctcctcctaccgcggccccacacagaaggttctgtcaggcctcacgacgcaaaccactctacatccccgcaatcaagacagggcggggtgggctgtacgggtgctaaaggtctggagacgctggggtatggagtgagggcacagcagatcgggcctgcaggaagaatagactcaggtgaattgtgctggtgattaagttaaaccctttggaattttcagcctggagaggtgggatggtgaccaccccacaccaaccactctccccctctgggtacctccccccaagcactcagttgattagaattaacccaagttctatttttccttctgctggcccttagtcatttccagaccccgccagtccccaggtagcagagataagcagaaaatggttggtagcgggaggctggtatgttgggtgggaaggcaattatttggcaactctgtcccctttaatttgcattcccacttaccccgcccctcacgcaggataaactatgccctagagggcctagcaaaacccagaacccagtcctggacatagcataagggtggatctgcaggggcatccggcttcaatgcaggggccaggccttttcccaaagcctcctgtgtttctgccatctggccagtacctagtcagcctttggcaacagcagtatagactgagattccagaggtcagggcctggcataaatgtagcctagagcaggattttcctgagattatttctgtgagccattctggttctgttctttgggccacccacctccaaacagcctataactctccaaaggcaattatcttttaacctgtccaaccccaaatctaacagttttctgcccgggaaggcagctacctctctttagatatttcacaattagtaaactccttagggtcatggataggcctccaattgttacttcatttgagttttgaaaggaagacaggctgagctagattggtctacgctactccaccccaccccaccccaccctatggatctttttttaagtcccattgggtaagcctagagttcatttgctaaatgtaagattggaacactgtgaatgtgggttatttgcatgtttttaaaagatagttaacattaacagtatagcccacattacataaagtaaaaatgcatctttaccattcatgtatggagtgttccaataactccaataataaatctagtaacatcagccagaaaaacaccagctgaggaggcctatataggaggctacagaactagggtttccattctatacatacctgtcataaatgaatccccaaccacacacacaaagttgggaacccagattgcccctaattgtaggtaggacctttgcataggatgcaaggccttaccccagacctaggggtggctagactggtggaagtgcggaaggtcttataatcagcagaattcagcaaggacagacaggtttcaaatttgctcctagaagctccaatttggttgtccagttgcagagcctgcttagaatctgtagcaagagaaggcccgggagtctaaagtccagccgaacgttataatcacaaggccttttcatgggggatgaggctggtgggggaggggaagcatccgcagctccacctcgcagtacttctcatttccgtgctgatttatttttcatctggcaaggcatcctcccttgcctcgctctcacttgctcatctgctgcgctttgctttccctgaaatcctcccttttcggagtatcacagtctgacatcagggtcagctctagtgggccttagaggagagggcagggaagagtgcgaccatatgcatctgggcactcccagattcagtagccacccctttgagtgaggggcacaagaagggactgcttttcaacagctttcttttcccaggcaacaattttgacgaaccaggccaataggtgtgatccttctccacttagggccctggggaaagtctcacattttaattctcagtgagtcagaaacaccccccccacacacacacacacatttttgcgcctgcctcttaggactcccttaataagatattttttaaatcccacggaattgggaaacgcatccctaagagatggaagagaaagcttttaattccaccaactcactggagaaccccgtggagtccagagactcccttaaagaagagggggtgactgccacaaattacgtcaaaggcgaatttactggcctgtttgtctccagcatcaaatttctccagcagtcagccttccccaaggccccttcacccttacagcacccccctccgttttagctctaggacttaaagttagacaaacagaccccattgtcagcagtctcaggaggccctacgactcgagaggcctcaggctccatgatcgcctcctggattttcggaaagttctggacagttaatgtaacttggacgctgggaaaagcctgttcctgggagaattgggaggtgagaagagggggagagaaggtggctgggcagcgagccagggcttctgcggtgcggcctaaccaagccggatgagcctggcactgctctgctgttagtccaggccagccctcctgcccagcccacagccgcaccgcggcctttctgcctggaatcgtgtacagagtttccccacaaatacccaactccagctttcccggttatttaagacttgttttgaataaaaggagtcgcttcaaaaagaaatgttgctacaacacacaaccagcggccttccctccagctgtgtctgtaacttgcatgcgttcagtctaataacttttaatgtctagccctaaaacgtctttataaaaaatagctttacagcataatagtccaggtgtctttctgcttgttaccggagattaaaaaaatgtgtaggttagctttcagagacaccccctccgccactcaagaaagaccaggaaaaagaaaaaaaaaaaaaggcatacattccattctgcaggcgctggttctggaagcattagcggcacagcacagctaggcactacccactggcctgcctctcttttgcatcagttgttacaagcatctctggagcatgaagatttaattctgttcaaagtttcgggtttcaaacggtagagatgtttcacttctgctttgagaagggctgtttttataactatgctgagaactaaaacagaatgaataaaattgcacctaatatcagtcacaaagtcagtagtgggtgtcatttttaaaaggaaaaatatcttctagctagagatgagattttttggtcttgaccttgacttaataatcaacttgagatgcttttaattcattgttggcgtgtagacgctccaggatatttaaaaactttccgagtggggttactagccacttccatttcggacttaggttctcatcaagcctgcaccaccctgtccctaggcagaagacatactccagcccgtcccagaatcgaaagaccccgtagaagcaccgaatggggtaaccttttggcctcggtgtcagggctcccagcctgtgtgccttgacttcccttcccgccagcttttcaaactggagcggtgttcgtccttgaggctctgcattccggggaggcctgaacctcgcttctcggcttccccctttcgcttgcctgcccttccccgccccccatccccccctggcgcccagagctgctcctggtgcgtaggagaagctcgatacgtgtcaattggattgaactgctgcgggcgcaggctgtacactgccgccgagccttgatctgcacgacgttaccgagtgaaaatttatgggctgaacggtgaagccaaaagttgttcccggccaagtaaaataaaacgcgggagatactctcacgaggccgaggtgagagacgagggcagaccttccagccatcggaggtccggactgtgaaatgcttaagaactgggagaaactcaggctcatcccaggtccctttatggtcctcccacccccttgtgtccccaagagcagccccccacctcaacacaattcccacacaattgaaatgtccggggagcaagggcgcggaactgccactgttgcgggtggtggtgttttcacgtagctcttagcgccttaaggggaagtagctcctctgggaagaaggggcgaggtgcggtgggggtggacgcccacgcgcactcaggctctgctgggctggctctcggaggggacgctaggccgggagagcgcagcgctggtggcgagaggaggcagtggcgcctgccgctggggtttgacagctttggctgagaggagtgcgaggcgctttatggtaattgcggtcctccactggccttctgggtagcaaggggagtctcggcgcgcggcagggaaagcctcccccgccgccccgccgccccgccgccccccattcttggggctggggatttgttggccgacctagccgtcgccgctgcggagtcggtctccaataccctaggacgtgagccctggctgggcgtgaatgctaactcggccggagctgggacggagaggacagagggcggtagagttggggggggggtacgaggacacgacccgccacccaggtggtttggggttcagatgtggcgaggccccaatgcacccggctgggaatccgtgagggccggggaaagtcgggcgaacctttcctggggaatcaccccctcccgaaaccccaccgcggaggcgccgcagcggagggtgagcggagactggggatctcaaacttgcgagagctggaggcggcggcggcggcgggcgggcgggcggctgtcgctcgagcgctgcgcctgaggggggaggggaggcggctgttgggagggagggagggagggcgggcggagggagggggaggaggaagaggagggaacctgggaggggggacgcgttgggatcgcggcgtgcggcagcagacggagcctgagctcccagcggcaaggtgaggcagagctgcgctccgggccgaacggcgaccgagctcttcggccgagggggagacgcgccggaacccagagcacgaccgagagcgggagcgaggcgggcggcggtggcggagggggagcacgcgagccgccgggcggagagcccgagccgcgctgtcgccgcggagggacgacttggccaacacactcgctcacacacactcacacacacacccagcccgagcgggcgctctcggcgaaccgtcaacatggcgctggggctcttgcccgagcgcgggcggcagcggcggcgcgggagctgctgagggtgacagagctcgggccagctgcgggaggagaggatcgcgcggggccgtcgccacctgccctgaagctcgcagcccgccccgccccgccccacccccacgcggcccagagcccacccctccgccgggccgaccccgagggcagcagagcggctgcagtcggcggcgagcgagcgcggcgctgggagtggactgcgggcaccagaggaagccaaactttgctgctcgctgcgctttcccggccgggctccttcacgtagccgccctctcccgaccccgcacacattcacccagccagccgcccccggatcttcctcgccgcctggactccgctccggggaaaacttcaaagcgccggatcgcagggctccctgcctacttcccgactggggatttcaggtcagtgcccggaacacctttccccgggggccgcgggcgggctggcgcgccggggactgcagccgacctcctccctccgagggtttctcctccgacttcggtagacccccgttgggaggcttagctaccttgctcgctttcggttttacatcagagctgcaagttattaaaaatgcagccaacctaagcggcccccgcatgggcaccagggagggagggactcgacggaggacctgccgcctcccgaggggttgggaggatcgggagttgaacgagtggaagtttgcagcctctgtgtgtctgcgcgggagcgcggtcgtcgccgagcgtcgggagtcaggcgggggggggggtgctgggctggaagctgggaacctcgtctcggcgttacctcgctagcaggaaggggagggcggcgggttcccgtctgctttctttttcgactcggaaaagaactgtaaaaacccccagccgccgccgcttcgtctggcctctcctggggcccggcggtgcctccgagtggaacgccggcttgagcgtgcgctagtgtgtgcggcgggcgcctcggaccgagccgagctcgacctgccgtcgtcgctcaactccggaggggagtcccgggtttttccttggcttgccccaaagcgtgaatcacgtggaataacgggggcgggggggggggcctactaggaaacagcggagagccggagattcggaatgggccagtccggcgacccgtcaggtcagatgcattgttttgtaaatgttcttttaagattctaattcgaccccccccacctccatcccttcccttcgggaggcgtcccaaggcaggttttaagttcggagcctcctggagcccttgtagactgcttgtttagggacggcgtgggggagcgagcagagccctcggctctccgcttggctgtacggagcctggtgggaagccccgatgggcgtgtgaaagtctgcggccccgggaagttggtcccactcggagggagggcgacgcggaggctccaggcgaagaggaactcgcgcaccgggcgcgatcctcggctgaggcggggagggcgaggcggcacagggccagcgcttgaagcaggcgggaggctgcgctacggagccgccacaaactcgggggctgcgggctgcggcgaagagagcctgctattttcgaagagagcctccgagcgccctgaacggagtagggcggctcgtggcacgtgtagtcccggcggacttctggctgcccggcggctcaatggaacacgtacccacgtcccgaagacgaccgaacctgtccccttgtaggccgaggccgagccaggcttaatttgctgttaatgaatcttttccagaaagtctgcgacctccagctagactctgaatacccgcgcgcgaagacgcgcgccgccggcgtctaaagggtgggggttgggggaatagaaaagcgaagaaggaactggaggagggttatgtttatttaaaaacaaaccttaaaaagaaaccagcgcgcctcaaataggtattcgtcctgcctggttgcgtctagactagacagaccggggttttaactgtaaccccctccctgcgcacccttattgagagaatgctagggatgagtactgctatttggttctaaggttagttccttggacggaaaaaaaatactttaaaatggaccgggaggaaaaaaaatgaggaaatagcccaccccagaaggtggtgggtggtgagcagacagacttgggtatttctagccatctgacacttctgtggcattggaaacggacaccaccaccgggagagaccgacctgtacacggtactggattttgctaacagaattgcttgtgtggaaggtatttcaattgtcgacctcagagacacctatatgtggactcttggggggaatactctcttctcgacctttcccactccatccccgactagttacctggtctgggttgcagtgtcgcctctggtgtttatttgggattgaattgtgtcgtgtagacctacgcggagccgggatgattaatatgccgtccaggtttaatctgaggctggcctttagtgtgcggagtacaccaccacgtacgcgaattgcctgcggtggttaggggatcacgcgggtttcggtcaccaggcgctgggcgggtaggtctggactggggctcgatcggccccagctctctcctttgaggcgctgtcaccagtaggtgactgagagttaattaggaagtgttctctggatcaatgggccgcacagctcattagcgattctttccagccctttgcagggccggcctggcctccgcctcccacacagcccgggcccccgcggtccctgctgcggagagtgccgctgggaagtggggaggggtggtcagtgagggacagcgggcaggccagaacaacttcgcagggccgtgtgttgcgtgcgccgccgcgaggtccccacagcccgctctttcttcctgctcgcggccgcctccactgtgtctttaactcgctctagctcgctttgctgcctggctgctcctccccgcctccctcgcctatctcttgttctctaagcacgacgcctgtgctccccgcccagtttgggattagacaagataaaaataggactgcccagcgcgcagagctgtgacagtgcccgggtagccgggctgatgcgagcgcaaggggtagggtctggggaagactagcagggtgctcgggtcggccagattcttattggaccctcacctcctaccccgcaggcgccgtcacgctcgctggactccttccgctgtgaaccgtgcgggccagggggacctgagcagggtctccgcgctctcgcgggtgttgttggtgtgcgggtgatagatcggtctagacaggcatgcagactccctcccggctgaaggacggggggtggggggcagtggagtcggcagccgactccggagagctgtgagctagcaagctaaagctagcctgccgacccagcaagccgggcttgcttgccgggtggaaggcagattgagggggtgtctcttaaccctttaagtgcggtaaatagtttaatggggggagggacaatgagtcttgtaaaagtgacttattagagtggtctgcggggtgggggcctgggttctagacccactcgtgttttcctttctcttctgtgtgcatccgcccattctttcacaaatcgaatgcagctgctcgacagagtactagcttgacctagtactcctgattctgggaactttgacctcaaaatgggcaccctcgcctaagaatctgagtttctgagcagactatatagacctctctgtttccaatggggacctgaagcatgtagggggatactcaaagtgagagaaggtctctctgacccagacgcctccagattaaagcccccccccccagcctgagatgccaggccagcaaatacagcatgtatgtattggtggcagaacacagcattccttgagttgtccataaatacttaaccacgaacttgtgaatagttataatcagacatgtgggagagacaatccaaattggagatggtctggacacttaaaaaaaaattctatcattcgtgtatcgatgacctaaaatttactgcagctcaccataagttagtctagttctattcggggctggatattgataggtaggttcccctatatagaattaacttattccctccctcctttcccccttaaaaatgtgtggcctaaggttcctctgtttacatttaaactgcaaagccatgctggtcaggccaggaaatgaacttcattatatggctagccaaagaacctaagcagtagaaagggaatctcagattaagatgtatctctgaatgacaagtgctgggacaaatctagagactttggtcccaatgtcctagtagaagagatgcccaggagataaagaactggacaagagcagagtaaacacgggtatgtaaatgtagaccatgtatagtggtattctaaaagaaaaactgtagatgtcatgaaactggaaagtggggcagagtttccatgtgttgcaaagacaaaacccatttaaagaagtaaagagggtcacttgggaaagcacaaaaggcacgcatatgcatacataccctgtgcttagatacaggggcctaattaccaagacctcccctttgccttgagatggacttttcactagtgagactgattgaaagtaagaggggagccagggcgtggtggcgcacgcctttaatcccagcactcaggaggcagaggcaggcggatttctgagttcgaggccagcctggtctacaaagtgagctccaggacagccagggctatacagaggaaccctgtctccaaaaaccaaaaccaaaccaaaccaaaaacaaaacaaaaaaagaaagtaagacggggcaactctattgacacattctcggggagataatgtgtttgggcagtagaaaatggcaaagcagccttccaaataggtggctggccctcggttaggatcacttctagttagttcttgccctgctggctaggtagcaggaatccaaagaggctgggagttcttgaccttggagaggtgagggaaaaggcagcagtagtggccaggagaaagatgtaagggtgtggtaaatttggtgaaggtggagcaaggcttggactgacagagagaattgacagaaggatggatgccctctgggaagaataaagggagcgaatgctttcatgttggtatgctttcttatatattttccctccctgctggaagagactctgcctgggacagccagtgcagggtgcattagcaagcacctcggtgaccccagacatgtaaactcctgctagggtttagtttgctcggggcacttgtttgcctggtccctctttgtctaagcccagtcaggaattccagtttttattgggaagatcacacttgggtagagcccaggctgggtggggcagagctgtgctttgaggaaggctggcagcttcctaaaaggcccaaatgctgccccaaccctaacacaggcctcaggagcaaccagtggcccttagaaatgccaccctggtttcctcaaggattcactgttcagacaactagccaggcagggtcagggaatcaaatgtgccaacctctgggctgagtccaccgctacagctaggaaggccctttgttaggccctaatgttctaggaatcagatgaagagtgtaaatgcaagtgtgtttgcttaggagtctcttgggacactctggatctggtctagaggggggggtctccccaaattaggcgttggttggccaccatcagaggaacttggtcagtgttgatggccaatgggattctctctctctctctctctctctctctctctctctctctctctctctctctctcccctccctccctccctccctccctccctctccccagagttggtcttcctgctgagccctaggtggtaggtctgggaaaatccaaataagctggcacaggaagtcctgtccacctccatggtagcccaacagagcttatccctgggcacttggcctaaggatggacctccttaacagatccccaacatgtccctcaagaggggacatgtatattttgtggggtagcagtttttatgcccttcccggatatttctgaaggttcccattccgggctgactgacgctcaattccgtgtgtcctcaatccgtatccgtgtggtatggccccatttattttttttcagggagcaagtatcactagccagcacccacacaggctgggctccccatgattagacaaatggagaagtccactccgagaagatcctgacagcataaaatataatttgtgatctaaaagacagtttccagtataatctcattatgcaccacagactcccggtgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactattgggggggagggaggtgagtcaggttaggttgctaggggcagaacaggtaagaggctagctgagcttggggggcaatttacaactttcccggatagctttgccttgatttcaaaatgtgggaaaggggtcgagtttaggagaaagttataaaaaggtacagttgcagtgaaggccctgggtcttttaatgccaacggtaactataagggagaggggaggtttatagggttacgggggtcttcctgcacccttctcggcactcccaacccgaatttctattgttttgattctacggggccttcgctatggtgccagggacatcaaaatctaaagagagaaaggaagcgtggaggtggggggaacccttctctgttcccgccttgctccttcccctcccccctctacagcgagagaccttgtggtggaggtgaaggtgttagaggctaagtatcccctccaccttggagaggcctggtgggtccccacggatgggactgtgggcagttgtctcatcacgatggaagctaaggtcacaggctcagctggatggcaattgcctgggaagccgcagactccaggtggccgatgtcgaagtagaggaggatgggtggattggactggagtgggagagagtgtctgttggagcttcgggcctgcctagtgccagggtcagggggtcgctgctagaaattctggcatgctaggccagttccaagccaggccaggcaggagctggaaactcatctggctagccaaggctggaaagttttaaaaagagaaagaaagccacttgctggaggtctggctgggagccaggtcagctgtacagcatggccactcggagtgggggtggggtgaacggagggagtgtgcgctccttctgtccacctggaccctctccctcgtgatggctctgccaggtctatttcagaggtcctggttgagctgcagaggctggcaggggtgaccagatgtgtggtgcctgatccaggcctcactaggcaaaggtgaagattagtaaatctttgatttgagagctcctaaaggaaatgaaagcctgggctaggcctagagatgaggaggaagtggggagaggatctttaggccatatcctggttggggaaaggaaagtcttccagcttgcctcggtggttggcttttggtagggatgttggggtgcccaaaggggcctgatttagaagtcactttgctgatcttccatctggtccctagggtttctcttccatctggtccctagggtttcctcttggagcgttaggagatgtagacagatgtaggattcccttccagaggccctttgcttgatctagataatggattgcatgatgtgacaagtctagggtggccatctcaatcataggaccagtccagaagtcagcatttcccctgagaacagagagtccaggccacctactacttactgatgtttggccctccaagcagggcatctcattgtgagagatttgtagtatgtagtgggagattgtgaaatctccatttcagtgaccttagagattgcagtgatgtttaggggaaagtgggctctggcttcctactggatgaattacctaagtttcatgtgctggctcttgcagttgacacacaaagccttaagatgtcttctgcacttacctgaggtgaagacaatatgtgaaagtggggatttcaagtgacacaattaggccaataattggctcctctcctgcaactccaggactgagtttgaccatggcccatttttactagctgtgtgaccttgggggcaagttatttatggcctctgagcctctgtatgtttcttcatttgtatgactgggaataattatctacctttaggatcaaagacactgtttggcacatagtaggcccagagggttaataattgccctgaatgactggtcatgtttctataagttgctccttagctctgcagtgtcccagggaccaaggatgcatgcaggttagctgccccctccagggacattcctctggttgggcctataggggctcctctctttgtttagagttctttgccttatgcctttaagggattccatatgcaacgacttggatccccccccccccttaagtgggatcattatataggtcagaattgattccagaactggtatctaggtgccatttggcacgttttccagtcattatttcagaggaggggacagggctgctggagaggacctagctggaagaggtgcaggaatggctgctacagcagccagaggtgctgtggcgtgatagggattaggtccggatgttatgaaggctcactgtggttttcaataaagtcagccagagactgcttcttttatatcgatatgtatttaaaagaaattactagcacgagaagaaaaccagacctgtatggatccaggccggtagtaagctactgtgatcaggttccctcttcgactcccagaggggaagtcagcttttgattgaagctacacttggttcttgactctcaggggatgcctgctctgaaacaggagctcccccccttctttccctaaaagcctttgtgctgaaagagcttcagtaggcatgaatctctggtccctctgaagaaagccttgcggcctttgctgacgttggtttgtgaacagtggagcagtggattttaccaggccagcacccccccccacacctccaccccaccccctgatttagctcactagttagaggtagtatatgggcagggtgctcctgactggtggtggctgcagcgtggagcccagctgcctggaatctgaaggctctgtaacctttgaagggggccccctcatgagggggcagaggtgcggagctcgaggacccagggttgttttggagggtctgtttgttttctccagtctccgagaggctgagggtggagacggacggacgggcaagagtgtgttccagctttgagtctgatttaaaaaaaaaaaaaaacaaacttgatttaattggagaaactcctaggcatttcacagttctgtacaaatgcaaacttgaaatagcttgagacctacgtcatttttaggaaaggataaatgaagtacaaaagtgttcaaactatgtaaatccttggagttgtctgccctcccataaacacatgacaagtgccaaggcatttccagtcaaaacatccatggacccagcagtctccttcctttgtatttattattttattaacagcattttacacagcatttaacaagcccagactgcccgctttccacagtgcctgggtggaagatgggtgggggtgggggaaagtggtctacaaacccactagagatctcccgatggacaggcagtctatctctactggccagcaaggagccaaaagtagtactgaggagagagctcccttcctatcctaggagtgtttttgggcttctagaatgtgtctgctcccatagtctacgtggaaggtaaatcagggtctactcctggctactctgccccttggttattagtgatcttcaaagaatgagtatttgtctgtcgttattctatatcctggtggaaagtttctaacgaaaagtaatgcctttcttaagtcataaaatgagccttgtatgattatttaattaaaatctatttaaggaccgattaggcgtgtaatttgcgctaataatgacgattatggaaatgttcaacttaaccaaaaagcataaaggagacattttgatcagtggggcgaccagtaagtattcaatgagttgggcaatttctgaaagaccagaggcggacctctgtggccctgcacagaactgcagacatgtccagcctctgtgacaacctcggggggctgcaggcctctctatcacagccccagcctacccactttgtccagtggccaagtagcgtgagcagccatctcttcccatccagcgcctccagactctaccagaggcacaaactctgggagagggctgataaaccacagcgaaatcactgcgaaatggcggtgctcttgggcttaacaaactgcaccgagaaacgcacgcttccttggctggccttggatagagcccggaggggtggggtgtgggggggagccagggtcccttgttccggagaaagctgccagctgctggtcttggtgcgaaggcgaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagccgcgctgcgcctcctcagcactcacacaaagcgcgcactatgcaggcaggccccgtggaggagctgcagaggtggccaccactttgtggctggcgctttcggatgagagaaagctgggtcacatcccgtcaccagtcacatccccagcatgcaccttaaggactgcccaaagggtggggtaggggtgtgggagggtttatatgttgtggttgagggatcttgttagaccgaggtgtcaggagaaggcctggggaaggtgggggtggggcccggagtgtcactgtctagaggggtttggccaagatccatgaacctgggtcctcagctgcttgcggcagagtttgcaagattcgggaaaacaaccagcagccccaaataaagcttgtcgggaagaattaagtgaaggccttctggggatcccgcaggctctgaaggctgttcttcctttgcaatggctctattcagataagttagagagaggcgcggctgtgttctggccactgttcttcagggtggaaatgcaagtgtgtgggttcaggatccaaaggcgtttgcattttccgggaaaggggtgcaggttgacttggagccacacggtctcataagctccccctggcagagcacaccggccttcagctacagcctccaaaggcctggtagaagaggcaccacccgctgggcactagggtgctgtgataggagagcaggagaaaggtgatggtgaggaccagcactctgtccaatcctggtgatgcatcgcataggatgcatagatatagtctagaacttgggtcagtctcttgggtggcctggggcaagctgggaggaaagggtcaccccaactcctcaggagtcccgaggtcgaaaggagccttcccaggatatagaaaggctgttcccgggctatggaaaaccttttcaggctgacttaattctacagcctccttctgggttactttggcccttgtgtggccagccgacaggctgtctgagtctagaaactccccaccccccaggtaggacttctttctacatattcccctcggggagctgggagatgcttctggagtgatacatgaacttcggtgccagttctataaattggtctctttttatgacgtgtgccattttctgtaggaatgttgcttgcaaaacgagtttcgccttggaggaaaggcggaaagataaacaagcctgtaacgccaaaacactggcagtctttccttccttccagctcccttaaagcagccgggctgtatttccaggattagactcatgcttgtaaggagggactctgttggctttttttccccccaagcaaatgcaaattagagaaaaataattttctttcaacgatatgcaatgtattagtcacttggtatcgtgctctcaggcaggcctcatttgcgcgtctgccagctcgctcacatctgcttggcgctgttggggcattttaaccttggcggtgtcgtgtctagtcccatggatcaagaaagagtaattaagctctgaacagccacaaaaattcgtgggtccccatctatatggctttgttttggggtgctttgagttccaaggctgagtagcagacctggaattcttattgttccttgtaaagaccatgaatctggctctcctgcccatcccagccccccagccttcccaggacgtccaggctctgcacagtctacaagaagcgtgcatgcagatttcaggacccttgcatgttgcgccttacttccttaaaaagtttctttgtgtttcctaaggatagccttttgtataacttgttactttctgtagcaaatgtgtttagtttatacaaagccttagtggaaactaagtactccactacttagccgagtactactacggccttgattgacatgggccatttatttaggattcctctctaggttgtgtggattccccagtgggggacagaactctgttaggctggatcaagtgttaggtgggggcggggcggggcggggcggggtggtggtggagggggatgggatgtgaaaaggagtgctggctttcttcctaagttctgggtgctggtgctgggtccacctccttttcaaggacctcttgcttccaaattcaccccagtgcgctttggatgcagatatagttcactgactagtttatctggcgcagcctgaggtaatcggaaagaacaaaaggcagggaagggagtctctggccattcctgtagaagggagggggaaatagccatccctgtccttgggttgggagcggtggtaaatctgatccccatagctgggattctgcctcgggtagaggatggatgcccagcaacccacttttagtagactcttggggtctgccctacccagggctccgtgcctgtcctattttacagtataccaccacactcagctctcagcttaggggagagtccagaggtacagtctgaccgaaggaagctcaaagtgaaggtagggtttgcagtcctaactctaccggtaagctcgggagcatgtcccttgagggctcaaattccgcctgaacccactcaaaagtttatttttgtttgaaatttgatgatgaagaccaaaggagtagtgaaggctcccgcagcggaactctggaagttcccgtgagaacgcagggttccaggggttaactagggtctttggggagggtggctgcccaaggggagaactggcagtttctggaaggcctgagggggtttctggccaggtctgctacctctccctgctgggaccttggcagggagctgtaaggaggggcagaaggggctagtgagctctgagcagggagcgagtgctgggaaagacaatccctttgttgcagactcctcacatcaggctctgcagaggcatggagagggggccgcccctcctcctttctccctccgctgccactgagggtcaagtttattccctatcccgatggctctctgccgtgaccctggagcttcaggaagaaactagaaaggttctgtatgctgggaaggtcaggtctgtgtgagcatggccatcgtccgtctcctccgcgcctgctccctgactttagtcttttactaatgtaaaatttggggttgtgggtggcgacacccacagagccagtggttgtggtttggagtgtgcacctgggcagcctggctcacacacctctaaccccacacctcagatagatgctaaatggctcaggacctgggagcaatttgagggtcccttgctcatctgggaaagcagcccaggaggacccgccctgcattgcatatccgggaaagcattttcttttcatttcccacccccacataggccctccccccaacattctaaaataggaacgtctttcccctcccttccttgacacccagagcgtggtgctgctgtgactcagtctgcttttggagcaaccccaggaagggctggcgctagctttgggcttgggtgaaatccacatcagttgtgttttccccctcctggtctggcccctctgtatctccctcgtcagctccccacccatgatagataggagaccgcatcaccattctgaacagcgtgtttagtggagtcagatgctgttggatggggttaacgggctccagcgattgccaggcaaaactcaagtccagagtgcagccaaagtctctagaaaacacagggccaaatatttacagagggggaccaaggttggagagattcagccacctgcccagggacacagggtgggtgagggtgagagccaaagagaatggacactgactgggaccaggctacccatgtgccacctaagcttcctattgtgggtgcagtgctacagatggacctgttcaatctttggctgctgcccacataactgcccgtagggtggtggccagaagggcctagggaaagaacttaatcccaaagaagggactgccagtgtttgagaggtttcatctcttcctagtctctggaagcaatatttttcctattgtgggtgcaggggtcaccggtggcagtggaagatgatctgccactatggggtggcagtggggacaacagacagttgagcctagtgttgctactgccttcactgcctcctccccgttgtctgcagggggagatcttaaatgtccttaaagaagaaacaagtaagtgggctgcggtggcatatgactttaagcccagcagagacacatccatctcttgagttccaggctagccacgacagaaagaccttgccttttagaaaaggaaagagtatgctcttctgcatctctatgtgctgtcttggcagggatcgactaaacggtgttagtaggtacaccttgggggtcacctgatgtcttttcagaacatgaagcaattgggctcctttttagagatgcctgggttggagggacagcacctaatcttggtcctgctcaaaccaagcatgggtactctagccactctttggctcaggagcaaatgattgttcaccaagtctgttcaggtgagtcctccggctctccgttaaacacagtaagttctaaggactgcagccacataccaatgcatgcttgccacatagaggttcccccagacctcggttccagcaggcagatactgcacttagcaatcgacctgttccgtaagactcagacagccatccctgcctggctcacctctgagccaccttttctttgcgtttcctttcttatccttggttttctctccatggctggcagaaagggttaaaatccagagcaaggttaaagctagcaccttgccctcagaacaggccggtgcttgcttgtaaagtgctttctcatgagtgatgtcccacattttggcacttctagaggcaaacatagcctgcatgtggaagaaggggcaaagaatgagcctcttccttatatatagcagccaagtgccttgaggcactccgtattccagccaccatttcccacagccaagggtcagcaaagtcacctctttgctttagaggtagagaaaaagtcccggctacttcactaggactttctagaaactggaagggctgagatgttcttctcttctgctgcttggtctctctttgttttttcacccagaggtttgggggtgggtactccctgctcctccatggttgagtggcaacaggacatttctcctgagtgtatttctgctgggctcttggacttcccttgtttgtcaccctagagaagggccggcctcctgcctagcaaggcccacagtcatcgaccctttctattttgatcacttgctctttagccaggcacctgaagagttaaaagtccttagcttgttgcaatgaaattatggctggcggtggcgccactgttcgttcaacagacctccacttttaagcagttcaaaaaaagttcacagggcagctaaagattttaagtgtgggttcacgagcgtgcacaagcactcgtgcacaagtgtgtgcagtccacagtgcaactcctggcttagcctactctccgaaaccatacacacaggagaatgaactgcactccaggccttaactctcagtctgtccctgtgtctgtgacacttcattctgatggctagtgttatttatctgtgacaatgctattgaaaaaaatgatgagtggaccccagagaggggttaaagtttcagttctccatgccgtcccaggtccctcacagtcccggtggcattttctgggcggggggtggggggaaggactgaagataccactgggctttcatggggaagaggtcaggccttccctaagctgattctgattgtccttgagggtccctgatgtactcttcccaaggtggccaactatgtaggaggtggctgggtttcaagactgaggaactggggccatggagatttgacttttctcaggcccgttcttctgaccctttttcctggggggattaattgtggagccctgctgtccccagtaggatttctatacttccccagggctctatgagggtgtgatctggtccctcctgcggcttgctgtccaggacccctgtgccaaggaacagcgctctacttgctcagtctgcctgcaatgtcttccctttgttgtgagagtgggcaggagatgcccactcaggaaagggacacttgatgaagtgggtcttgaatctttccagtcccggtgacttgacattccttgcttattttgtacatcaaaaaggggggagggacacagtgaacagctcccacacagtcttccccggtaccccagtctgtcgctccatgcaccgtggctaggccatttggagtttccctgtctgaagaaagagagacccttcccaggaaaccagcttcaccaaagtccattcccatgatgccttcaggaattccagcctcttcagggccctcccctccctgcttcattgttgagctctaactgtgcgtggtgtgttggtgcgtgttgttctatggttgggggccggtgggggttgctggtggacaaaaggcctacttaggacaaagaaaggagcatagctgagcttctggattcaggcctcccaagcctttcccacccccaccccagtccctggcagaagagtccctggacggggtgcctccacccaaccgacctggcagtctgcttctcgtgtgctaaagtgtaaaagcaagcatttgcatattttctcctgctaacaaaggaaatgtgtcgacttaagggaacatttgggctttcggaaactgtgtgggtgggtgtgtgagggaggagaaagaaaagttcccctgatgatctatctgcacaccaattatttcacactcggatttgggtcccgtggaaaaatgccgtggcctgtcctggagaagggaaactgagatgtgtttgtgagcagggaattgcccagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcggcgtgataatcctgttaataaactgcagcttgtcctgacccttcactcatgcagcaaactagaatgtgctgtgggtaggggcggtgggctgagaaggtaagtgggggaggtggtctgggccccttcgcaccctcccttccgcagcctccccctcccacgaggtggaaaatgggtggcttttgcctgttccctgtgtgccagcagctcggagcccatcagcgtcagccctggctgcagagacttatgcgctaatgatttcttgtccccagcgagcaggcagtcattgaattactcagccgcctccccctgcagctcccaggcaaaaccacccctgttaggtgcttaatctaatccagggctccagtagagaggttcaccagcccactggtctctctctttcaccctccagctttcgggttgggcacaggacagcttggaaattcagccgtcccaaacctgctgtcgccaccacctcactgtttctgcctctaccaccccaagagagatgaatgtgccagtgatctagcaacctgtgtctttctggtccctcctcaaatatggcttctttctctggcaaaagggtgggcaggcccagacctgtgactaggatgggtgtcttcctgtttgttagcttgagtctggtctcctccgtcgccgtgggacaggtgtgttcttggttcatggacattggtggacagcgtcaggcacaggctacgtcgtgtatgaattaccttgaaagaggctttgctttctcagtgcctctctcctttacctaacctcacggggccctcccccctttctttttttaaacagactagacgcttgaagccaagctgccatccaaggggcgacatgctttctgcaacccctctgtatgggaacgttcacagctggatgaacagcgagagggtccgcatgtgtggaacaagtgaagacaggtgaatagtctccagggccaggcctggtgagggagaacgggcgggtcttctcctccacactcctgagcagagcccatgcatacccaagcccccctcatctcctcacagccagagaggggcccaaaaggtctggacaagagagatctcctagctggtggcccttgatttacagttttaacaggcagcctggttcagcgaagcattgccgccctttaaaagattagcccctaaagcggcctttcagtgcgctttcgtccttaatttattatttcatatttatgaaggagaattaatccccatctatatgctgctttaactctaaatgtcaggagtgtgggcccaggtggatcggcattcaatgtgcttttaaaacaaatagtttgcttagtaataaatgaggaggtggctaccctttccttgggtccaacccaaggtttcaggttgccctatgctgcccttctgtgttgttattggccaggattctgatcactggacagcccagttaggctttcttctaatccatgatgttggactggggccgagacaactgaacaggaggtgatggaagcagctttggggtactggtgaatctctgcctctgctgctcatcagtgctgttatcctgaggatttggaagttggcgtggaacactttctttatcaatgctctctgataacaagtcccaggacagccaacagcagcctggcacagatgtgcggcttcctctcctgcctgaagtagctgacatgtctctgatactattgtacatccccacacagctccacattgttttgataaaggctgcaaatataacttcaccatcaccatggaaactagatgggtccctaactttgtttgggggaaagaaagttttgaaagcctaccctcagggttaatgcagatgtggataaatgaaggggctagcctgtagacttctagcctgcttggtccatggccattttatttaatttctgccctccagaacagctcgtaagggttagctaagacagcacttggcctctgtagaaaaggtcacgtgagagaagtgtgcttaatttctggcttgcccacctctgggacatatgtgttattcatgtccccacacatgaaaggcctgcctttgctttgttctgccagggtaatattgaatcaccatttgggagcaactttcactataggtcatggcagggagggttaagacagttcaaaaaaaatgaatgagattagtagaaactggtctggtccggggagatagatgaaagatatattcagcaagaaatgttttcatgaaattggtgtgtctttttaaataggaaaattcctgtgaatgatggcgacgcttcaaaagccaggctggagctgagggaggagactcccctgagtcacagcgtggtaagggatggatggtctctcttgatagggtggctctcagtgatttgtaatcaactatgcattagtttgtgtgtaattagggagtgtgtgtgtgagtgtctgtctgtgtgtgtgtgtgtgtgtgtatttgcttgcgcgcacgtgctcactcatgcacacaatgtgaggagggggaggcatcagggcctggctatgtattgtttttaatatactctgccctcacaagccctcgttccttggtcacgtggaagcatgggtcttctataaccatctatcccgttaatgctccaagctgtataattctctagcctccaagtagttcctagggctttgctttgccagtaaaatatgaaacactggactgtcctttaaggcaccagggaaaggaagtcaaaaatgcaaccatactttgaccacgccccctccaagcccctttattgatttagaactaagacaagctagaaagttcctcatatccattgtccggaggaaaactgtttcttgtcctgttcaataagacctttctgtgtccaagaaatgaatgcccctctccccagtccaacctgacaggttccacagagtcagtgtgtgtcctgtaccccggaggagtggtgcagagaatgtcttatttggtgttgtctgtgccacagcatggtagggtttgctcacagatgagcaaactaatgacttggtttctagtctgagtggatctttcagtgcttgtaggatctcagttgaacagaaatgacaaaaaatgaggcttcaaaaggatttgcatgtgggaggaggcggggcactgggcacagcaaagctatctttagccttttctgttggggtgttaagggtgatgtcatgtgacccagtgggtggtctttcttctggaccagggctgctactgtgacaggtgtcccaagtaacttgtgttattcttttacaaaggtggataccagtggagcccatcggatcgatggcctggcagcactgagcatggaccgcacaggcctcatccgggaagggctccgggtccctggaaacatcgtttattctggcttgtgtggattgggctcagaaaaaggtcgggaggctaccccaagctctctcagtggccttgggttttcttcggaaagaaatccagagatgcaattcaaaccgaatactcccgagacagtggaggcttctgctgtctctggaaaacccccaaatggcttcagtgctatatacaaaacaccgcctgggatacaaaagagcgctgtagctacagcggaaagcttgggtttggataggcctgccagtgacaaacagagccctctcaacatcaatggtgctagttacctgcggctgccctgggtcaacccttacatggagggggccactccagccatataccctttcctcgactcgccaaataagtattcactgaatatgtacaaggccttgctacctcagcagtcctacggcttggcccagccactgtattctcctgtctgcaccagtggggaacgcttcctctacctgccacccccacactatgtcaaccctcacatcccctcctccttggcttcacccatgaggctctccacaccttcagcctctgcggccattccacctctcgtccactgctcagacaaaagcctcccatggaagatgggcgtcaaccctgggaacccagtagattcccacagttacccccacatccaaaacagtaaacagccccgggtgacctctgccaaggcagtcaatagtggcctgccaggggacacagctctcctgttgcctccttcacctcggccctcagcccgggtccaccttccaactcagcccgctgcagagacctactccgagttccacaagcactatcccaggatctccacctctccctcagtcaccctgacgaagccatacatgacagccaatagcgagttctctacatccaggctgtccaatggcaagtaccccaaggctctagatgggggcgactgtgctcaatccatgcctgggcacacccggaagacaacggttcaagacagaaaagatgggggctcaccacctctgttggaaaagcagaccgttaccaaagatgtcacagacaaaccacttgacctgtcttctaaagtggtggatgcggacgcttccaaaggtgaccacatgaaaaagatggctcccacagtcctggttcacagtcgggctgcaagtggcttagtgctctctggaagtgagattccgaaagaaacactatctcctccaggaaatggatgttctatctatagatcagagatcatcagcactgctccctcatcctgggtggtgccagggccaagtcctaatgaagagaacaatggcaaaagtctgtcactgaaaaacaaggctttggactgggcaataccgcaacagcggagttcctcgtgtccccgcatgggtggcacagatgccgtggtcactaatgtttcagggtccgtgtccagctcaggacgcccagcctctgcatcaccagcccccaacgccaacgccaatgcagatggcaccaagaccagcaggagctcggtggataccacgccatcagtcatccagcatgtgggccagccctcatccacgcctgccaagcacggtggcagcaccagcagcaagggagccaaagccaacccagaaccgagcttcaaagcgagtgagaatggcctcccgccaacctcaatatttctatctccaaatgaagcattcaggtccccagcaattccctaccctaggagttacctcccttacgcagcaccagaaggcatcgctctaagtcccctctctttacatggcaaaggacctgtgtatcctcacccagttttgttacccaatggcagtctgtttcctgggcaccttgccccaaagcctggcctgccttacgggctgcatacgagcaggccagaatttgtgacctaccaagatgccctgggcctgggcatggtccatcccatgttgatcccacacacgcccattgagatcacaaaagaggagaagccggagagacgctcccgctcccatgagagagcccgttatgaggacccaaccctccgtagccggttttctgagatgttggaagctagcagcaccaaactgcatccagaagtccccactgacaagaacctgaagccaaactctagctggaatcaagggaagactggggtcaaaagcgacaaactggtctacgtagaccttctccgagaagaagcagacactaaaactgatgcaggggcacccaaagcaggccttgtagccgagaatgtaggtcaggacaccgaggccaccaagccctcagctgaccctgtgatccaacaacgccgtgaattcatctccctcagagaggagctgggccgaatcactgacttccatgaatctttcactttcaaacaggcctcaagccagccagtgttcagcttaggcaaggatagtggtgcagcaggaaccaacaaagagaacctgggtgtgcaggtagcaactccattcttggagacagctctgggcagtgagggccctgctgtgacttttggtaaaacccaagaggatcccaaaccattttgtgtgggcggtgcccctccaaacatggatgtcacccccgcctataccaaagaaggaactgatgaggccgaatccaacgatggcaaagttctgaaacccaagccatccaagctggcaaagagaattgctaactcggcaggttatgtgggcgaccgattcaagtgtgtcaccaccgaactgtatgcagattccagtcagctcagccgagagcagcgggcattgcaggtgagccccccaacccgaatttcactaactttatcagttgtcagtttttgtaatgtacaaaggggatttgggggaacgtggtaggccagagcaccaggcagatttggttaatgacacttatgataattggaatgtatgaaatgtgttcaataaggggacggcagtagtagcttttaggaggttcatgtgtcagatactttaagctattctgtagactatatgagaactctactggaatgctgataacaagttgtaattattatgaaggatgtctaaagactgcatgacgtttacctagcaattgctttgatgtctctgcctgtaagataacaaatataactagaagcattgcttagaataccttacttgatacttggtggagatgtgtagcagtcgcatgtctgtgggaatcgtgcaatttttttcaccaaaaagaaagaacattcgtttaaagggatagagtatgtatttgatttgctagtgaattatgatagatgttgtataggaatttccttaagatattttacttttaattaaaagatgaataaagccaaattgttttgcaattgttaagaaaaaaattggtttatgctgataaaaatggatgaagttatctaaatgatccattgagtgcccattttaattacatagatggaaggattacaagaggacagtattttatgtctacccgctgcttactgtgaggtcagttcttcaaatttttattactagaatcttccataaaccttttgagttaaatttcatttccaaatatacaaagggaagtttgtgggccatggtcgtctttgttcattgtacattttgtttcttttctgttgtgttttccttttgtttttctttgcactgtggctttattttattttatttataaccttcaaaagagaatgtctgtctctatgcaatcgtgtatgtatggctatacatacacattgcgtctatatctctatacacacgactttatggataaagaatgtgtgactactcacatatagacactcttaaattttatctgttaaactttaaaatatctgagttgtatctcataaattgtggttggctttgggcaagcttttctctgaaaacactttcctttatagtataaggcacatgaaatagcctttatggtaagatgttgtgtttttttttccatcttcgttttctttctagcgtgcaatgatgcgcttctcagagttggagatgaaagagagagaaggtagccacccagcaaccaaagactccgaggtgtgcaaattcagcccagccgactgggaaaggttgaaaggaaatcaggaaaagaagccaaagtcagtcaccctggaagaggccattgccgaccagaatgacagtgagagatgtaagtaacccgagcagctgggctgtagcatcacattggtgagagcagagccaccctgcttccaaggcctgagatggtgagaggaagagggatttgtggataatggctcaaggtccagttggggactgctctgagaaagaggctgctgtgtggcccttactgtagtgatgtctgcttacatgcagctgggaatctggtgtctatgagatttttttctaggacttggtcttcatttgcaaaggaacaccaggctcaaagtgaatgacagcccaatacaatgtagcagtagaaagcaggtggtaaggatcagttctttttttttttcttttgaagcagctagaatgatactctttagccttgcacctctcccacatggcagtctacgctggaatgggaaaagtacttaggtttttttctatctaggtttttttgaggtgggatgaaggttggtcaaagcaccagaaagatggcaacaggtattagctgagtttgttgtcattggaagttatcaatagaacccaagaatggggtatgggaccagcctacaagacagatagatggtggtttatggtctcgggtaaatgtgggaaaaggtaagcaagcgccttttgggggatctttcagtctaaacgatgggttccctgttgggctgggcttttggagagttttaagggtgtttgctgtgacacttcgtgaaggtctttaggttcctcgaatgtctatgcttaaggtttgaggcctgctctggccttcagaaaccttgctagggaaggcgaattaggatgtcaggggaaacatggaggagagttgttgcagaagcctcctagacaagccagtcagtggcattgggtgcttgagagccctctattgttgcccttgaaggtgtaacacacctggcacagttcttggtgcgccgtctttccttcactacctccagttcatctttaaggtccagaaaacgctctggctggcctgcagcaacagtcagacccaagaagatttgctgtgagctagtcctaaagaaaaaggtagtttttatagcaagcaagtgacgcccttgcccaagggactcaaacggtctctgtcaaaagatgtgtacgtgactgctcttgggccaagtggcaaaggtactccgagtgagcacagagcaatagaatcgccagtgctttgtgaggtgcttggcgaggaaggcagctgcgaagtaggcaaggtgtttccagaagggaggagctagctgcaagtgggagtcccctttgttctgagtgaacgctgagagatgccataagagggtgagaggttggatggcttccagcctttggcctttttttttttttttttttaaagttttcaagtaatggagccaggccccaagtggccactgccctcagataagaatctgtgaggcctcccacctacctgcctgggaggtccacctcctccccacttgttctgcttttggagtggcttgaggggcccctccaaggctcagacagtgggctatttggggggtaccagaacagggctcccgccacttgtaagagccagaaattaccatcaagtgctttggaggttatgtgtaaaaggcttgcttttcaagaaggaaaaatgttactatccccatacttgcctgcctttacaactcatagatgtgacgggagaggggcttggtgggggggaaatcacggctacaagagccaagcttaggagaactagggtagggatttggagtagaggggacaggattctaaactctacctatttctttatgttgttgttgttgtttggttttgggggggttgtttgttttggggtttttttttgtttttgtttttttgttttttgttttggtgggaatggagtaacacaaatcttaccaggtagctcaggctggccttagtcctcctgccacacccttttggatgctggggttataggcatgtactgtctctgctcccttccccttctgagggagcccctctgctctgagatggtgggggcatcttgttgggagggggcatggtcaggattttcatttgccctctttggctgaatgatggtagaagttgcttgaatgagttcagtgcttcccttcacacctgacagtgcatgggaaggacttcgccaggacattttagagatgtggaagggcaaggaagcattaacttggtctttgctgaacatgagctactttaccagtctcttgggtggggtagacctggaacctgctaaaggagagtctgagcaggaactggagggaacttgagtcaaggggctttgtgggaatgtctcatctggggagtttttcccccaggacagcaccagcatcccttatgaactagagagatgccttggcactgatcacctactctgctcagctgtgggtgacagagctagctacctgcagaggggaatgacatctaggatgaccctcagaagtcttgtttagggctcactgggcatggctgccacagtgatgaagttgctttgttgccatggtgatttgtaaatgttgccatggcgatgcttctacaaggtatagtatggcagcacagtcatgataaattatgggatatatgtgctgcaagtcatatgaccatgctatagggagcagatgtcaaacagccacacccacatccgcctacatggcttgacctagaggccaacagtaagagtagtggtaggtagtagagcctggtggttagggcctctgttgcttgttctcttttagcctatcttttttttgctctaagggtaatcttgctggtagtggttggactggccccatttgcagaggtccaagtgaaaaagtatttgggaatgatgcggagcatcctatcgctgatggcagtaggggtatgtttgcttcaagattgttattagttcctggaagaccaccctagtgcaggcctttgggggcttctctgaagggaatgagaatcgttgccctaagaggcttggagaaaggatgcacagaggtttctaagggtttgaagaatggaggagaagctggctatgttgatggtgtgtggactaatgtgaatctcagatttattagtgagactgcttgatggtaattgggatgtagagagaacaataggccctgctgtggagtttcctcaggatgaggtagagagggacttgccatacagcaattcacagtccccgagggtcaggaatacagtggccagatggatgcggaatgatgagttgaaggagccagcctccctgtcaaggaggcgtggatggtaacggggtggcgggggcacccactgtgtgcaggtttgctcaaatgggaaaatcccagaaagggatgagctagccaagcctttagggatgctcttgtcatgtaaggaactgaggcaggcccctctcagctgatgccagcccatgcagcagtcttccgggtggttttaccagggcactttgtgcataaggtcaactgatttgagataagcttcattccactgttgtgagttgacagtgaggctgaaagtgtttcgctctccaagaaagatagcttagacagtgatgcaggcgcctcctcgaaatccggagttcaactgttaagactaggaagtgaatgtaaaatactcagggcagagagagtcttagcgattgattggcgggggaggggggtgatgatggaacaggataagacagggcagtgggatctgggagcggccccccactgaacatgctgctgtctgatagtgattgattccacctataggcagttatgacattacccagttacctccccttcacatcacctacaaaagggagaggtgaacgaggtacacattaagattctggggtaaatttgagctggtttaaggatcctgcataaataatttctctggcccttcccttttccctgagcagccagggttgaggaaggaagaggagaggcagctggtcatcatgttcccactttatagcccagcgcggccaagttgtaaagtggtgtactgttagtggcagagcagttaagagggtcacagagtggctagcacaagtgataccccggccatgctgagtgcagtggtctttgacagtctgcatgccttcactggttgccgtcaagccttagggctggacactgacattgccgaagacccacttggaccatgtccttgagttataaagtactcagagaactgcagtgacatggcatacaagggatccagccgctggctgttctgtctctgccaccatgaggagggggagcggttggggacatgtagccattccttagctcagattggatccagtcccacgttccctaaggtgctgctcacccgcacctgacagccactcaatgctggattgcccttgagagaagtcgatgatgcatgagcagagctggtcggaagtaggggtggaatttcaaatgtattgagctcatcctatgaggtgaacgtttatttcaccggcaaaatgactcctgcggtgctaccaaaatgccagacccacatcctcaggagaccgccacccccggggaacctgtggggtcatgttagtgatctatgggcaagcactgagccttatggtggttgctacatagtgggttttgttgttgttgtttaggggatttattttctctgtgtgaacacatgtgtcacaatatgtatgtgtaggctagacgacaattcttccaccatgtaggtctccaggagtggagcccacttccccggcttacctttacccactgaggcagctcactggttcctgtagtgtttatattttgttggatattgggaaaactgccaccccagagcaagttgtgggctagttcctggttacaacaatttggaagtggtgtagggctatggtggctcagggagagggtaggtgccataggtgtctactggtcctcttgtcccttggtctgctacagagaactgaaggagccctggggagctggagccaacagtttatgcttgcctggctacaaaagtctgtgaaggtggtgaggtcttgtctatagatgtttgcatgacagaaagagcacaggttaggtgacctgagtccccgtggggacccctattttggacattaaatggaagcagcagcttgattcagtgataggtatttctgtgggcagccatcagattgagccctttgaagttgtagcatccttgcccttggctctgcttggtcctcttctcccagcagccctggctctgcagggttctttgccccctcgtgcccatccaggtcctgggcttctttcaacactctcccatccacattcctcagttttcatcatcttttgtctattcaagtaaacatagatgtcgccccttggggatatgacattttggggatatttcatcttttactacaatcctctgtgtctccaaatcatgacctaagagatgcttccccaaagattttttagtttaagcagacttggttgagactaggttggggtagctcagccctttctgagttcccctggctcccaactacaaaaaggttagcaagacaaagtgcgtagcttgctgacttgttttggcatgccctttctctggaaagttctggttatcctgcttccatgttcccaatgggcgaggatctctgtctcccaagacctgtgaggtgttcatcaccatggccttggccaaggctagcctgcctacgccccatagcccgcctccatgtagggagctagatcctgatttctgaatttttttttttttgtctgttctcacaggtgagtatagcactggaaacaaacatgatctctttgaagccccagaggacaaagatcttcctgtggaaaagtatttcttggagaggccacctgtgagtgagccacccagtgaccagggggtggtggacacgccacacagccccaccctccggctagacaggaaacgcaaactgtcaggtgacagcacccacactgagaccgctgtggaagagctagctgaggaccctctgaaagccaagcgaagacggatctccaaaggtgagtgtggtcagctcccactgcctgcttgggaggcctttgcatgcagccgcagagggcgcaattgagtgtgcttgtgtggggtcacagtggggttattgcagcacctctccccctccttccatagacagcttgccactcccacaacgcctcccgaagccctggggaggcggcacccacctcccctccctccaaacccagaggcggccaaagaaaaataaagtgacctgccaagcagagacagtggccacacccttcccctcccccaccccattggtgctatgtaagacaggtttttttcctccccatggggctttttgattaatttgtagttatttctccattagatgactggcctgagagggaaatgacaaacagttcctctaaccacttagaagacccacattgtaatgagctgaccaacctgaaggtgtgcattgaattaacagggctccatcctaaaaagcaacgccacttgctgcaccttagagaacggtgggagcagcaggtgtcggcagccgagagcaaacctggccggcaaagcaggaaggaagtggcccaggctgttcagcctgaggtcacctcccaggggactaacatcactgaagagaagcctggcaggaaaaaggcagaggccaaaggcaacagaggctggtctgaagagtcgctcaaatcctgtgacaatgagcaaggtatgcagagaccacctcttggctactcactgtgcttctagaggataggtcatgcattccatgggaacacggggacttgggccatccaaggttgtggctttttagtgatgtcctcgaacacccccattgcccgtctttccactttcctcctgatttcccagtatatggctgggcaggaagggaaggctgggtggccccacaaccttgccaacgaaccttccaggctcccgctgcctcagtcatcaggatttgtgagcacctgagcccagtgggtgggggagagcaggaagaaccagtttctgtcctcttgtcctggccctttgaagaaagttaccacttggcattttgagggttaacctatttgccatttgaatgtgggataattaaaatattaatgctttgaaaacataattgttatatctttaaaaactgaagccgctccagtgatcagtgctaacaatgggcttttctttctgcatcggctacaactgtgtaacgcctgcttcttctgcccctcccccgcccggcaccgccccctccccctccgtatttaggcttgcctgtgctctcaggctctccgcccatgaagagcctttcatccaccaatgcaagtggcaaaaagcagactcagccaagctgcacgccagcctcaaggctgcctgccaaacagcagaaaattaaagaaagccagaagacagatgtgctgtgcacaggggaagacgaggattgccaggctgcctccccgctgcaaaaatacacagacaacatcgagaagccatccgggaagagactgtgcaaaaccaagcacttgatacctcaggagtccaggaggagcttgcagatcacaggcgactactatgtggagaacactgacactaaggtaccttctgccctgctccccaccttgtgcctgcttcttatgaaggaagctcccatcttcctggactgcactcccttgccaccgctcctgtcttagaggggcatgtgcactgggtggccatgaagtttcaaattagtaagagtgaaaccccaccccacccctcctctgaccgaccatccccccccccccaaaaaaaagacaagtgtctttctctgtgggtttatcacttgaagaggaaagggagaagaagcaatgggggtgttaaagggtcacagtcttacctgtgcatactgcttactctcgtgacagatgactgtgcggagattcagaaaacgacctgagcccagttcggactacgatttgtcaccaccagccaagcaggagccaaagccctttgaccgtctacaacaattgctaccggccacccaggccacccagctgccacgctcaaattctcctcaagagaccacccagtctcgccccatgccgccagaagctcggagacttattgtcaataagaatgctggcgagaccctcctgcagcgggctgcccggctaggctatgaggtgagtgtatacttgtgggtactgggaatccgaagcatccagctgctgctgctgcaggctgggtgcaggagcttcagggagggccttggagagcggagcccagcccctctacatcaggaggtgttccaaggcccagcaggatgtttgtatcatacccactctggctgttggctctttgtttttttggtttttggggtttttgtttgttttgttttgttttgtttttttcgagacagggtttctctgtgcagccctggctgtcctggaactcactttgtagaccaggctgaccttgaactcagaaatcctccgcctgcctctgcctcccaagtattgggattaaaggcatgcgccaccactgttggctctttggtagctaggtctgtcagggtagaaaaaccaaagcaagcctcagatgttctgttcctgttcaggcaggtaagccagccatgccacgcttgctcccttagctctgaaagaaagtctgacataacccaggacttggcaactgaggtaaattgtaatgatttcttttggtttgtgattaaaaggggtgtagagaagctatcagctctatttagggtggcttatgctattgctggtagaaaggtggtcttgaggagtcggaagtgactgtggggatggttggtgtggacccactgctgttggggaagcagccctgactggaatgacatctgagagagggaggcaacctgaggggctctgccccaaactcattgctgccaactggacctgtgccctcagtgttggcccgcctgagtgtgctcccaagcctgcatgatccacagtaatccattttccctctcatcttctttgggcttgcaactgctgttctctgcactttcggttgacaaaagttgcagggggactacagatcttggaaagatactgaccctgaacagtgacggcaaagcccagccctgtcccatcaccaccttccccagctcttcttggttggactcttcgctccaaaggctccagggggacccttcctgcagttcagaaccccctagagctaacctcctatttctgcccctgtatgcccgccacgcccacttaccaattgaaattgtggtgcaataggccacggggcaaaggcctttcttcttctttttttaatgctgacatcagccccctgggagttggatggtcagaatgaaatgcagttcagcaagctgtgtgtggaggtgtgaaggaaaagggtgaataccctggcccacctttggctagggccagcaggatttagccggcaccctgacatcctttcattctgataaccattgtacttcgaggtgggatcgcctagccctacaataaccagtgacggaaatcccagcctgggaattgtagctttgtaggtgggaacttgagggaaggatggtccttgggtgcacttgtgtttctggttgtgtgtgctgttgtttgcattaatacatctgtgttttatatctcaggactagctcagagatagctagaaggaaagattggttatcagctcagttactgtggtttaagtgcaagtggccgttggttgtttaaccgcaagcagagagagagagcatcaccacctaggacaagggtgaggcttcgtgctctgcatcgatttcctttcaaggagcttcaccagtgctccacttgggcttctggcaagctcaccaaaggagccggtgagggaatgagggctccctcaagggcagcgggcttctttgctcatagagaaacaaggcttctttcttagccctttgatctcggcatcatttccaaaggtcttacacctttgcaaagagaaatggcgaggctcaagagacccttgtggcttctctaaggaatagttgttatgcagccggtaggtctgaggtctctgcgaaggagcacttttttaggctctgttcctttgatggcccggggaatatttactgaacttctccatgcaggcacgtggaattttcaatctgtaaatttcaatcccgggtgatttaactgttaatgttaaccatttcactcacccagagtctgcctttcctgggtttcttttggcagaatgtacggtgttggatgataggccattcagatgcggcaatttcaaactttctaaatgaagggcaatttcctggtcctgtagggaactgttggaaacctgcagctatggagttcttccagcagtgaactttactactgttttcctagttggctaaagtacagtaaaaacgaaagtcctctcccccgaccctcattctctttcagctagtgtgtgtctaggggtttacagcaccccatctcttcaggggtgtcttaactagatagaccgctgatcaggcaggcaggcaagggacactgaacattgtttgtctcctaagaaggcttctatttctcttgctaaaataccagcatgcaaccacatgcttgtgcatttagtggtgatggttaaattttctatgaattaaataaatcatgtttttaaaaaagttaatgaggcatttaattaattaacaatgtcgagtttatggcctttatggttacattttgcggttaatggcattcggcttatggcctcttaacagaattgtccaacaaaaacagtttgatttttgtttaggaatgggtgggttgtccttcaaacacccatttctgatgcaaaaaataacaagagagatgtatcaggcggcacacatcttccccattctctgttgggaacagcagttggcatctgtaaagaggccacccttccacctaggagagtggtattagcttgcatgacctcagcagtggggtcggagggatgctgctggtaacagctggattgaagccctctagctggagcttttcattgggcctttcgaggcttcccagcagacctgggaattggtttgagtgatgagtcgaatagttccccttggttgggaatcttaacccctctggaccacagtctcccagagtgttggatgagaacactcccacttttcttcctggagtttcctaggctgtggagagtggtgtggggcaagatctcacgccaagtgacatcagtgtagctgagtgaggataggccatggcaaatacctcacctagtgtgtggccactgctaccttcccagccttcctacggggaaaagagcgaatcgacttggccttctgctctggcttctttcatttctaggttccctcagatctgccctgtagcaagataggcttccaggtgagggccataattgtcagaacaaataaaccctgggttgagagaggacactgggcagaccgccgggatccacataaattgatctttgcacagcagtcagtggcgctcgccgatcccagagtcacgtgatgaggtctcttcctggctggggcacacagctcattagattgcagccgtccactcgagtctggctagcgagggcctgctaaaagagcagcagcttcatacggtatcctggataccggtgctcagggcaggtggcctgggagctcagagcattgtgggctttctggcaggttagaacctgaaggaagaaacaccgagccaggcatgccttttctcttcctccccttgttttagaaaggagccgccgtggtgacctgaagcagcacggcacagatggtcagatttcccagcatgcagctttaggctcacagggaggcatctggaacattctagttaggacctaagtgacccttacctttgactgaactgtcctagaaagggcataagagatttttttcacaacccacctcatgtctatgagtggccagcaggagccatgtctaacagataagtttccccagtgttacctgtgaggtttccctttcactgataggccatgtgttaggccacccccacacttacccccattcttagaagttaggactgatctacttggcatgacttagaggaagatagcgtaacctgtttcctggcgacagatactgttcaatgtgtttgaaaacttgcttaatcatggtaataagacatggaataaattactgccgtgcttactgggagtggttcatattaatattttaacttgctaaagaactgagattaataatagtgatttggatgcagactcttgacactgaccgccttccgcagagggggaggggcgggcttgttctagtttgttctactatgtgatctatctgattcttgtcactgacgtaggtaaataagagtgtatttcattgattcagtcttgagtagaatgagaagtgaggaaaggtgggtcatttgaggtcttagtgtccttggtggtgtgactgaataaagcccagagcatggcctagcaagcaaaggctctcctgctgcactactccccgcctccccagctctctgtatgccttttttcctcacgtgactgtttcttggggggggggttgttttgtttctttgttattaagagtggattttgctttatatcccaggcttgccactaaggctggcatcaaacttaaaagtcatccccctgcctcagtctcttgagtgctgggattacaggtgtatcccacctcacttagcttcatgccactccttggtgatgtctaagatacctggcaagaagccccaactagagccctgcctctcatccagaggcctggctgcccaacctctgcctcccctctgtacacagggctggaatctacctgacccaccctgggttgcggggtgtggtgacaacttttccattttgcttgcctttgatcactctcacttttatctaaacttggctgtttattatctataatggccctgtgaaacataaatgccattgtacaggtgaatgcacccttggatttgttttgttgaggcagggtctcacggtatatcttagaccagtctcagattcttgttggtccggtggcctcagcctcccgagcattagcaattacaggtgggagccaccatgcctagctttgaatgagcccttttgagacctatgcagctgaatctctgcatgctccctcagcactgagccaagtagattggggcctcatagctttgggccacacagagcccttcacactgttctgagcccctcaataaacatccaggcaccacccaaaccaaagtgggttctcaggccccagtgtgcagtcttagaactatgaagaagtcttccttgtgaggtgactgtgtggtgattggatggtatttcctgttccctccccacaggaagtggtcttatattgcctggagaacaaggtctgtgatgtcaatcatcgagacaatgctggctactgtgctctgcatgaagcttgcgccaggggatggctcaacatcgtgcgccacctccttgaatatggcgctgatgtcaactgcagtgcccaggatggaaccaggtcagtggtgtgtctccttgcatcctcatccttcctttagaggaacagacggtagctctaaggggatgcagagaacccctgagagagagagagagagagagagagagagagagagagagagagagagagagaaagggagagatcgcacctgcacaaattccagtctagaagtgaactgaacaggttttcctggcacgtgtagacaaacccctcctagtcttggccagttctgtagttctcccacagaccaggaccctccatagaggctatgtcttcctgaagagtcagagggtgctgccttttcaaaccctaaactgttcattaccatctgggaagtcatattcaaagtacttgtgagctgaaacacccctggcaacagactaaagaccacatgtccctccctccactgcttcctcagtcaccacccacatccaggccctggtattcacttggtgcttaacctctgctctgagtcagcacagcatcttgaggggtacactgctgggagacggggcatagatagctaaaggtaacctgtgaatcttttaggcttttgttttgttttgttatttggacacagtctttctatgtagccttgcttatcctagaatcactctgtacaccaggctggccttgaaatcacagagatctgcctgcctctgcctcctgagtgtcctggtttcctaataacattgactcctgtgtcctcctttgaatataccactgtcaggcccttaagacactttcatcatagacttaagttcttccttaggcctaaggataaaatagatgtgtacttgagagctgacccttcactggtactttagaagagagctgcttctttgactttgagccagtcgtttatacccgggtgctcactgtaggtggtgtgtctttgcttctagcttagaaggtggtgtgtgtgtgtgtgtattcacacaagcttaatgtcactgtgtgtctcttcccaggcctctgcatgatgctgtggagaatgaccacttagaaattgtacgattgcttctttcctatggtgctgaccctactttggccacatactcagggagaaccatcatgaaaatgacccacagtgaacttatggagaagtttttaacaggtatgatgtagtccaatgaataatcttactcaaaagtttgactcacctgtgcacagtatggtttcgggcacctacagtcctagatactctgagagcataaggatggaagatcatgcatgtaaggccagccagactgacttatgaaggcctggtagttgaacacttagcacagggaaagccctgggctctcactcacaccacctaaggagtggatggggtgggaagagatgggaactgtatattttgatttgggtgtgactaggcagaatgcaaaggttgtttgtttggttggttggttggtttttgatggtgtaatcctgttatagtgaggccatttggcttcttcatggtagcgttctttgattgtttgtttagtttccctttctagaaatctcctttttcccgaagtatggctcataagtttacatagcaagtctgtatggagtcacacaatctgatgggcatgcagtttggggtgatgttgtttgatcttagggtaaagccatcttttaagccccaggcgctaggagattcccctaaacagaagcacagagggttttatgactctcaggcgcacttacagtttgcattccttatcagacattctgggaagggattccctcagctggaccatgacccactcatgcccatcttgagttggactcactgggagaagttactcagttgatcagagacaaggtgtagaaatacagttcttccttggttttataggcaaaagctgcagagcttcttcgctctcatttggtaggccagggtggcctgtccctcggcaagtcaggataacagttatgtaccacagaaggcttctaagaattgagaggctacgtgcagacccattcataaaatagcctatcatgagttcataggagaaatgcaccctaagtagatcagcattttgttattgtcaagtgacgttttgtttcgtgtggggacaggagcccatagtggggcccaggctggcctcaaactttctgggattatagttgtgcgacaccacacctagtgatcttccatcactacccctgtttctctgcagactatttaaatgacctgcagggtcgcagtgaagatgacaccagcggcgcttgggagttctatggcagctctgtgtgtggtaagcagctttttattgtggggagtggatggcttccaatgtctatgcctacccggagggagggcggtgggcactggaaaaacttggtcactggagaagattgttagaggtctggatgtggtggtgcggctgaaatcttctgtagttaacggatccctctctctcatttgtcttacattagaaccagatgacgaaagtgggtacgatgttttggctaatcccccaggaccagaagacccagatgaggaagaggatacctatagcgatttgtttgagtttgagtttgctgaaagctccctcttgccgtgttataacatccaagtgtctgtcgctcaggggtgagcatggctatttctggcacaaagtggccaagctgcttctaaggcagtttgtcccattaggcagatgaaggtagatgagtgggtggctccttagctgtcggcaaactttggcttagggtccagattgcttgattatttatgcccagtggagatggggcttaaccatagcatggtataggttgccctcatgagaaagcaggagcttagagccaccatcttggatattacagttgtcacccattcccgaacaaatcaccctaggaactcccccaagacttgaggtataattggattgtagtgataatctacctccttatctaagaataggacagtcacacttggaatccttaatgtgtcctcagatttggttagatcccatgtgtcccctatgggtgtgctgctgcaccttcataccgtcctctggggcatacatctcaagaaacagctatgctgtgctatgtggggacaaaagtgtttaatgagtaataatctcctcagctctgaaacgataaacacatatgccatcacaaacagcgacagaaattctgaagggtattagctagctattaagagtattaagaaaaaccgggtgtggtggcacacgtctttaatcccagcacttaggaggcagaggcaggtggatttcttgagatcgaggccagcctggtctacatgaagcatgaagcaagttttagctagagctgggtgagcaggactttttctccatttgtttccatcctcagcagacacagtgaagcttgttcaaatcctagtacaggttcttcgtaggaaacgagatctggcctgagttctttcagctgcagttactctccttacctcaaagtccagtgatgagctatggtgggagagagccagtgggagggttgaccaaaagacagctggccctggttagtactcaaaagtagtcagggtactgtagtacctttccatttggccagaaatctaagtcccacccctttctattttctaggccacgaaactggcttctgctctcagacgtgctcaagaagttgaaaatgtcctcccggatattccgtagcaattttcccaatctggaaattgtcaccattgcagaggcggagttttaccgacaggtctcaacaagtctcttgttctcctgccccaaagacctggaagccttcaatcctgaaagcaaggagctgttggatctggtggaattcaccaatgagctccagacactgctgggctcctctgtggagtggctccaccctagtgacacgggccatgaaaactactggtgagccacctgccccgcccacccactgtgtacagtgtgttatagtgttaatccttgtgcatatgtgtcataatacaacaatttctgtaaagaaaggacactattacatatgaaaatatctcttctttatataagagaagttactccggtcagaagaacccagaagcccgtgttttctttctaaaattttaagtcagtttttatgaagctgttgaaatgtctttatttttcagtgtacacatgctttgaaatgtatgttcgtttttacttggaacatttttcttttctgttcttttctaaggagaaaaaaataaatgaataaatgaataaatgaaaaggagctctgtgcttggcgtaatttcatacaaagctctggtggcgggccatgggtgtattgtgtggtgaggactatgtgtttggtttgctggagtgaattgggtgaaggcacttggtggtggtatacttttatgttttgtttacagagtacctgctcacaccaggtaaatgctattggacgtgatccagtggtatgtaatataaattcaaaccatatccacacacaacaactaattgtaagaaacttttgtatcctaatttaaaagctgtgaaattacttttcacacatcaaaccggattgtttatatgtttaaacattttatgctcttatttaaagaagactttgagctatttttttctgtactctgtaaaatattgaaaactaacataatatgttgaggttgcttgaaaatgtacataaaactaaaattttctgaattgtgtgtttatgtttgaaatctgtgttttaactttgtaagtaaattctctgcctttgtatttatattttacaaaaatttttcttaaaaggcaataaacctgttgaggaaaggagc

SEQ ID NO: 617 - DNA, 91667 bp, mus musculus; identical to SEQ ID NO: 616

SEQ ID NO: 618 - DNA, 83761 bp, mus musculus
cagcctgcgcatgcgtcctaagaaccccctccactcgcggcccaggctccgagtattgtcgggggctattctctctcccaggaacatggcggcgagtcagggaggcggtgggaacagtgggggcggcggctgcagtggaggtggaagtggcggtggcggtggcgcggctggaggaggaggtggtggtggtggaggaggaggtgggggggccggggcgggaggaggtggcggctgtggcgggaccgtggcggtgcccatcccggtaccgactcttttcggtcagccgttccccaatgggccgcagtggcacccggggagcttgcagccgcagcacacggtgaggagcctggaccgggccctggaggaggcggggaactctggcatcctgagcctcagtggcaggaaactcagagagttcccgggcagcggttacgacctgacggacaccacccaagcaggtgacaggctggggggaggggaagcggggcctggaaggaggatggggagtgggtggctgcgtggctgccttggagtctgctggcccggcgcgcagaggcggcgggagtcccggaatcctagcagcctcctgtgactgcaaaggggcaatgcaggcagcgggaaagaggggcgccagtagcccagggatgatggagagctggctgcgatgttaggggcattattgttagagagttgcgtgcatacaggcagaagggacttattgacaccttccttaatgcacttcttgcaactcttggtcttatctttccctacctcaactgtgagtaggtgggaggcagtgagggggagttgagaacagacaatgcagaatatcataatctctacttattccttgaaggcatccatgcctgcacgaatggcatagtcctttttagagtcaggtttgctgtttgtggtcttatggtggatttgtttaatcatcttagggtatttttggcttctttcccctcatgtatgccttatagagtgttttctattttatcttattttatttattcattttcctggcgttgagaggtgatggtggctagattagtatttgttgtagtagcaaattaaatcatcaatcacttaagggtttggttattgggtgaaaggcagtccagatttgaatgatgttagttttaatttttatagcagaaatcaaaagaaatgagcatttttgagaaaaatattccatttcttatggagttgatggttaatggattatcctatactctgtgttcgtctttgttgtggctggtatttttgctgttgttacgaattcgctctccttctaaagctgtgcagcttatttttagctttgtttaggtttgctgaaagtttttttttccttctcatgatctttaattctttatttatgtaccccatatactctgctgaaatgaattatgcaccaaaatattagaagtgatgtagtgattttgaagcaacatagtaagtaaattcatgcgtagtaggaaatagtaaacaaccttatttacaaaccagacaaattgagtgcattcagtttctagacatcaaatcaagatgcatgcactggcagaggatggaagaggaagaaaacctcaaatgaagcttcctagtcaataatcctcttaggcgttagcctcaggaatgcataatcaagacctgattttgtattttggaaagcacatttgaatgtttacacctttaccaagaacagattgtccaaacaactctattcacatactcatggtgaggtactgacaatatatgctccttggtgtgtttttacaaaagcttcaagaaaaatggctccatgatgcattcttataggaattgtttttcttactgtttttttcttttctttttttaacccataaaggttccttcattctacctgtgggacaaagtttaagcatcttagctgtcactgtctggccccaggttaattattgcaaccttatctccacaaatgtttctgccttctgttccaactaggtcagcttgctgcccttcaaatgtgtttgtgtaattttgcctcatattcatgaaggttctcagtatgcaggaggttttctaagaagctggctccataatccatagcagtcttctgtttctttgaattcctcggcacttattgtctttactacttgtttgacatttctgactttattttccctttatgcttgtgccttgttctccctgaggatatggggagcccctttaaaggtatatactcatttagtgttaccattctatattgcttcctcctcctccccctcctacttctcctcctcctcctcctagccccctcctcctcctctttgtatagtgacgtttctcacaaacatgaacatcattttattcagttataaccatttgcttttaagcctttggttggttttctgaggcaaacctcaacacaacccagaaccatatttgttcttggtaagctgttaactccccatatctttttgttggtactggtgctgaagactcaggattttgcacatgctattgaagcattctgtatccatcttaatctttactagggtctacatggtataccttttggtgtgtgtacttgtgcttgtgcccgtgcaaacctgtgctagggtgtgtatgaaaatgtgtaggccaggggtcagcctcaggtgcagtgcgtttgattttctttgagaggtgctctcactgctctgaagttgtcaaggagactaggctgggtggtttgagaacactgaggacccatttctcttcctttctccagctctgggatttaaaaaaaaaaatgtgccaagctttttttcttttgtatgtagatgctggggattaaatttagatactcatgcttacctgactaacaccggctgaggctgagtaaggtgttttcatttgtgtgttttcctcctttaccttttcattctcttcctgcttcctcctttgtgtgtgatactcctgtgtgtaaacattcccttatggatgaaggcacatgggtgctatgggcaatgtgtggtcatcaaaggagtatcttgcatatccgttcttaccttctacctaaagataggagtcttctggactctgagtattcttggctagctgacccatgatcttctagggcttctgctgcctttcttcttatcttcctaaaggagtgctgggattgcaaatacctgagttactgtgcctgtcctttacgtgggttctggggatttgtactccagctgtcattctgttgacaggactttacccattgtcatttccccagctccccttacccacccttttgagacagagtctctgtatttccagctagtattgaatttactttgtatcccaaattggccttgaacttgagataatttgcctgactcagtctcacctaattacaggcataagcaaccatctgatagtacttttcaaaataactctgctttattataagctatgatgcatatatgaaggagaataggcagatttttctctttcttactttgagttatctttgcttaatattatactttctaaacccacccacttgcctcttaatttcacttttatgaatatctgaataacattctagtttgtatgtgtagtacattttcattatctacacatttgtaagtggatgcccgtgttcattccatttcattgttattgtaaatacaggagcgataaatatcgatgtgcaactctacctggtatggagtcctttgaggagtctagctgggttatatggtcggggttcttttgttttattttctgaggaaattccaaactcctctccttacttattgtaatagtatgaattctaccagcagtgagtaaggattacttctccccatcctccccctataaccctgtcctctctaacttttgctgttagatttcttgatggtagccattctgaccagggtatgttgaagtctcaaagtaatttactttgcatttatccagtgactactgatgttaagtactttaaacaatacattccatttgtgtttcttcttctgaaaaatgtctgtagatttaattagcccatttgttaattaacagttttaattcctagcctataatgtgcatgcatgtgtgtgtgtgtgtgtatatatatatatatatatatatgctgttagtatgggtgtagttataacatttagaaagacaatagagagaatacaattagatgatgaggaaggatgggataaaggtaaaatgacatgtgaatcatgaacaggacataatgacactttttctctcctggtttcaactctctctcatagatttgtaaatttttttgtggtatacaagtgaagaaaaatttaattgaaagtaaaagtgtaaagccctaagcaaagctttgtctcttcagaaatgatcattctgactgtatagcagtttgctgagatggacaggcttggggcaaggcaagtgtttgaaccagctgtgtagataaaaaagtgaatgtttttatttgtgagtaattagaacaaagttattttatttaaaaatcaataatgtggttttattttttttaaaaaatcaataaaacagcaaattaaaaaggaaagaaatgccaaagatttaatatttttttttgtctttcaaatgtactttctttgtgagaccatatcaaaatcaggtagagtaaaatagatcttgtggtattatctttttcatttcaatgagatataagtatgtgagttacttgtcatctgttttgaaaagatttatctatgcattatctaggagcaatatttgtgaatacagatatcatgttcattctatgtaaatgaaagaaggcacctcagatttaaaggcaaatgcagcatatgtgaggttatatatgtacatgtacacaaacatatacatccaggtaaataccgtcttctttaagatgacactgcttgatggcattgttacagtgtatgtacaatgactcttggctaatgtttcagaacaaaactgattatttagacaagcatgaggtagtttattggatggaggaaggactcaaagaaatgaaaatagctaagatactattctgctaattaaacagtggttggaacatgagttaaaaatagcagatatgctattctgctaattaagtggttgctggaaaatgagccaaagcaatattgacttaagggaaatcgacaaatttccaaagaagaacgaagggaaggctttctgtgtttttttttttttttaaactctcactcatacatgcataagatgaaatataccagtgtttcctgctctggctagacattacaatcacaagggattttttttttaagcaccaaggccatactccagaccaattaaattagggtctcagtggccaagtttctcaaacaaaatcttcccaggtgaattcaatatacagtcaaggttgtataaatgtaaacactttcagtttgagtgaatgaacgttcaggcagaaatttagtgattaacctaaggttactactcatccagaggttcaaaacccaagctatgaagttttcaagttctagtgcagtgttattgtgtgtctttatactctatgggatgagcttactaggaacctatggttagttttttttttcctttagttttcttggttatcccaaccgtatagctcatcctctttgtaaactttacatactgtcctccaattatgtagccatgaagccttgttgcctctaaaaggcttgctaagatggaacatggcaagaagagctgttggtagagtgtgtctttggtgtctttttccatttttctctgcatttatgtctgtgacttgtggatccctcctgtcagttttcatttctacctctgtctcacttttctcctttactgggatggtgctcaatgctacatgattatgacagtttcttgagagaagattcgcatttaagaggagcttgtacctttcctgagaaatcagctgatggtttgtcctcatgacctttttgagtatatccactttctcaactcttaataataataaacctctcacccaaaatggatataagaagtatccaaaaattgttattgtattttgggaaagacacttattctctttgtaatctctcctttcatgtggcctgcttatagactttgtatgaactttctggataccatgataatttgttgccttaaaatgaatttattgcactgggcagaggtgttgcatacctttactcccagcacttgggaagcagagtcatgcagatatcagagtttgaggttagcctgctctaaaaagtatgttctaggacagccagggcaacacagagaaaccttgttttgcaaaaccataaaccaaccaaccaaaaacaacaacagaaaaaccaagaagaatgtattggttacccaaacatatgttgatcgttttcacagctcgccctcccccttgctacaactgagtggatgtgtttgagcctgcttgcagccagtccctctgatgcactcactgtacagtaacttttctgtccacgagcagatgtctgtaaaatagatttaggaattcttttgccagattgtgctgtgtcccgcataatcacatgttttcctgtaaaccaggaattgactctaggatttcctacatatgttggctcacctcttcaactgtaggatatggtacattgtattcaattgtaaaatggagccagataaaaacatctgacctagtctcatagttaaaggtcttgctagtgcactcactggaacaagtttgtgatgtttgtctttgacctgaatcaagtatctgcctttctttatggagtgtcttcctaaaaatggaatgtgaaacacatttttcagagttgactcatattttaataactgtagattatatctgatttgctaaaccttgaatggatttactctagaacaaattctatagtgatcccttaatgtcttttactttttctgcaagtttgcaaagttaaataaaattttagcttgaattggaaggtgtagtcattgttaaactaattcaatttgtacttcttcatatataatgtatacattctattttatcctattaaatatgctttgacattgtttgctattggtagaatacatagtacttcttgtgtttgctgtggagtatatagcaaagtattggttaggaatagcacagtgaagtatccactgggaatgttttttccttattatagaactattaatagaaatttatagaagttacttcttgtgaaagtgcatacttactcaactttatggctatcatacattttccatgtcatgccatgttttatttactcacatagccttttatgcctttatgtttgaaaactttagaataaaataattactattagaagtttaactttggagacatgttcaattgtccagaaagaaaggaacctagcatgtatatagatgtacatctgtaatactatccatctgaaggctaagagagtaatgtattattattatttcttctattttgggtgattataatataattacatctctcccttccttattccccttccaaatcctcttatacttacaactccctactctcttttaaattgatggcctcccttttcactgtattattattgtatgaatatatataaacacacacattcctaaatataacctgtttagtccatgtaatgttgcatgtatgtgtgggtatctgtgtgtggtatgtgtatgtgtgagtgaagggcagactatggatccatctttctatcccctaggcagtaataccttgaacttaaggctaaattaaagtatataaggcataaggaaacaatgtcaaaccaaaaaaaaaaaatccagaaagattggtatctcagtattagaatccttgcctagcatgcataaaggaagccctgtgtttgattctggtgtaaataaccaaagataggctacatatttgaagtacagcataaatacacacagaaatggatagttaggataccctgtacttggatgggaagtgttgcttaaagtttaaatttttatgtttcaatttagattagttataattagttagggttctctagaggaataaaactgatgggatagatgaatatgtctatatgggttatatataatattatatagatattataactataactaactatatgattattaccatatatatgtatctatctatctgtctatatatctatatctttctatctatctatctctatgtgtgtctatctatctattaatctatctatatatctgagtgtattgcaggctgtgtgtggtccagctagtctaacagtggctgtctactaacagaaactccaagaatccagtaattttttagtccatgagctggatatctcagctgatcttcagtatatgccagaatcccaggaagtgggttctaatgccagtgaaggaaagaacttgccagtgacagtgagagcaagcagacaaagagcaaacactttcttcttctatgtccttcctatagactgctaccagaaggtgtggcccagatttaatgtggattttctcccctcaaaagatccagatgtagtttgggtcttcccacatcaaataattcaatcaagaaaactttctcaaaaatatactcagccactcatattttagttcatcccagatgtagtcaagtaaataaacatcacacttgggatagtttatatggcattagaaataggtgatcaagatcactgacaatgaaagtaatgttaggtatacctttcataagaactaagtattgaagagttatagcatactgactttctggggcatagtattcaaactctagtaaattcattgaaaatggacattctctctgctcaacccagtagctcactctgaatgatacttaaactgggtgaagataaacctcatgccttggggattcattatcaccatggcacaggagatgaaatcttggccttgggatgtaagtcagttgaaacaatggctgcttagcattcagaaagccctaggttcattcctcagcataacacaaaccagttattgtagtgcatgcttataaccccatcattcagagaggaaacatgagggtctgaatatcaaacctcgaactggcttgatagtgaattggaggccaacctctgttactggagaaccagtctcaaaatggaaacaaacaagcaaagcagtacaagcagtgccactaagagagtcaaattataactgtttctctttttccccatgcttggatatgttcagatagttgatgaagcattgtaatactcttgtagaatcagttttttgaaaattttagagacttctctacatgtcctttataggacaaaaatccacaccttacactccagagcaccatttaatgtatttaaagaaaatggtatggggtaattttataacaagtcaactttaagtgtcaatttctgcttttgcattcagtctagtaaaggtcaaactttaactaatgctggtttgggggtactgtagattgaactcagagctttgtacccttgttttgtttttaccttaatcccaaacactaagtctttgtttaatctgtttcaaagagatttaaatttgtagaatttcacttacctaaaaccagtgtatggattctactagataacaattccatattttctaatgttatttgaggtcatgtgaaagaaaagttttgatatgagagttttaatatttttttttacctaaacaagatttacagactgagcaggttgtagttaggtgtgtgtgtgagtgtgtgtactaaaaacaaacaaacaaaaacccagatgaatctcagaaacttaatattgggtcagaaaatataaaagtttctacagttaaagaaaacatagtattaattgggtttcactttttaaagctttgagacaaagaataagagattggaactctgaaagttttgttaagacagctgactggcttgaatgtgctttagcaaccactgacaatcatagttacacaatgcaaagcacagtcgaacaaggactgcaaacagtaacaatttgggggtggtgctgataacaacatttagtaatcagagatgagggatgctgccaagcatctttcagtgaaaagaacaatccccacaatgaagaaaaaaatgaaatttttttttctttcccaaagcatcaatggtaactatcatttttgaaccttaactttgaagaaggttgagtgttgtaagtgaaaacagtgtgcattgcttgattagaggttgggatagcatttgattgcactataggcacatcacagggagctttagaaagaatactttgtctccatatttgctcccctgagtattttgttcctctttctaagaaggacaaagcacccaaaatttggtcttctttcttcttgagcttcatgtggtctgtaaattatatcttggatagtctgagcttttgggctaatatccacttatcagtgagtgcatgccatattcgttcttttataattgagttacgtcactcaggatggtaggagacaaaatgaagagcagagactgaaggaaaggctacaagatactgtcccacctggggattcatcccatatacagtcaccaaaccctgacactattgtggatgctaagaagtacttgctgaaaggagcctaatatagcagtctcttgagaggccctgtcagagcctgacaaatacagagtcagatgctagcagccaccattgcgctgagtgtggggtccccaatggaggagttagaggaagaactgaaggacctgtgggggattataattccataggaagaacaacaatattaaccaaccagacccctcagagctcccagggactaagccatcaacaaaggagtacacatggctccagctgcatatgtagcagaggatagccttgtcaggcatcagtggaaggagaggtccttggtcctataaaggcttgatagatgccccagtataggggaatctagggcagggaggcaaaagtttgtgggtgggtagaggaacactctcatagaagcagggggttctgagggggatgggatagggggtttccgggagcagggaaactgggtaagggggataccacttgcaatgtaaataaagaaaaattaaaaaaaaatgaaaagaatgcgttggcttagaaagaggatcacatagaaccttactgaatatggacatctcaatattgtctcaaacccagcttatcagatgacaagctcttgttgctgactcttgactctcttgtcactcagatcaggaatgtggggcttgttccagcttcttcttttttctctcagcttctccatcagttagaaattggtgcctgttcaccagaggcttttgaataactttccttcctgtctgtcctcactgccaccgttattctggttcctctcctccttgccttgaactggacctgtcaatagtttctcacagtttctcatctgtcatcttggcttcaacgtcattttattttctccacacttgttcaactgtgctttgcattgtgcaactatgattgtcagtggttgctaaaacacattcaagccagtaagctgtgtcttaacaaaacatttcagagtcccattttcttattctttgtctcaaagcttaaaaaaaaattatactttgttttccttaactagtaactttaatattttccttaattacgtttccgagattcatctggttttttgtttggttttggtgtgaagtgcaattcattcttttgggtcactacactataccacactctgacttttgagctatccccattctcctgcagacaatcgacctgtaaacattaagcatatctcttacatatatggaaatctttctcttttgtatactttgaaatggaattgctaggttgttgatcaatcttcaaattgttttacagtttatattttcatggaaatctcgtgcgcacatgcgtgtgtgtgtgtgtgtgtgtgtgtgtgtgtgtgtgtgtgtgtatgtgtatgtgtgtgtgtgcttcctgtacacagactagatcaggcttggattatgtgtcatgttggatgagatgtctcctgatgctcctccatagacatttctacaagtgtttatgaacacgagtcccctatatttaaatattttctaatttcaaacagtatttttggaagtcttttctaaacttttattgatcttttgtgaatttcacatcatgtactcaatcccacccatcttcccatccattcatatccacccttgcaaccttcccccaaatgaaaacaaaacacacaaataaaaacctcctcactgtggaagctgcagtatgtcagtatcatggggtactgcatgctaaacccttttgctcagatagctttacttgcaaatgctcactgcaaggagtcattggtctggtttgaggcctctgtatgctatgctagagtactatagtctcaccaggactcctctcgcatatcctgatttgccctctgtcatggagattctgcagccttggatctctaggaccagctccttcaggcactgcaacagtccatagatgaggtggatgttggggtggacaacgttaggtgtgggtggtagcccaccagctctcttgcacgcacaccaccagagtcagctttacattattgcctcattagcatacccaaggggcggggccaactctcctgctctcctgctctgctctgctgtcctgctctcctgctcttggggctggctcaccctagcctctgccaccaggataagctctattgtgctgtcttaatggtgcagggttctctaccctgagtgccatagccagcggggtgtgggactggctgtcttgctctcatgactttgtggccagctctcctatctgctgcaggttactggggcgagagggtaaggcatggcatctctcttgagcccagatcacctcatgacagaagagggttcatgttctcagggaagcccacacccccgcaccctgtcgcccacacccttgtcccctctattgtgctgcccaggtgagatgtgtgtgtatgggcggggcactctccagagtactgtagctggtgaaggacagggctatctctccccagtgccacaaccagtaaggggtggggccagccctgtactgtccttggacaccaacatggtcccaggcagcagccctcacaagggatatcacgattatgtttggtggtaacacgggccatggttatagacacagacctttgctgctgcatttccaccagcccaggcatgaaccctagtgtcaggatgggctgggacttcaccattgcctcaggtagcagtgctggctgctaacatcaggctgttcctcacaacttcgagtttccagtcccacctctttttattgtgctcaaaccattctgcttgtctttctctctcatctctccaccacatgcttgcatatttagtagcgcccttggtgagcaggccaagcagtgcacagcatcacactgagaacatcataaatgcatatgatatgttttgatctaatccttattcccccattccctcccgttgaagttgccttttatatctccttaccacctttatctcccaacttcatgtactttgtttgttttaatccagaatcagtttagtgctgtctgtatacacttgggtataggaccatctactggagcatgggtgacctctcagagtttgaatcgctgaagaaaactcacactgatttctgaattatggtgcctttcatttctgtttcatacctagttgtcctgaatataaattatggtacaatatttagtagatatagtgagaaagggcctttcttgtctgagtttggaagggtaacatttttagtattttctcaatagatatgacgttaactttggtatttgagcatagcatttattaggtatctcattgagggtttccagtgccatgaaaagacaccatgaccaaggcaactcttataaaagaaagcatttaattagggctgtcttacaatttcagaggttcagtcccttgtagtctcatgcagggaagatggcggcttgcaggcagacatggtgctggagaagttgagagttctacatgtagatctgcaggcagcaggaagagagatatactcgggctcttgaaatctcaaaggccacaccaaatgacacgcttcttccaacaagactgaacctactccacaaaggccgtttgccctaattcttctaagtagttccactccttgataacttaagcattctcgtatatgagcctatggggcccattcttattcaaccccccacatcaggttgaagaaattcctttctataactagttttatagtattttgatttttaaaaggcattagattttgtaaaatgctttttctgtgcaataagttaatcatatttttgttctttattgcattcatatgggatactacacagatttattttattaaggaactcatcttgttttactgaactcccatgcttttatttagtctcagagttcgaaactatggtttgcttttcaaaagtatccaaccacccatctttgcatgtttcttggtctgtagttactccctgtcaggcattctgccttttggtaagcctcctttcttttcgtccttcacctgcagcagtgataacttcagaccccttttgtagtagctgtgatattttattgcaattcctagctttcctccattgcaccatttaataactatcatctttggaggcagggtcttgtcctataactcagtctgatctagtacccacggcgtagtccaagttggccttaaacttccagtgcttctgctttgtgagtgctagaatcaaggatgttctaccacactgagctctatataatttgttcctttgatttgatcttctcccatacaatacatcctgagcgttgtctttcctccctccacaattaccagtgccccactcccattgctccctctgtttgccttcagaaaagagcaggcctcccagtgatatcaacctaacatgacataagatgccataagagtgggcacaaaccctcatgtcaaggcccagtaagaggaaaggggtcttaaagcataggtaaaagagtcagagacatcctcgctcccacaaacctcccaagctaaccaagcacagcatgtatgctgaggacataggacaggcccactcaggctatgtaattgctgcttcagtctctgtgagcccctatgagccatagttgattgtgtaagtcattttctcctcgtgtcctcttgctgctacactgctttccacagagttccctgagctttacacaatgtttggtagtatgtttctgtacctgcttctgtcagctgctggaggaatccattctgatggtgactgggctaggcactaatttatgagtatagcacagtatccctgggaatcatttcactgacttttttgttgttgttgttgttagttatgtttggttctactttctttgaaccttcacaattctggatcctgaccatctagacagtgttaggcataggctccttcttgtggcttgggcctccatttagacagtcattggttggccatgcccataaattctgagccacaattgccccagtatatcttgcaggcaagacagaggtcctgatggttttgtggctaggttgatgttgcaatcccatcactgggagccttgcctggctgtagaagatggccagtttcaggctcagtatcctccattgctaggagtcctccctggggtcaccctcaaagattccaggaaaatactatatatatatattttaaactgaaaaagacaaactaacaggaagatttctctggagatagcaaagtccttgccatggaaacatggggacctgagtttggatccccagggctcatgtaaacctagctggggtctactgcaaatctgcagttctgaaattcttaggtgagatgggagacagagacaagagaattcccaagagcttgtaggtctgatactctgtggtaagccacagggactacaagtgatcgagtctcaaaagtgtgccataatacctgtgattgtcctgtgacctgctcacacatgcattgtgacaaatgtgtgcctgaactcacatggaaatacacacacacacacacacacacacacactaaaaaaaaaaaaaaaaacagaaataaaaacagaaaaaaagtgctagaaagaaaaaacatgtattattgctccataagcataaataacaaattttaagagtttagagatgtgttattgtttttaaatgttctatttttggtttttacattttcctatattgcacaatggaatgtttttaaaaaaggaattagtttattgaaaatatttaggttaattattcagtataattgatttaagttatatattagagatggatcttcactgcactcatggcaaggtggggcagtaatacaaggcaaaacagacaattagagcacattaaccaactattttaaattgtctaactcctttaaaaaaattccattgtccaatataaaaatatgtaaaaaccaaaaataaaacatataaataaacaacttatttccgaactgttaaaatattttgtcatatttttattattcatgatatttcattaaatagtaaagatggcactgaaaatagtaaagtgtaatgtagtaggaggccggctggcggcctacatgaaccgggtatttctggaaggcaggctggggctgaaagagagactagatggcgagaaaagaaagaagccaagacaattttttctttgatcaaggcccgagagtttactaagagattgtgcttataagggggaaggcccatctcccccacccccagtccattcttggtgcctggagccagcctgtaaggcaaagtgcaggataggatgtgtctctggaatgtctcaagggtctctcagcaggtagcagagtctcagtgaagagcagcggttgacataacaatatagccatctaggtgggaaggctacaccccaagtgatctcatattcagtggcagcaaagtctgaatcagcctgcttcaaggctgggggaggctacagtgtaagaaattcaaccttttgtttgtttgtttgtttgttttgttttgagtcaaggtcttatggtacagcctggactgcctcgaaactcattctttggcacaagctatcttcaaatgcacagcaattcttctgcttcagcctcccaaatgcgaggattataattatgagccactaagactgtctaggtcacagacttagtgttcaaagtcataattgcattgacatgaggaccaggaaaacctgagacaagtgagcacttgtgatttattttagaattatttcctgttttcttgtagcatgccgtgctctgcttttctcttcctgctttggccagacgccccttcttgctgttgagtgcagttcagatccatagtctccaagctacagttatcatctgcaggcagagtgagagtagaggtgctcccgaataacaggtctgtgtgttcatggcttcttcttttcctgcttcatcaaaacctaatgactgaggtttactcacctttctttatataattctgctgtcatgaatttcatgtttcctttgttctataaatataggaatcaaggcaacggggaagattccttcatattggtagccctgagttacagaggtttatatcctggtcttttaaagactacctgtctcatttaggtctaagcacagagaactagaggcttatggctaaaaagtgtcaaagctcaacatttattgctctagattttggatgcataggcttattgcccaggttgtagaggctcaaaaccagtggctaaagttatagattatgagtatgggtatctgaaattttggaacttcattactcagtagcttgttcaaactcttctagcaaccagagctttcagttcttgaagttcagctcctgtctttgactctccacagtttcttatcttccctatgctcaacttttctgcctctgcttcttggccattccttactttctcagtacttccatcattcttagagtattgcaagtttagcctttggtttctctctggaactcttcaactgtcgcctagtactacatctctgaactttaaagcatccagcttagagagctttgcctatgataaggaccatttatggaaagcacccagcattttttaggatcttaactgaggtttgaatggggtatatcataagaaaagccttgggcatggccccacaagattgaataactgcttgcttatatagctagggaatggatgtggtgtacgtgtggttcaactgtaattatgtaagccacagcatggtttcccagacccagttcctaagctcacataaagaccgatcagaagccttatataggaagtaatgagaagctctttgatgattcattggctaggcagccatggtaggttctgagtgagaataacatcagtgtgagcagggtcatctagagtgtaaccagattgtcctgtgcagagtctgttttcaatcattcagatgacttcccactcctataagcttttggccttttgaatgaactaagtaacagataattgactgagttgggccccagctgaggtgcctctgcagtccttttcgcctagaaaatttaggagggagatggtgctatggagtgatggttggtgggaaagactacaaaagaattggttgtcttatattggagctggatattaacacaagaaaagaaggacgatcttaagcaggggctttcccaaataagtttaggctgttttagaatccatggagaagaaatagtgagttgttgataatattggctgtcaggattagtttagatgaaagtaaaacgtttttgagatacaggtggcagtggagtgttgaataaaacattgttaatgtctaaaatagttaaatgttttatgaataatattattgaagagagtgtgtgggttggtgataggattaggacaacagaaaggtcacaaataaccctaagatcttaagaacgacctggccttgagacagggacaatgggaattttatacagaaattcagttggggctaaagaaagtaacatttaggaatttgtagtaatgtgttaagagtgttctcaaggctttgaaacttatatggggaattggataagtctttaaagttgatgaaaatggaagtaatatgtgagactctgcctgagtttgacgtgttccaagtagacaggaacagctgactagttatgaaatggaagatattggagagcagaaactatggatggtcttggtgaacttctgttgtttagggaaccatgtttgaggttagatagagtgcagatgtagtttggtccccagtttgtatataacatgtttttaactaataaatcaaggaagtccaaattaggaaggcatgactaaagtactgttctccaagaaaacaggacgaaagaggaatggccattggttggaaaatgccattgacttcaactatcaagatagaaaccagaatgacacaccttgaaaaatcatggtctgcatctaagataaaatgatacccttctttggatagtgaacactaactacactgggcttaggcaatccagtaatctaagatagggtttgttttgaccctggcttattttagtcagtctactgcaggaagcccaaaagatccttccttgtagaaacatcacccaccttgagccttaggttagaaggttagactttggttgagctgagacactctcttcgtgtgtgtgtgtgtgtgtgtgtgtgtgtgtgtgtgtgtgttagaaagagagagagagacagagacagagaatgttgttcttcctgtgtctgacctgtttacacgtttttctagatagattaggtgggagcctcttttgggaggcaaatttgatttcagtggccagcagactgtacctaaaacagaaactaagggacacctctcaaaggcccaactagtagtgaggcaaggggctgacaggcttgtcttttcatctgggatcttaaggacttaatcttttcctttctctctcatgagcttgctgattgttaaatctccaaaagactgtctgagatttcattattattattattgtctccagtaacatagtagcctagctctatgaagcttacattattaacatatattgttgctttagcacaaatgtgatattactcttttgtagtgacacatgttgcaattatatatatacatatatatataatgattattaagaacttattattattattattattatgttattaagaactcaaattcttttgtaacttgtgaaagaattgtagaacttggctcttaatttgctttctgtttgagaaagaacataaagacacacaagtgtggacaatgcctttgcctccaagtacttagaacagcaggcagttccgaactcagtagcctgaaagcagtggccagagtgggtatggagctaggagggtggaatggtcttgagtgaggggtcataaggggtttagaattaaaatgcagtggatatatctggtcagcatactcattgtaagagtgcgagtaggagttgaagggggaagggagatgaattgaggagaaagaaggggcatgcatgcaagtagggcacttactaacgtaagtgagcaagtttgaagaagtcctgaataagagaacacaaggccaatttctgcccaagtgatagcatacatggaattggaataagacactgtgattaagagaacaattttcaggccagacttcctaggcatcaaggttgaataaaggtcatgttatactacaagagaacacttaaggtcctagattcttggagactccagaatagcatacccagtctttgagagtctgtgtaaggggctacaaagattccttctaagaacataaagacagtgtccctggtggtaattaattcactgaaagattgggcaaaactagtgctaggacttttgctaaatgagaaacaaaagggaattgcctgtctgagatagtatgaaatattttctttcttgcctaaagtgtctgagttattaccccatcatttattctcaatacttatgaatgtctatttatgaatctcttcattaactgttgactactgcatatacaagcttctctgaccaatattgagagtagcactaatttaatgatagaaacatagatattttgatggcaacttcatacagtgtccattcagctaaacaacagtagtaagttcccctctagagcctatgacatttgccatctgtgggctattgaacaggtctacagtaccaggtatggattcccctcttgtgaattgggcctcaaatccaatcagaaagcaattggtcacccaataacaaacttgttgtcattttacaagtgaatatattttgcttgatatgttggtattatagcttgcagggcttacagctgattaagaccattagtgacttttccttccctcacagcctgcatagaaccttctagtactgtgaaatctaactcacaagtagggaagttccggcttagatctagcctcatttctctatgttctgcaaacaaagtatatagtatcttcagcaatagggtctcaccatgtagttatgataggttaccaaagagcaattggaacagtttgtgttgttttttgggagaaggaacaacttttggatcctccttgtccaacagctcttaagggggcatcccatacctgaaacttgtttattatttaataaatattatttaataacttatgacttctggtacctcagtttaaattatttaaaatttgtttcaatatgttatatgaatgctgaccattgataatattttaatttgtgatataatcaatggaggtgtgctatttttattaatgtgcattaattattgctttttaatatacccatacttttcttcagatgagtctaagccaggaaaccatttgttagtgatttatttcttcatgtgatactttgaaaatccttccccattctaaaattgcacagtgcttttcatgttcatcttctcttttcatgtttattttactttagaagttatatggtttgcctttaaaaataaaaagttaagtcaacagtcacttcataaataacacgacactggttcaaaatgccaaattcacagtctgtacaatttacatgggttgaagggtagtgccattcttaaacatcactttgatgttggtgccattactctgattcattaggcattaattcttggtgaaactgaagaatgttgctgaaattcttagagacggctctgcatgtagcccctctcccgacttttattaaagccttggccttccatgtgacttaactgatgcatgactcacagtcttttcctcatagagcacggatgtaatctgcccctctggttaacagctgtggtttcttcttgcagcatctgcctttgttggcacccttgcttttcagcatgcctgtggcagcacgagtcttccatcactgttaattgttgaaaagtgaaatctagatgcttcatattgattctactaaatgttggctttacagcaacttttctgcattttcatcaaatatctacaagctactcctttccctccactatactatagttcacactttatttaatcatgaaataccttagaagttctctatctcatgcatcctggtgaatcaacaaggcttagactatataaactgtttgttatttcctcgtgaatggcagcccgacacccttctagagaatactgaatgaagaaatcacttgtctttggagatggcatgtgctggaaaacagataccagagccatggggttgtcatttcccatcaggctccagcatcagaatctctaattcttcaaagacatcaatagacagctgtgctgcctcctgttttctcattgggtgttgtttctagttctgaccattctttttgatggaaaaatagataaggaagtattaaaatgtgagagcatattaaccagatttattcaacacaacttgaattgagtaatggcagtttctgaaaagttgtaaaaatgtgtttttaattttcatgttagaaaataaaacaacttgttcatttttatgtactctccaataggataattttgttatatatatatagtccatgtcataaaaacaaacataatggtctaacttatattatttttgcttattatctatacaaaccttatttttcatttattgtgcacaaattgatgaattatcttttattactattatttatatcttgtgagattttaggttgttagagaatatctactcatttttagcaaactaataatgatggattaaatgatgttggaagtctcttacaaaatcagaagtttgttctgatgtagtctactgttttcttttaagttgtttacagttctgtgacatttaaattatacattcagaaactttaccctaagaatgatggcatatgggacagtttgaagacctttataaaagttacaattttagttgaaataagtgaagatgattcttttatatttcttcagtcactgaaattgtactaatgttagcttatctaataccatctgatgctagagttgtacatgaattggtattgcctgtagttcatgtctgagcttcccttaacatgtacttcttcacccctacataatatttaatgaattcaattaaatgaatgacagcaagtctattaaagattctacctgaaaaataggaaaataagttttggaaggtgattatcacaatcttcttatgtggctacataggatttgagacttaacaatagctagataccaatttgcacaactgtggttatgctctgaccattttttcccttgatactggggatggaacccagaggctcatgcctgccagacaatcattctgctcttgacctacattcccagtttataagctgtaacttctaagccttgctggactgtggaaaggcaaggagctgaaggggtctgcaaccctataggtggaacaacaatatgaactaaccagtaccccagagctcttgactctagctgcatatgtatcaaaagatggcctagtcggccatcactgcaaagagaggcccattggtatagcaaactttatatgccccagtacagaggaacaccagggccaagaagtgggagtgggtgggtaagggagcagggtggggcggggggagggtatagggaactttcggaatagcatttgaaatttgaaatgtatataaagaaaaagttgtcaactagaaacagtgctcaaaagagggtcaaagatgtttttaatgagcatatatataattcgcaacaggccatggtagtttaagacattatatctaaacaaaggaggatgtttaaaacatttatgatgatataactttaggaatcattttaattactgtatcactttcataatgttaatgatctttctcacctagcaagaactaagctttcaaataatgcagagggtacatgatgtgtgatatattaaaaaaaacttcctgtccaaaaaaaaaaaaaaaaaaaaaaaaagaaaaagaaaagaaaagagaaaaaaaaaactatttggagacagttctcaataggcttttatgtttccatatctctttgttgtgaagcactgttttgtgtgtcagattctcttttcaaggatgtttgtatggtgagcagccttgcaagatgagcataactgcttccttcaatagcaaagatcagacgggcttgcatccttggaagaattctgttgtgtctctagggcaatgtgctaccacactgtccagtaaaataagaatacattccttaagacacagggaaggcatgcttactgctctaaatgatgtgggtattctcttatcacattcctcttataataagatgtaccacaatatgcacacctacattggctcagtaggattttaaagacaagtggaacaaatatcagtattttcttcatttcccgttgctggctgtgagttctaaagtctttcatttttcatacaggagcctcatgccttattctagcttccatacatagctttacaagtagttatgtacttacaagtagcataacatttcagactctttgtagtcccttcaataaactcagtggttctgtgtattgtgttatatgcctttagaataaattggtttacttagttttctttaatccttatttaatgaattgattaagaatattgaaacgctaataaaggcccattcattttaggagctaacaaggctgtatcttatctcagagcaaacaattgtgtattgataaaattaggaacagctgagggattatcatactgttgattactttctgggcctgactttgggacgtaagtaatactactgttcagtttcctgttataggaataagtctttgtgtatatgtttagaagagttactgtttctctgaccttgatttgtggttggaatcagaatacttgaaatgtgagacaggaggtcctattagtgggaggagaggaaaattacatagagatcattggctttgaagttgatttgagttcaaaagcccagtgctgtcattttttttttcctgtattggacatgtcattcaatctgtctttgcttcatatgtataataaggaatggtagctactgcatagaattagcataaggattagagataatctatgacaagtgcatggattctggtgtaatttatggtgtgtgtgtgtctcagtcttactgatatgaattttgaattctgactttaagtaatttatacattaatctatgtattaatcttatgttcctttaggcagaaaattctttccttcgttcttcctcctgcctacctttctgtctgtctcatgccattgtgttgtttgggttttactctaaatcatatgagctgaagatctatgattatatgatgctatctgatgatgatgaagatatgttccaacaatttatataaatattagacattttactagagagaaacatggtctgggcttcatatactagtaaggtactgtggtagtctgtaccactggatagcagtagactaaaaattactcatttctcttattttacagtttggtagtttgtatacttccactaaaaatatcagactataagtagcacaattagtgtgataatttctgaaaatctttttctgtactttggcaaaactactgctgatggaccaggcaatacgttgggcagcagatggacccatctgtgatgcttatggttgcagcttggaagatggctaacagacttccattccatctgacttcctcctcctttctccaattttcttggtctttgaagctaacagttatacaggacgccttttcgattagattatttcagaggctcgattagcatctctaaaaggctgtcagcgttttgtaaagagtgtcttgtaggaaggcaggaaacagtaaactgcaatctgtctgctgacttacagccagtaatggttgatatggcttatgtttagaaacgagacaaaggaaaagctgggtacttgttataatgtgataatgcctaaggatattaattaaatgaagtgtcaccttgaagcacaagaaaaaacacatagctatgcgttttttattatatgtgctgccaaataccacagtacgtagctattaaaatttttaaaggctttttacccaataattatagtaaatgattaatgtgagatctgtttgtttcctgtggtttctataaaaattatcataaacttagtggttcactgtagtagaacctgagtctgctatagtttggagatcaaaagtctgaagtgagttttatgagatgaaaatcaaggtttcagcgaggccctctaggaggctggaggggacattccatgtcttgttttctaactttaggtggcttctgaaactatctgtacatattactccaatggtggcttctctctttatgtggttttctcttcagtgtatctgtctagtttccttctgtctttccccttttccatttctgtgagaagtagtgtcaatatgtagttcagactgtctcaaatgtgtaccattggtctctgcttgctctgcctttttccttacaaagacatttaatctgcctttttccttacaaagacatttaatcaagtatagggcccacctagatgatctaagatatgtcattgtggcaagatttttaattatatttgcaaaatacttgccttttaaggtaatgcaggttctggtaattagacttgattaggtgtgaggactaccattcagtccacaatagaaagatgatttttaatgatgaaatgatgaacatctttatacttgtcgtttcccaagtccttactgctcccttaggaggtaccttttgaaactgttttaaatgaatctcaacaaggaatatatattaacagtttatattcttggttttgatgaaaaatttatttttctgtttatgtatttctatttttactggaactatgctgaaacaccaactttatggatatttcttgaaaatcatatgtgcattattgtgttattctagttccctgagtataaatgatgattaaatattttttactgttctgagactcttttattaggtaaataacccaagataaaattttaaaatcagtttagttttatgtatttcatctctgtaagtcagtctttactactttcaaggtaaccatgacatgttgttaagtgtgaaatagttcagagaattaagacctagattattttgtgttatttctgtgtttccttagtggtttagtattgttttggcagtgttcttttctcacccagtgcttagaaaggatgtttatactaatttacaatagaaaacacactagactagatttccttaattagggcctatgccatagttagggctttaatattatttccttatgctttgtaataatttcattcagttagagtaatcctgtaattttaactgtcttttagtaacaggaattcattcagataataatttatgaatataaatataattaaaatccagagaggcttatactattactttgtaatttaatatcttttgaaagaaaacaaacaaaatacatcatttaaaatgctattaaaatacgtaaaataatgtgttgctatcatttaaattattttttgtgtgacatattcattttttcatgatttaatccttttttacagttcaatcttcatccccctcctagtctgacccccctactgctccccatgctatacctccttccccaagcccaatccccctacgcacccctgtctctaagaggatgtccccaagcccaaccccaccccaccagacctccccactccctggggcctcaagggttaggtgcatcttctctcactgaagctagtcctctaccgtgtttggggcttcatatcagttggcgtatgctgcctggttggtggctcagtgtccgagagacactgggtgggtgtcctcagagtttcgggggtccaggttaattgagactgctggtcttcttacagggttgccctcctcagatagtccttgggaagaccaacatttggtattcaagtggggaaaaagagttaaagaaaccaagaggtgattgagattagtagacattcagaaaggtactcttctaggtcaaggaatgaaaatgtttccagataggtggagaggttaggtgtggttgaaaaatccatagtaaatttagttgtatagtggatttgtataaatctggccatgaaggaagaagaaagagactgaaagtaatgaggactcaggggatggttagggatgcgtttttattgttactatatatctaggtgtttacttgttactcaaacattgtttttattttttcagatctttccagaaatcgttttacagaaattccttcagatgtgtggctatttgcaccacttgaaacattaaacctatatcataattgcatcaaaaccattcctgaagccattaagaatttgcagatgttaacataccttaacatcaggtaagcaagcatacttttaaaaataaatcttgaaggtgctgaaaatttagctcagtagttaagaaaacagccttcttgtttcagaggaacagagtgtggtttccagaacccatatgttgacttataactatctttaagaccagtttcggggatccaatgattcctgacctcatcaggcatcaagaatacacatgatacacatacgtgaatgcagggaaatactcatatcatcatcaacaacaaaaataataataaagcaaatatgatgcattttattatatttaataacataaatattacatactagattagctataatacaaaatatatttttctatattaaaatagtatatattatatagtagtataatatgtaatatactaaaatatgtcatgtaaatataatttattattgtattattgtttaataagtaattaaaacaattttttaaatattacaatgctttatcgtgtttagtagtagaggaatgtattctgtttatgcttacattatcttgttggcttttgggattgttctttaaggcaatgtttgtcaaagtttcacacacaggaattgtctggggatcttgttaaaagattctgtcctgttagacctgctgtaggaactgcattttcgaaaaggtcccttgctgattcctctgccagcatgtgtgtttgtaattagatctcactttgagaagaggctttagaatataaatatttttttattatttgctgtccactcatctgaattgacttatataacactctggttagagtatagtgaaaaacgttttaggtgaagttttattactggtgatgttgccaattcaagaataggtagattgggatgggatagttggaaaatgagaggacagagcacctttatgattaatatgttttgtctttcagtgatggggatcaaccctgggtgttgtgggctaggcaagcattttgccaatgaatgacatttctagtcaactcatgcttaatttgtatttactgcatgccaggcaatatcccaagtatttgactcatattacttcatttaatactccaacatcattattgatatgtcttatattatacctataatacaaatgaggaaactgtgttgtttgaaaaagccatatattcatacagttgttctttggtgtctgtgggacaatgacattcaccccaaatactaatgtcaatcaatattcagtttccttacataaaatggcagagtgtatgaaggattatgagtgggacctaggacattacacatttcagaagtccttcgagattactaagtaaagatcattatccttcccttttgttacacacacacacacacacacacacacacacacacacacacaaaggacctctattttaaagccagtctagtatttctagatatactttgccaacataagatgtggtaaagggtcttttcttccctcctcattctttcttgaataacatgtagcttttattaatatatatcttatataaaacatgaggtacaggtctcttaatggcaattagaaaaataggggaaaaagtaaaattattgcttgtcagtgcctgctagtatataattggaatgttgtcttctctatattttgattgtgaggtacattgggtcaattgtctgaatttgatttttgactatagcacattaagggtaaagatacctgtgccagatagatctggtttcaaccatgactctcctgcttatcaactgtataacctgagaatgttttacttaccctctttgtagtatatttttcttttcaaaatgggactcatgatgagtgtcttcctaaagtagattgttgtgatagacagttgcgttatttcataagagctattctgaacatttactggcacatagtaagtattcaataaaatgttgttagccaagtggtggtggcagtagcacatgcctttaatcccagcactcagaaagcagagggagccagatctttggaaagcctgtctagacaatgtgtgtgtgtgtgtgtgtgtgtgtgtgtgtgtgtgtgtgtgtgtgtgtgtgtatgagtgcagtacatgtagagagtagaagatggtgtctgataccctggaaccggagttacaggagatggtaaattgacccccactaggtgctggaaactggatttggggatgcgtcaagagcagtcccacctgaaactgttggcccatctctccactttccaagctatcagtcttttaaaagataacttctttcttcatttcaagtacattttcctgggagccttaccatggttagggttatggaggcactaagtctgctaaaatttgtgctccagaagaaggttctggcattctctaatttgtgtttgaatcctttctataaactaggcaagttacttagtgcacttttgccttcagttttcattcttgtgacttgaagctaatattccctatttttttgagttaatgagcagattagacagagtgtgaaaagaatttgcatgctcttgttttaaaggaagtactcaataaatgtcactgaaagcttatgatttactactaagttgctttgtatttttttagataacattgagactcagacacatttttcataatgacactttattcttctttttttttttaaagtcgaaatcttctatcaacattgccaaaatacttatttgaccttccccttaaagttttggttgtcagcaataataaactcgtatccattcccgaagaaattggaaaattaaaagatttgatggagttggtgagttaaatattgttttaaattataacacacacacacatacacacatatatgtatatcacatataatatgtacctttttcttttggaattgtatgcattcttttgtggaatttcactgtaagttttttttttttaaggcataacttggtatatgtctaaattcaataggatagcaatctcagctacatttatttaggtctgattttagctcccagccaacaataacagaaacaaaagttcagtgattcctcagtctaagagactttaggaggcttggttatgttttcagacatatgtttcaagtgaatcactatttgttcattcactttgtggacagagaaggtcttaagcgatttccccctaaggtttacagagctgatgaggaggcttagagaagagtggtaaaggtagagaatacagctgtgggtatggtgctgcatgtatggagtctcggctcctagctactccagggaaagacagcatgatcatttgagcttatgcatttacacatcaagtcgggcaacctactgagtccccatttcatgaaaacaaacaaagggacaaataattggttctttttttattaggtattttcttcatttacatttccagtgctatcccaaaagtcccgataccctcccaccccactccccaacccacccactcccacttcttggccctggcgttcccctatactgaggcatataaagtttgtacgaccaatgggcctctctattcactgatggccgactaggccatcttctgatacatatgcagctagagacacgagctctggggggtactggttagttcatattgttgttccacctatagggttgcagatcccttcagctccttgggtactttctctagctcctccattgggggccctgtgatccatccaatagctgactatgagcatccacttctgtgtttgctaggtcccggcatagtctcacaagagacagctatatctgagtcctttcagcaaaatcttgctagtgtatgcaatggtgtcagcgtttggaggctgattatgggttggatccctggatatggcagtctctagatggtccgtcctttcatttcagctccaaactttgtctctgtaactccttccatgggtgttttgttcccaattctaagaaggggcaaagtatccacactttggtcttcattcttcttgagtttcataaattgtatcttatatcttgggtattctaagtatctgggctaatattcacttatcagtgactacatatcatgtgagcttttttgtgattaggttacctcactcaggatgatgccctccaggtccatccatttgcctaggaatttcataaattcattatttttaatagctgagtagtattccattgtgtaaatgcaccacattttctgtatccattcctcttttgagggacatctgggttctttccagcttctggctattataaataaggctgctatgaacatagtggagcatgtgtccttcttaccggttgggacatcttctggatatatgcccaggagaggtattgcgggatcctccggtagtactatgtccaattttctgaggaaccgccagactgatttccagagtggttgtacaagcttgcaatcccaccaacaatggaggagtgttcctctttctccacatcctcaccagcatctgctgtcacctgaatttttgatcttagccattctgactggtgtgaggtggaatctcagggttgttttgatttgcacttccctgatgattaaggatggtgaacattttttcaggtgcttctcagccattcggtattcctcaagtgagaattctttgttaagctctgcaccccacttttaacggggttatttgattttttggagtccaccttcttgagttctttatatctattggatattagtcccctatctgatttaggataggtaaagatcctttctcaatctgttggtggcctttttgtcttattgatggtgtcttttgccttacagaagctttgcaattttatgaggtcccatttgtcgattctcgatcttacagcacaaggcattgctgttctattcaggaatttttcccctgtgcccatatctatgaggttttcccccactttctcctctataagtttcagtgtctctggttttatgtggagttccttgatccacttagatttgaccttagtacaaggagataggaatggatcaattcgcattcttctacatgataaacgccagttgtgccagcaccatttgttgaaaatgctgtcttttttccactggatgattttagctcccttgtcaaagatcaagtgaccaaataattggttcttcaaaagcaaagaatatgatgcttacaaacaggagtagtagtgcattgttgcactgtgattggctgactccattttaattattttatgtatgtatgtatatatatgtatatctatgtatatatatatatatatacatgtatatgtatatatatatgtgtgtgtgtgtgtgtgtatttaaagaagcttctacagttgtagatttccacatgatttgtccccagaaggtatttagatgaatgccctttcaatcagggttacatttgtataaccttgagagactgcagactctggtcattttgagtagctttgagtgggatttggattactcagatccttgcttggaactttcatattcatatctcttttggaaaaaggaatttatttaaattttccttgactctggtgtctggttctctagctcacatctctgaatccttgactttttgaggtttttatcctcgtaaatagtctaaaactataataattgacagactactttagttggttgatagttatctatagtattttatcttaccttgaacatttggcttattgtaatttttgtggtgaaatttgctctttaattgagagttttacccttgtacttactaaatttaatctcagatactcacagaacaatttttattgacagtggtatattaagttatgatctaatacaaataaaaacccatcagagaggaaattagaagtaactttcttagcaatttggccatgtgctcaaagtttaaaattgaaagtatgtttgtatttctcaattttgatacactttattttcttgttttccttaggatgttagctgcaatgagattcaggtccttcctcaacaaatgggaaaattacattcacttaaagagctaaatataagaagaaataatcttcatgttttgccagatggtaagacagacagtcaccattttcactcacccgagtgatagaggaaccatacaacctttaacttttttttttcatttctgaacagaattaggagatctccccttggtcaagttggacttctcctgtaataaagtgactgagattcctgtttgctataggaaactgcatcatttacaagtaataattttggataacaatccattgcaagtaccaccggcacaggtttgtaacaagtgcatggttcttatttttctcagatgtttatggtttcatctgtgtattaaattttaaagtagtatcttatgactcaattttgtcttgtataaagcattacctagactttctataagaactgaaattttacatcttgttttgtttttgctttaagacaacatctcgtgtatacgtaggctggtctcaaagtttctcaatggtggatgaggatgacttttgatcctcctgctcctacctgtcagtgatggacttggaagcctgtgccaccatgccctgctagatgggactttttatttcaatttggtagtaattatagtgtagattacagataagcagttggaaaagctagaatcagcctttttgtgaatttgtagttctgattgtaaatattattttaagaagaaagattctgactgaatacattcaagtatacatttgcttgatatttgttgttggagtgatattataatgggtactgagatgtgggttggaatttgagttactctaggaaaattccatgctgggtgttaagatgaggttcctgctagaccaagattactttgcctgaggtaagacatctctcataaagaagactagtcacatatagcttccagcatattcttgtaactgagatagaattcatacagatagaaaaaatacaaatggaaaacattaaatttggattttaaaataataattattaaagccacaaggaatcccctaaaataataaagaataactaagatatatacccggaagggcaaagagaattcatgagaagcagacagcagaatgttgagaatgtaaaataggtgaaatggtggtaacttgtgcccccactcagaaggcagacgtttgcctgaggagcacaattcctacccgctccaagcttgggtctgtggtgtatgaagaagcatttgttggcttgtttgttttaatctttcaataatctcctcctcctcttcttcctcctcctcttcctcctcctcctcctccttctacagatttctttaatacaacatattgtgattatggttcttcacttaactctttccagtccttctcatctctccacccactgcaatctacattttcttgctctcattaaaaaacaaagaggcatctaaaataataaaacaagttaaaataaaaattaaaaatctggatagggccaatcaaaaaacccagataaacaaagaataaaagaaaaagcataagaaatatacgtaaatgtagagacatatatattaacacacagagaaatcacctaaaattacaaaatcagaaaccacaatatataagtaaaggactctacaataagaaaagaaaatgaaaaaaaaatatcctagacaaagaattatgaaacaaaaaccctccaaaaatactattaagtttattttgtgttggtgtctactgctagacatagagtctggccttcacagtggtttgtgtatccagtgagactatattagagaaactaagttttcatctgtgagtagttatcagttggagataacttttgggttagggatggggccttgtgtgtacagatctggaactttgcttggctcagaaacatgtgggtcctgtgtatactaacgcaatctctgtgaattcatatatgcattggtcccagtgtgcttagaaggccttatttccttagtgtccctcatcctgtctggctcttacaatctttccacctcctctcccacaaggttcctgtagttgtggctttctttaatcatccacatcaactgcaaaaaaaacctccaaaaacataaaaactctgaaaggaggcatgagagctcaacttatttgaatataaggatacatatttataatgttgctagaatctatactggtttaggatattggaagtagtagcttctcttttatattccatgtactcttccttttttaaaaaatatttatttattttatgtatacgagtacatactgttgctgtacagatatagttgtgagccttcatctggttgatgggaattgtatttaggacctctgctcattcaggccaaccccactctttccggttggctccacttgctcagtccctgctcacactggcccaaagatttatttattataaataagtacactgtagctgtcttcagacacaccagaagagggcatcagatctcattactggtgattgtgagccaccatgtggttgctgggatttgaactcaggaccatcagaagagcaagtcagtgctcttacccactgagccatctcaccagcccccatgccctcctcctttgtcatgaataattggctgtgtttatagtgccaagcaataactcccttctattaagtgaagtgactggtttttttttaacccctctaacgacataggttatctaacaaagcctagtttcaggcatgagagacttcctttcaagtttttggttggggacaccaaaaggaccccccccccaaaaacaatatatgctgtgtccagtgcccttagtgccttccagaaaaaaaggtaagattccattgctgaagacatcacatacatcatacactgggtttggaggaatccatctgaaattgaactggaagcatcagtgagaacttgcaatcatagtttcaggaggaaccatacatgcaagctgtcaatagatgaaaacaacagcttacccagatgtaacatcaatgaaccattacattgatcgacatggcaaggtattcttaaaggtgccacaatggcacgaatatcttggggtactaacactaacagttgataaatggacttgatgaaataaacagttttccgcgcaacaaaggacaccatcacttgtgtaaagagccagcatatagaatggggaaaaaaatcttcataagatttacctctgtgaaaaggtcagcctctagaatattaaaaacaaacaaaaaaacaaacaacccccccaaacaaacaaacaaacccttaaacaagaacctgaacatcatggaaacaaatgaacagttaaagttggagcatgacagtaaacacttaagtttcagaagaagagatacaaatacccaagaaatactttaagaatgttcactatcgtcaactatcagggaaattaaaattaggttgatatttcatcctacttacgttagaatggctattaaaacaaatcaaaacaaaacaaatcccccaaaaccctcaaaatcaagtgagcacaagtgcttgcaaggatgtgcatgaaggaaatgcatagaaacttagtgagagtacaaaatgatgcaaactctatggaaattggtgtctcaattcctcaaaaagctagaaatagatctgccacacaactcagccatatcactcctgggcatattcccaaaggattctatacccttcaacacagacacttggcctcccatgttcactggataaagaaagcagcctagatgtccatcaactgaagaatggataatgaaagcatgtcacatgtactcagtgaaagttctcttataaagaacaaggaaattctcagataaatggttggagctggaaataattatccctgctgaggtagtccagacacaaagaattgctttgtgtttcctctcacatgtggatgacactttagaagtgtatgttctaattggagtacccgtagaagtcaggaagccagtaaggactactaagggactagtaagaagccataggaagacagtttcaaggagtcctgaatagaagacaggtgggaggagacaggaagaaaaatcatggactaagtgttaaatgaagggggcagtggaagggcaggaggctggctcttctccattgtgtattgttagcttctttgtaaaaaaaataaatacataaaataaaatctggctttgtatatctgcatctgtattggtcaggctctggcagagcctcacaaggaacagccatactgggctccaatcagtaagcactttctggatcagcaatagtgtctgggtttggtatctgcagatggctacatccctaggtggggcagtctctggatggcttttccttcaggctctgctccactcttagtacctgcatttcctttcgatgggaggaattctgggttaatatttttgagagcagggaccccagtggggaagttagggcaagcatgtagaggctgaaggggtttgcagccccataggaggaacaacaatatgaaccaaccggaacccccagaactcccagggattaaacaaccaaccaaagaaaacacatagtgggactcatggctccagttgcatatgtagcacaggatggccttgttggacatcagtaggaggagtggcccttggtcctgagaaggcttgatgacccaggatagaggagcacaaggcctctgaggcaggaatgggtgggtgggtgggagagcaccctcctagagacagggggaggaagaagggggtaggaggcttgtggaggggaaactgggaaggaggataacatttgaaatgtaaataaaataatcaataaaaatgtgaaaaaaatctggtagctataggaaggtgggtttgtatgcatcatctatcaacatgtctgtttctatacaagtataatgctgattcattactattattcaataatataaattgaaatcagggatcatgattcttccagcactgttttcaatgttaagaattgtttttgctgtcctagctcctttttaatttgctatacttactttataatagtgcttagtctctctgtttttaacctctgcgtcctatttcaccatctcccttctccttccccttctccttgccctctctctgtgtgtgtttatttgtaagtgtgggtgtgcacatgccatagtagaaatgtagtggtcagaggacaatctcatgtgctcaggtgttggaccttatttttcacttgtttgaagaaggatttcttgttttctctctgcatatgtgagactaactcactgccagttttaggagtttcctctctccacattctgtcttgtcttaagagtgttaggattacagtgggggggggggtgctatatttttgttgttgttgttttataatgtggatttaaggaatcaaacataggtcatcatgcttttgtggcaagcacttgtgagtcatatctttagccagcaaaccttctttgtagatttcctctcttaacattggttttttgtatgagcaacagacatattttctccgagcattttcctagttgaactttattccaactgcattgctattatgatttttatttgtttattgtttttatttgtttctttgttcgtttttgagacagggtatctttgtgtagccctggatgtcctagaacttgctctgtactgagtgtttgaaataaaggcctatgccatcactgcctagcactttattttttaaatttgatttattacctacttatgccgtctttattagtctttctcacattttatatcatgcttttggtttggatgagattatatatgtatattttccctgttctcactagtccagtgaatagtatgtttttaatttttctaataaagacattgtggtatagatcttttagtgttcagtagtttgttcattttacttttaataagaaaatgtgagtgaaatatagaaatatgggctagagatgtagatcatcagttaagaacaatttctgctctttcagagaccccagattcagtttccagcacatgaagaaaaaaaaaaaaacactccagttccagcatctcccacaccctcttatggcttccatggtcatcagctatgcatgtggtacatttacatacatgcaggcaaacatgcatatacataaagtaaaaataaatacatttttataaaaggaaattgtttattttaaaaacaatatacacagagatcgcacaggtctaagccagataggacctgtggcgagaggatccagatacaagccccatcctaactcaggagctactttcaactgacaaccacttgcaaaggagaatttactttttatctatggattttcactgggtatgcaaaccacagtagatggccaaaataaaatgaactcaactgtatttttgaaagcttatttttaaattgtctcatgatttgtctgagctattttttaactcttatagaatttttgtttatatattgtggtttccaattttggttttattggttttatgagaatgaagcatgcatgtcagcatctttatgtgttttttgtccattttctttgtttttttctatttagtttataatcttttgtaataataataaatacataaataaatgataaataaaaagagtgtgggtttggaagtggagaggatcttggttgaattagggaaaaacatgatcagaatgtattgtttaaaaagatctattttcaattagaagaaaagaaaaactgactgcattagtaactaataaaaattaacatagaatactttttgataagatgatagcagattttgttacagtattgtcacattttcctgtcttgctccacacacttaattcatgaaaattctggttgtgataccttagcataatttgagattatttcaatatataaatcacttgatagtgtcccattttatttgcaattatggaacagagagatcgctcagcagttaagtgcacttcctctttatgaagagtacccgactttgtttcccagtacacatataggggctcataaccatctatacctaattccaggcatcctatgtcctcttctgcactctgtcatatggcgtgcacatggtgtacattcttaccggcaaagcattcagacacataaaaataaatatttgaatttaaatttgttactaaatactttacttttttgtttgcttacagatatgcttaaagggtaaagtacacatatttaagtacttaaatatacaagcttgttgtagaatggataagaaaccagactccctggatctcccatcactgaataaaagaatgccttctcagcctcttacagacaggtaacataactagtcttacagcttcagacaatgattgtgcttgttgttataaaagaaatttatcattcatgaggatactgaatatatttagcctgattaaatcagtgtttaaaaaagtcattgaattttttttcatttaataacctctgtgatgctgaacaaaatgtgagatttttctttaggtagttattattttagtacaaaatgtaaatattttacagtataagttccagcatttacagtataagtaacagcatcctctctgtgacagctgttaacctaattttgatcaccatattaataatacttgtaatggctagttggattagtctgtaaaccgactttgagagaagaggatgttattttggaggtgcctttcacccttatgctaatgatcttttctttttccaatgttgaattttcaatctaaacaagtgctctatcgctgaaccacaaccccagccgtgtgtgtgtgtgtgtgtgtgtgtgtgtgtgtgtgtgtgtgtgtgtgtgagagagagagagagagagagagagagagagagagagagagagagagagaatatgttttctttttctggagtactgggagttcagtccagagcgtgttttatactagacaagtgccctaacattcagctatacctctttatcttctggtcaaaaatgatatattattggcctttgattgtgctttaatctttaggacattttaatatggtagataaattgttcttttaagatgtagattggtctgaaaacctttttcaaaaatacaattccatccagaaatatggaaaataacatggagtgggggtaagacgacagaaagggtgactgtgaccacctaaaatatttaaaggtttgtcattgatttatatgataaatttgatgttttggatgacattgtagtaagtactgctattagcagtaaaggacttgaattcccaaatagcaccttcccatgaatctttctcttgccgccataaaatatttatgtattatattaattcctaaattgtattttggttattattagtagtacagaaactataatattctattgaagttaggattggtatctatactaatctctattaatatgcttattatttttgcagatgagatactttattattaatggtgttcttttcccccagtcatttgtgatatccatagctgttgattgcctactgttagactcaggatgtattgtgttgagagctgtacatgttggtcttggcatctcgtggacctcacagtctaggtggaagaaacagtgaagaaacaaaacaaggaaacaaataagagttcagttcactttgcactgctgtacttttaagtagtagacatttttgtggctcatagttttggagactgattaagtccaagataggggaggaataatcagtgacatgtcaaaaggtaacagatgaggaaaagaacttgagagatgtgaacatgaagtcaaatttactcctgtggcaaatctatttccaggacaagaaagtaactactacaatagaaaggttaatctcttcaaagactgtactcttatgagcaaaccccttactagaccccacaagctgatgcttttgcatcaggaattaagtttacaacacactcagacagtagcatgcctatttccttccccttactctcctccccttctccctcccctccttccccctctttcacatgcacagtcacaagtgttgcctgccatatgatgtttcatgttaccatttttcaagtattccatggtacttaagttacatgcagtcagcagaaaccattcttgagttctgaattctcatcttttctggggatgccaatatgtagtatgagcctctgcctcctgagtgctgaaattaaaggcacatggcaccaccaaccagcaacgttgaagatttttagtgtgttttgttttgttttgttttgttttgttttgttttgttttgttttgttaagacaaggtttcaccctctggactcgatgtaaaccagtatagtctgttattctgaggatcctccagttatgtcttttaagctataggctggtgccgcctggcctgcaatcacccttaaatgacatgaataaaatatttgataggattttttttttttggtatttcctcttttaagaatgtttgatatcaaaactatttattttgcattatctagggacagtttagctcaatttgctttctgtatttaagaaaaaaaaattctagctgctcaaagtatttgtctttctgcagcatggaagatttttatccaaacaaaaatcatggccctgactctggaatcggaagtgataatggagaaaagcgattgtctacaacagaagtgagatttttctcttgctggcctgtgttgttttcctatttcttagagctttaaaaaaagaggcacttcagggccaagaagtgggagtgggtgggtaggggagtgggggggggagggtatgggggacttttgggatagcatttgaaatgtaaatgaagaaaatacctaatttaaaaaaatttggaaatgaaaaaaaaatataaaaccttccaaataattgcttggaggaaaaaaaaaagaggcacttaaatgcattggattttacttttacaggcagatataattttgttatatattttatgacttcaaaagaaggaatacctactgattttttaaagtaaaacattcattgtaacatggatttttggttggaaatctggagatgtagagcagatattttgtaattcctatttaatcaaagaagcaaaagcttccttgagtgttccaaatacgtcatttatactgtgtacttgttcctttcagccatcagacgatgacacaatcagccttcactctcaagtctcagaatcaaatagagagcaaacatcaagaaatgacagtcatataacaggaagcaagcctgattctcagaaaggtaattcttgtggtgtctcttaggtttaactcatttacacagcccatattaaaaatgatatttttatttgaagtggactttgaagacttataaggttataagatatagcttatattgaaaaggtgagcttttatcttgagaactaaaataagtagaacatctataatgtcttgtaatattaatctatacctagaccaggaggtgtatgattttattgatcccaacacggaagacgtagcagttcctgaagaaggagatacacatattggatcatttgtttctttccttaaggtaaataagcaaaactcaatgaacattgttaacattcacttcatcctgattatacaaaagtataccatgaaatttacaatgataattttgctttttataaggggaaagaaaagagctctgaaaaatctcagaaaaatgaagaaccgccaaatgaaaaaaagtaagtatagtctgctttttgaaatacagtatgaattatgaatgcttggattattcattatgtattcctattgagagcacttgagaagtttttcatatgtcatgggtttccccatgccatgtttagatagttacctttaaagtccttcaaaagaaaaaataaagtccttcaaattaataattataatagacctttgcttttccccttgaagtagaataataatcctgcctacagttttgttacctaaaagggctgtgtcttcacaaatactgcttcatttgagtcccccataaaaatcccaacaggatcattttgtctataaggaagcttaggcctagagttctgaatttccgaacttgagctttctgtttcttgatttaacattttatattatctcctaaaagactttctattgtgtattgaaagctcttccctagtccccgctggtgtcaggactgagttttatcgcagctttcctaggtttctctgcacaccgtgtttccttcaagtgacttggttgcttggtaatcttgttgaatgctcggtactgagctccaggcctcattctctctaaatcacaaacccagaaccttgttagttctctaagtactccttagtgagtctctcttactcagtaggaaagctttgttttgttttgtaatcctttccttttgcataacactgaggattgactgttcagtcttcagcatgctagtagacaagagcgctctaccactaaggtgtagtctcagtcctagtaatgtgtttctagacacctttgcagatgtatacaaggtgtagtagtcactctcatctcccatgtcactactatcctgattgtccccactctccactgactttttccacacattgttcatgcctattcatcttgttttgtggcccacggagattaattgcctgtgtcaattatggacttgcaactatctgtttgaacggggtgactcagtaatgaatatataactaaacacagttcaccttcaattgccagtagttcagaaattatggtagggtgccatgtattctctccttccttgacctgttgatgtaggtcttgtgtgggcctgaaagaaactaactatggtttttgtgaagtaacatttagcaactccaccctgccttctggtttttactttcttctataatgttctcagagccttaaaacaggtggaagaaatgcctttctaatggcttcatcccttttttaattttgtattaattatattttggacaggattttgctacattgtcaaggctaaacttgaccacattctatagtcctgaactgccttggaattgtgatcctcctgtcttagacccccaagtttataagcctgttggcaccactttgtttatttagatttccttcctctattaagctctttcctcataaaatgaagagagttgcttaagttcaagtgacaccagtgtatgtaagatgtgataaaacacaatatattgtgacattattgttatttatgcttattgttattaaatgaagtgctttttacatggaatacttagaatttggagagcaactcatttttaagttagtttttaatgttaaaattatatttctggctgagcagtggtggttcatgcctttaatcccagcacctgggaggcagaggcaggtgaatttctgagttccaggccagtctgttctacagagtgagttccaggacagccagggctatacagagaatctcttgtcttgaaaaaccaaacagaaagagatatttctggaaaatacgaatatttttattatttcttaataaatactcactgataagtggatattagcccagaaacttagaatacccaagatacaagatacaatttgcagaacacatcaactcaagaagaactaagaccaaagtgtggacactttgccccttcttagaattgggaacaaaacacccatggaaagagttacagagacaaagtttggagctgagatgaaaggatggaccatctagagactgccatgcctggggatccatcccataatcagcctccaaatgctgacaccattgcatacactagcaaaattttgctgaaaggacccagatatagctgtctcttgtgagactatgccggggcctagcaaacacataagtggatgctcacagtcagctatttgatggatcacagggcccccaatggaggagctagagaaagtacccaaggacctaaaggggtctgcaatcctatatgtggaacaacaatatgaactaaccagtatccgccagagctcgttatctctagctgcatatgtagcagaagatggcctagtcagccatcattggaaagagaggtccattggtcttgcaaattttatatgcctcagtacagggaacatcagggccaagaagtgggagtgggtgggtagcggagtagggggagggtctgggggacttttgggatagcactggaaatgtaaatgaaacaaatacctaataaaaataaataaattaattaattaaaataaataaatttgtaaaccttggtatggtgaaggtagtggactctgaagctcaatgatcattacctctagccaattagcatgcagccattcctggattttatgtgggcattgaaagtatgaatgcaaattatttaataaaataaattttattaatatttgaatatatttttaataatttctggaaattttgaaaatgtcatttgaaccaattttatattattcttatttaaactattttctttgttttacatagagttttaaaaaatccaaatgagtaaacttctagaaacagtatggcaaatgaaacattttgatagtagtttttctttatttttaagaataggccatgtggagcttttcaattttattcatactcaatactgagcagtgtgtactgctaattttttgtgaccattatacatctcaaattcagcatcacttattagctacatttctattgagaatgcagatgtattttcctaaaattccttatatcccattttagtattttaaacataacatcatatggattagctttctcttttttagtgctttatttatttatttatttatttattattagatgttttctttttttaaattttttattaggtattttcctcatttacatttccaatgctatcccaaaagtcccccatacccacccaccccccactcccctacccacccactccccctttttggccctggtgttcccctgtactgcggcatataaagtttgcaagtccaatgggcctctctttccagtgatggccgactaggccatcttttggtacatatgcagctagagacaagagctctggggtactggttagttcatactgttgttccacctatagggttgcagttcccttcagctccttgggtactttctctagctcctccattgggagccctgtgacccatccaatagctgactgcgagcatccacttctgtgtttgctagacccctgcatagtctcatatagtctcacaagtctcacttactagctacaattctattgagaatgcagatgtattttcctaaaaatacttatatcccattttagtattttaaatataaaaccatatggattagctttctcttttttagtgctttatttatttattattaaatattttctttatatacatttcaaatgctatcacgaaagtttcctataccctccctctgccctgctcccctacccacccactccagattcttggccctggcgttcccctgtactgaggcatataaagtttgcaataccaagggccgctcttcccagtgatggccgactaggccaccttctgctacatatgcagccagagatatgagctctgggggtactggttagttcatattgttgttccacgtataggattgcagaccccttcagctccttgggtgctttctctagcctctccattgggggccctgtgatccatccaatagatgactgtgagcatccacttctgtatttgccaggcactggcatagcctcatatgagacagctataacagggtccctttagcaaaatctttctggcatatgcaatagtgtctgggtttgttggctgattatgggatggctccctgggtgggcaattctctggatagtccatcctttcgtcttagctcaaaactttgtctctgtaactcctttcatgggtattttgttccctattctaaggaggaatgaagtatccacccattggtcttccctcttcttgattttcttatgttttgcaaattgtatcttgggtgttctatgtttcagggctaatatccacttatcagtgagtgcatatctaatgacttcttttgtgattgggttacctcactcaggatgataccctccagatgcatccatttgtccaagaatttcataaatccattgtttttaatagctgagtagtactccattgagtaaatgtaccacattttctgtatcaattcttctgttgagggacatctgggttctttccagcttctggctattataaataagggtgctatgaacatagtggagcatgtcttcttattaccagttggaacttcttctgggtatatgcccaggagaggtattgacaaatgggacctcataaaattgcaaagcttctgtaaggcaaaagacaccatcaataagacaaaaaagccaccaacagattgggaaaggatttttaccgatcctaaatctgataggggactaacatccaatatatacaaagagctcaagaagctggactccagaaattcaaataaccccattaaaaatggggttcagagctaaacaaagaattctcacctgaggaaatcagaatggctgagaagcacctgaaaaaatgttcaacatccttaatcatcagggaaatgcaaatcaaaacaatcctgagactccacctcacaccagtcagaatggctaagatcaaaaattcaggtgacaggagatgctggcaaggatgtggagaaagaggaacactcctccactgctggtgggattgcaagcttgtgaaactactctggaagtcagtctggaggttcctcagaaaattggattagctttcctatggcatttaaaataataacagtttcaatatctagatgttgacaacgttcagttggctttacgctttgaataactgtgtttgtttcagagttgacaaagaacagttacttccagaagaagaagatgatgatttgaaagaagtaactgatttgaggaagatagctgctcagttactgaagcaagaacagaagaacaggtattcttttcagtaatgagatttgagtagtcagatcttatcatcagtaaaagatgaccaaattaaggaaatgaagtttcaagtaaacaaaaggggcctttaagtattttgttttcaagtgattaaaaagacagaagaaaatccttaggagagaaataagaaattacatatataactaacagagtgtgctcagtttgacactatatttattttaggggtgctggtgatgaaagtcagggctttcatctgcgctgggcaagacctctgctttgtagctacaacccagccttagttaatgtacctcacattttacttctgtgctaaatcatacatagtaactatctgcctatattcatcatagctcacagtaccattaattacactataagcatttctttctggctatgtactatattggtaacatttatttattagatttttatatcagattcttaataatttgggatctaccattccccaaggatagaggtgaattataatagttgcttacatcagttcaggatttacctatctcaagttcacacttgtgtgtttcttgagtaaacaaacttttctccctctggttcagttttcttcaaatacatatctttgccaataagcaaggcactgtattcatgagtattgaatcaaattaagtttatttaaatttgtgtgtgtgtgtgtgtgtagtgtttgaatgtgtgtgtacacatggaggtcagaggtccgcatcaggtgtcttcttcagttgctctctacattatattttgaggcagtctcccactaaacctaaagctcactgtttgactagagctactggccacttagtttccagggtggaacatcctcaccagatcaagttttccgcattcatggtggccgtccctggatttttatgtgagtgcaagaactctgaacgcaagtcctcatgcttgcatagctggcaatttacctattgaggccaaagcccatttttttttagtacaaaaaaatggaccatgtgctacactactacctacaatagtacatacactgtaagattactgagaatcttacattgatcattttgactgaagtttctgtttctttttcatgagtaaattgataagagaattttgctatatttaggatgaataagtagtatttcctttcacttattcaaaaatacatgtttatggttatcatggtggctgtgtctttagagtttcatatttaaatatattgcatttgttttaaatagatcatttaacatatattagcatctggcagctgaagtgatggatggtttaggggttaagggaaccttttgctttcttagaagattggatttttttccagcacccaagttgggtgtgcttctgttacttcacctccaggggtccaattttctggcctccaaagaacccccacacatgtgatacaaagtcacatatacatatatgcataattaaaacaatgcagagcatctgggtattgtggtgcatgcctctaatcccagacctaatgaggctgagggtgaccagttgataagccagcctggtctgtaaaaaaccaaccctgagggtgtactgggtgcccagcatgtacgggggcacaatttgaattcccagtaccatgaaacaaagaaacacgacagtgctggtgagatggctcagtgcataaaggtgcttgcggacaaacctgacaacttgagtttgatccctggaacctatatggcgggagtagagaaccaactcccacaggttgtattctgagttttccacaaatgctgatgcatgcaagtgtgcaaaacagacatgcacacacaaaataaatacatatgcaaaaccagaacaacaaaataagcaaacatatcaagtgagaggtatagaatctgatgttaaggaaagaactggacaatggatcatatgataagtagccatctagtaccatttttgctcagccactacattttctcttaaaaatgtcatactaaaaaataccacttacctgtctttatcattgttaatgaattctcattctccatttacattgcttttcctgtatcactgctttatgtaaatgtttctatgtgatttactgtttaatcttttctaacaatgcatttcttatgtgccctctaaaaataacttttgagattataatgtgattatctaatttctgctttctcttttctcgcttcagtcttttacataactctccattttactctttttcaaactcatggactttttcctttaattgttgtagaatgtctatttgtgtggaggtggatgtatgtacatgttttacatatttatttattttgtatacacacaacacacacacacacaaacatattaatatataccgcctgctcagtccatatagcttgtttgtatgttttcagggttgatcatttggttttggataaccaaatagagtgctctaatctgctttttacaaagttgtcacagtaaggttttgtggagcctatgtgttgatcgcctgagtggtttgacttagtgaagcatacttccaccagctcttgggacataaaaattgcttgagttcatgctaccttttaggtagcatatttgtatttatttttcattatgagaaaggactagtgataattttaagactatagtaatacccactttccatttgaggcgtgtgttttagattccaccttgtgattcatagttgtttctttattttcatctttactcattgtatttaggttttcctatctctgtttcgtaattattccctgtagtttagattagggatcctctgagtaggccaccttttgtagggtttgctttggtggtgcctttgtaactagtacctaatggcacgtagtattgtgccttctatgtggtgacacagaagacacagaattagttgattcggttcttgaaaattataaaatttaaagttaacagaatttgtttagccaaaatttttatattctctgtaaacactttaattcaagatatatacaaagctaattttgtctttatctgattttctttttcattatctttttatgtgttacaaataataatataagaactatttatattaagcattgctatttttcacgatgagaaaaataacaagcattgtagagtcttttagaaaatggtaatctttctccataaggtgaaatgtaactctcacctgctaggtaaaggagaaatcaatccattttttaaaagttctacagagcagatgtacaatttatgtgttatgttttaatataattattatagattttttggtctttgtttattgctattcctgattaaaactcatttatatagtataagattaacgacgagtaccagagaatatcaccccaaccacccaggactcctgccttaactacatactgagctgttctttttcttatcattgcttgaaattaaacataatttggggtccagggtaaaaggaatcatgtttatagtcttaaacttggcttggttggaacaatacccacattgtgttccatgatgtttttgtcataattcctttgctacttgtttatcctatactagttaattaaaacctttgatttgctgaggaagtttgtgcttttatttcataaatgatgctgtcctaggagattaacaaatgatttcagaagacaaaattattaaccaaaaactgtgggacatgtagtcagtaaatagagtgtcatggaggtaactcataaggcttcagattattgtaaagcaacctcttatttctctggttagagattaagattctgtgaagctagcacaatagtgtatgtctgttttctaactacctagtggctgaggataaaggatttttgaatgtaggaattggactcaaattgtagaacatattcataaggataatgttgcttaaataaagtataggaaatggcattccccaatgaagcaacccaaacaatctatctataaaaattagtatcttaaaaataattttatgattatgaaatgaatagtatgtatatgtctgcttatataacactgtgcctatagttaacagtgcacttcacacttaaaaatgagtccttaatagatctcatgtcaatttaaaaaaatgttttatgttactggggatcaaactcagaccttatgcatatgagataactaaacattttcaccacaattaaacttatataaaaatcatgcttttcagatttgggaaggaaattgagaaaaaggagctgagaacaaaaatactaatattagagtattttttcatgttgtatatgtgatttatgataaacaagaaaactcttaatattgacctgagaataaaacagaggaatttctgttaaaaacactgtcatgatgctctataaattattaatactttcctacatttaaatcagctctacttatttatgtaaacattagaaaaatgattattatgctttactttatactgactttattgtggagattagctagcttcttaatttttggttattatcctaaaggaaagattattgtgtatgtgttttttacaatagcttcagctaactgattctcattatataattacttggctaacttactttatactattttgatatgtattacatattcataagtattttatttgctttcagttttgtcctaagagcttttctttattgtggaaggaggtatttctgaatgttttgtgacatagctagataacaaaaaagcagttgttaaatggcaaataattgaagtaaaatggaaatgatcaaagaattcaaaattgggttttaagaagtttattgtttgcatttagaattataaagcatatataacatgtttcttgtaattttgatctgattatatcaagttttcagtttgaggagctattatgttaacttttaatttgttataactacttggatacttacccttgaaacctagccattctttcttttctgtttcctttactaatgacttccttgtcttctccaaaacatcttccttcccccatcttttggtttgggtgatatatgtgaaatgtgactatagatggaggcctttaagttatagaacatcattcagtgacaaactcttccagaggaccagagcagcaggacggaaatcaaggtatctagagttggtggaagccataagcattaaggggccagacttatgtggctgaactgtctttacattttgctttaaataagtactgagaactgtgttagggaagtgtcttaataatctgtattagacttttaggtaaaatagattttaatatttatttatcacttagtaaaacacaaaatttctgtgtatattccagagttctacataggtcaaatttcaaatacattatccattttttacatgtatgttggcttcaactactttttttctattctatcataccagtaagtggtgtggcgagccatcatttttattgtgatgaaattcataataacttgaccagttccccaataattctaactttccttcctgagtagtatttattgtcatttctctttcttttatttttgtaaaatctctatttaaagcctattttcctttgttatttctataattttgcatttggggatctaaggaaattttagcacatgtacataattttttttaaaaaaatgtgcttaattctgtgattctttggctcagaaatacagtagtttgcgtctaatacttgacctttctcacatcactgaatccttttagtgaggttatggtcagagccaagctagtgaagatgtgagcctggcaccacctgactgcactttagtcatcatagtgtgtatttagttcatatgcaatgtattcagattttttaaatagtttttagattgttgatgtctaaagaattcttttagaaagtagattatttgttgcagcactaatttaaaaattaatttacatttatatgtataataataaaaatgattacatatgttcatttattttaattaaagataattactaatttgccacatttgacagggagattaatacttggaattgggtaaagccatggacaaatagttctctttatagggattcattagtttttatttttgttctaatactgtttcctattcaaagtttaagacttttttgaattttttgaaaggattgtccattaacactgatttttgcttttaaagttaatgtttattttttggcttttgtcaaagtgattataaactaccagtataactcatgttattttctatgcttataaaaagaaaatgactcaaaaggatacctaatatatttctttatattctgtgtaagtcagacttagatatacacacagtactcatgcaatggctacatagcatccaaacttatagagaaagtgtttttaaaccaagatgcaaaacacatttggtgaacttaaatctttcattaaagaatgtgttaattggcatctgaatctaaatagcattgaagtattattttctagaaatgatcttcgtgaatttaggtgtagtttatttgggacaaatatgtcatatgtgtgcaatgttctcttcagtatagtttgtaatcactgtgtcgatttacttctaggattcttaatcactcaacttctgtcatgagaaataagctgaaacaaactgtggaatgtgaaaagaggtataaacatatcatagcccttatatttggtatattaaaatgagacttgctactctgagagtgattttcctttaaaggtctttttcctggatatatgatgcagatttaatataagtagataacataggaatcaaacatgtcacaacatcagttcaatttggctttctataagcaaatcatgattctatttacttatacttaccatttgtcttcatttattcacaaatatttatcaactggatgttaccactaggtataattatttcttcatcactggctgtgaattttttgttactgtttgcgttttcatttcttcccattgggttttattaaactcttcatttgatttaatgacttaggtttacagatatgattttaagagaattagaagatctgaaaatttctatttattgttctttgtggtatcaagtttatgttttatctaaatcctagctcaacacttgcataagtgaaaaatttcaaaaataggcatgaagagttacacactgagttgccaactattagacgttagggtttatgtgcagtgttcttagctctttcactggattgctttatcaatcatcacaatacaattaggatactgttactgtggaaatcttcattttacatataagcaaactgaaactcagaaattatcataacattctcaaaatcacatagtaagtgggagagtcaggatgcaaactcatatttgtcttaatgcagaacctgaaatctattatttatttatttatttatttatttatttgtctaattcattcattcatttatttatttttttatgtgaattgatatttttgccaacccacatggatgtctgtatgaaggtgtctggtgacctggaaatggaattacatacatttctgagcagacatgtggatactaagaattgaactaaggtcctctggaacagtagccagtgttcttaaccacggagtcatctgggattcagtcccagaaactgaagtcttaatgtacagtaacagtattgacaacaataagtttacttcatatctgtgcatcttactgaaatatttccattgagagtgcactgttccatgtaaatttctctctgcaactccatcttttcttgtatggtccatctaccctatcgaatgtgaaacttcttatgtagtctcccaagtcagagactttgcaaatacctcattattgtgtctttttcctaatacagccagtcatgcaaaattaatgttgtgctaaccgtcttttcatcctctcttcctatcacactcatgttggctcagctgccattattttccatttgagtcactgtgccagtctccatgcctaagtcctttcttcaggtttgcttagttttaaattgtttctctgtatcattaaagaacagaggttgtagaacacaaatctgacaatgcaacacccatttatcaccttctaatgggcactcagaccttttatgataaagattagaaggttgaggttaatcgtaaacttaaaatgagcttcaatttatcttcaatctcagatcagagcctcatttgctgcactctctcgagtggcattttttgagtttaggatcatgattctttgatttatcacgtttctatttctataccctatatcctggtctgatttagatgttgcctacattcttcactgtctttgcatggtttcttaggagtcatctcagttctgcatggttgtcatgagggcttcatagtagccggcctctctgtggtggaagcatgtataaaagagttcacacagtaagacagaaagccagagagatttagtaataaagttagcttttagggttttttttaatgtaatgcatcttattcccatagggagcaaatgaagctcctatataacaatgataatcccatctaatgacaggctcaccattgaccacactaacttccactcctaaagatttcaccagttctacaacacaatgctgaagttcaagctctcaaaccttgggggaaatacactgtattcaagacagcatacccttcttcaaaatgtgcatatgcatatttgcatttgtttatatatgtgttcatcagtatatacaaatgtttatatatagaaatgtgcattgatatctaccacagtgtttatatacatgtgtgcatcaatatacattatattgtttatgtctaagctgtgcattaatatataccacagaatggtgaattttgttgtttccttgctattgccacttatatgtacagtacgaatgcctgacttcttcatatcatacttacactcagtcttattgtgcacttaaatgtggttctcctggatttttcccacttcagaaagtgctatctccattcttattgtgaagcatctgaaaaaccctacattaagtttgtcatttgctctccaactgcagttgatcaattaccaaataatgctgattattgggaatatttctcgaatctgatcacattttatcgactccacttctgtgaaccttgctctatatacactcccaacagtgctcaatcataagttaacaaataagtgatttccctgaaaagctttcctgtggaatacagttttgctttactgtataagtactcaagaatcgtttcaggtcaggtcagcctgtagaaattgactcctgaaaaatatttggaaatatgtttgaagagaaattgtcctcatttcgatattatgatattccattgttcagaggtgtgtgtgtgtgtgtgtgttgaccaatgagggtagggttagagattgttagatgcatagtccagagaggtatgtgtgcattgtatgacatgtgaaggtgaaataggcaggctggcaagtgctttatttgaagaggtaatacacgcatgtctgtggttatgtgtgatgtgcgcgtgtgcgtacccatagccaaaccaaatacagctttagttcgctattctattttgtttccttgcttgccttgttattatattgtcctgtgggctatatgtgcccctttgtctttgagtcctaaatttagggactgtctgacatctacctttcttctttctccctggtctgtggagtagaaatgttttcagtgtagcaacccaggccaagcatgacattcatctcttgttatccatttctcggattctttatttacatttaaagtaagtttgtctaattgatagatgtctgtatttggtaagaggtaagggatctagagttttgtctttccaccctccctcctttttcttacccatcttctgctgctgtttctttttctgtagtttacaaagtcatccagttggttatgtattgttatatattctataatttctataaatttaaatctcatttgtacgtaaagttactgtgcttaaaattttgtacttgatctcccactggagaaaatctataaattctggaattatttattttcttatttgtatatattttattactccctagagatagagatgtcccttgtacttttattaaaatttttattatcttctctgttcttactcttccttcacccatttctccttttctccatcctttttctgtctagttgaaataagttcttactctgtggcccaggatggcccagctgggtctccatcacatggtggtacctcagccttgtgagtgctgagatgaccactgtgagccatcatgcctcagctttaccctgtgtcctttagatttttgaaccttttgagtgggttttggtgtgtatatatgtctgtatctgtctgtttctgtgtctgtgtaagtgcatgccacatgtatatatgttgtggatgcccatggagaccagaagaggatattcgatcccttgaagctggaacaggtcctccatagccccttttatgtcatagatgaagctcataatcagtgattcaagagatgatcaagtatttgtcttctgaattctttggcctttaagaaaggatttattcatgtatttatttaatatgtgtgtgcgcatgtgtatatatgtgtgctatggcacaggtgtggaggtcagaggacaactttcaagaattcaaggagttacttctccccttccactatctggaacccagggttctatctaactcaggttgtcaggcttgatggtaagctagaacctttatttacccactcacctcactgatcctattacatgattttataaaacggtaacttgttttcagtaatattctgtgtacttactgcagatttgtacatattgtagtcaatttgtactctccaaaataggttggcctatgtataaggctaatatacaataaacccatgttgatgtttctcttagaacagtagttcataggcatttacaattggttggttttatcaatttcagtttatatattactaacccgtgtggtggttacttcctctcattgcagccctttgaaggctgaggcaggagaattgctatgacctcttggctagcctgggctacatacagtattaagtaccaggccatccagtgctatatagtaagacacaatctcaacgtaacacaatacaacacaacacaacataacacaaaacaacacaacaaaatgaaacatgggtatggatagtgtttatgttgctgtcttaaagcaataagaagacaaatttgttgtttataaagtatgtgaaatgatttttaaaataccttaaggaatattaaagcaactttaattttttagtgtcccagcagatgaagggaattcaccattatcacctcttgcatggcaggtaaggggaaataaaattaataacacatgtattatttggtagtcatgtgttgagttaaaaagacgtttttttttatttttattatagccattagaaaatcagaaggaccaaatagttgatcaacagtggccagaatctcagcctataatctggcaaaatgaagagaggagacgaagcaagcagatcagaaaagaatatttcaaggtaaattaataaattataaattttgtttttgtttcatacttactacttttggattttgacacttttctcttaaattaataatatttaactctccagttaaatgtcacaactgtgttcatgctgattgcccttttgtggatggtagagatatgctatgtaaatatacccacaaaattttagtaattcaaattaccaatatacactgtgattattttcaagtagctaaaaaagatgaatgtttgtgtgttacactgctaattgtggcaattaattttatgtttctttttctttattcttttgagataaattttcacaatgtagtccaggttagcctcaaatcagaatcctcccacctctgtctcttatatactggcattccagaaccactaagcctggctcagaaaaagactttcattgaattgctttcactaattagttcagaagtcttttcagatagcatttaaccatgcctgtataaataagtacttgaagactggtccatactttcttgttgtattagtagatttgttttgagatagggtctctctgcctttgacatgatacatctggtcctgattgtccgggacctctctatgtagaccaggctgtcttcaaactccccgagatccacatgcctctgtcccctaagtgctgggagtaaaggtgtgtatcactgcactggatgcagtggatttcttaagatggtcttttagtaaagataagttaaaataccagagcatatgaattattccaaatttctattgaattactacttatttgtattttaagtctactgtatttgcaggtctcatcaggatttagaatcattttttatattagcgagcatttactcttagaattgacttatataagcagtgcaaacctggtcctgtaccctaaatagcaagctgtgttgtcctttacctccctaaatcctcttctcactgaataacagtcattttatccaggcataactctgctaagttagacattatttcaaattcatgccactaataaatagtatttattttatagttttatgtttggtagaatttggtacttctgtttatattaatgtctttccatatattgggaagcatcgtgtgtttgaaattaacatatcaaaattaaaatgtatgttttagcaaatatcttaaatatattaaactaactttgaacaaataactattgagaattttgagacttggtttttggttaattagacaacatgaggcataatcacacatggaaaagacgtcggaaggaaatcgggaggtcattccagtgagaacgcttttatcagaaccatttgcagtttgcagcttggcatttatcttagcctccctttttaattcaggaaaacttaaagcaaagcactgaataaaatatgtttataggtgacctttgatgaattatttttgatgttgaatttctgagcaattttgtcatttctttgatttcttctatcaccaaataacaaaactatactgactatattcatccaaacacttgtatcagaattatcacatgtcaggcactgtcatgaatatttacacatattagtcagtttaccctttagaaaacttcagtatcattaatgaagttatcatttctattttgtgtacatggacaataaggcccggaaagtgaagtagtttgttaatcatacagttgaaattcaagttcaaagcctttacagtgttgtttcttttttgttgtggacagcttgatataaaatgaacaaacactaacatttaaacagtttcattgttttaaaaatattttgtactaattagagttaatagagggcttagtgagcctttatcacagacaagtgtttcttgctttaaaagcatttgttcattaaatattttagttttgatggctgacacatttcttctactgtgtcaattatattttaaagttgctaagaaataaaataggataatatctgaaatgaccattacagaactgtcactcagtaagtgttcatttctttcatatgcaatgatgtacgtgtaaacataatcttcagtcacggagggagaaatgctttaagggcatgtgtagttcttctcaattgtcagaagatgtcagtgttaggacattgcataaaaaattagctatcaacaaagtattcctctgttgtcaggaaaataaaaaattgtatagggctgtgggtgtaactcatagataagttgcttagtatgctcaaagttataggttcaaccttcatcaaaacagaaagaaagttagaacatggaacttatggtccattattaatcatagctgtaaaatacattagaggaacatgtctcctatctgtaattcctaatacaccttagtttgggactgaaatactaggtaagtcatatatttttttctaagagatataaaagacagagttacataagagggacaattaaatagaaccctgaatatcaagcaaaacagtttgggacatgatctgagaattagtagttttgaagatagaagttcgatgagctcctgtatctaccattgacttgcagcagaattcattgcattttggtagagaatcagaaaataagaactctaatgactggcacactgtgtgatttttgattctaagcatcactttgtcacatagataatttacattgaacaatctatctctatgtttcacaataaattgggggataatagtacatataccttatgcagttgttataaagatgaaacttttcaatacatataatgcagtcattactgatgtataataagcaatagttctaaatgttagattttagcactattactatcattgggaagtcggtatatgcatttaatgcagtttctttaagcctgaaatcagtagattacttcttttgttgtgctgaggattgaacccagagtttcagagatagtaggaaccacatctctagctcagcttcttaaaacaattgctcatgttttagtatagtgaaattacaaaccaggtgggagattctaagaaccctggataggatggtagttttaagaattcagaagttagccaacataattgacttgttgaacagagtgaacttagaagaagcaagactttacaaccttcctaatgccatgacactttaatacagttcctcatgctatggtaaccccaagcatacaattattttgttgctacttcataactgtaattttgctgcttttatcaattattatgtaaatacctgatatgcagggtatcttatacgtgatctccaagcccttcacgacccacagtttgacagctgtttttctaagatagccctgagattgcaaacctgaaggaatgggaaatggatcttgcttaggaaggaaatgttacttggcatattttgaggtcttggagcagtgtcactcatggcattgtatgtgtgaataggaagactgtttaaactgactgtgtccataagtttcattgcaggtaagttaataaaagtaccaatgtagcaataagccttatgtgccattatgaacaaaactttcacatgttcaaggaaaaaataaaccatgcatttgaattgtttttcagtacaaatcaacaaggaagaattcaagtggcaatgagaatgaggaggtgagacaaagggtgatttgaaagatttccttgcatatttagttggctcagtgatagttaatggagcccagctgtcaactgctttgttactgatttaaagtgtgcattttctacaataatgaagatttctgagcattttcatatggttactaatttaatcagttcgtttctggtgcattctggaacatgatttctaaaatagttgtagagctttgtggtttgctaggaatctgcaacctttccatttacatttgctgtcatttcccactttactttcccaaagggcatgttggtcaggtcagacttcatctgtttcaaaactgtgcctgtgtgtgtattgatgtgtgggcacaagtgtgggtgtgtgtgttccagagcatgcatgtggacgtcagaggacaattctttggagtcttttctctcctttcctcttcgattttagatagtgaagttgaagtcatgtcagtttttggaagaaagcactttaacctcttgacagactggctctgtctaagattttaaaacaacttttgtcacaaaatctgttcagatgttttaaattttaaaattgttttttatgcatttcacattcttctacagcttctgctgcaccactgctgaaacaatatttcataaccaaagtccccaggttttttgtgtatttggtttgggaattggtagtcaatttgatgcttagtacttggcagggcatctgaaatttatttttcagaaataaaattacactggaaaaaagatctatatgaattatgtctgcctaactcaaaaactgttttctttccatgttctatcaaatagtatttgtggtgacttaaaaacaaaacacggttgtttctaatgtttcccactagctatctcactgttagcgtttggggtatatctgagggcaggtttggtgtagatgtgtttcctaacatgttgctgctcatgaccccagtcaattcgtatatacctgatgctggctttccattgagatttacaatatctgtctgacccttacttcttattcctctctgtcataacccaccatatgcactgtaaagtgctgttatcaatgctcagagttttgaggactaatgccagtgtacctgatgagcacacctagtttatgtctctagtcccctacttaccattaagccttaggcttttgtagtaatgtgtcctccatcgtagttgattgaaacctaagttcctccactaagggctcaatatgttcatctttttcacccacaatttttccaaacacgtttgctttttaaattgatgcagttgtttttaaccgaggttgcactttggaagccctgattagtttttaaaggatactgatgtctggatcttactctcagatgttcaaattgaattgatgtgtatgtgtctgtgtgtgtgtgtgtgtgtgtgtgtgtgtgtgtgtctgtgtgtgtctgtgcgtgtgtgtgtgagagagagagacagagacagagacagagacagacagacagagagaagtgacatgttcaagagttttccatttgagttcactgcaggcaaagttgataactactttatcaaatcagtatttcctttctagacatcagaagttggcaaggtggcacagagctcactgactatgcttgtgactgaactttaaatacaaaagatctgcaaccatttacctatagatgcctttctgttctaatgacatttacacagttaccacctagaccatatgtctaaaatgtttactatctagccttccacagaaaacattctctgatctccaagctagaggttcaccttggctgttctccttgccttctgtctatcaattttcccccatctgcgtcaatatctattccattactgaaatccactatttctctttcttatttttaggcactgaaatattttgtctacacactccaccttcatttccatctttgcttctttggtcttttttgcttggtttcctacagtagcttccttgatttttgtctttatatcatctctctatctctccgtctatctattctttctatctatctatctatctatctatctatctatctatctatctatctatctatctatctatctatctatgtgagctctgtcaccttccagtgtcttccttagtccttttcaacaacctttttttgagacaatgtctgttagtaaatctgaatctccatgattcagctaggtttgctggtctgtgagatcaaagattctcttctctctgccttctcattcttgggatcacagaacatgccaccagttcaccattgtaagtaggtactgagtaccctaactcatgtctatgtttatactacaaacactttatcaattgaaatgtctctcccaccacttttctccctttagtgcattttcctgatgctttcagaatacaaatacatgaaaatacaagaaggctgttcctttgtttagaaaccttcagtttcaccaatgccttaaccataaattctttgtccattttaataaaagccctggtagccatagcaacagaacctcacagcttgccctcctttcaccattgtcatctgcaggaacacaggcttgctctacagttttcttttttttttaatttattgctctgtgtcttcattcttatctttttgctttacctagcttttactgatttgttacttgctctcacaaaacttaccttttttcagcatcccttcctttcctccagagtttctttgtgatttcctactaggccatacatagactggaaattttctaataactgctcacatgaacctttcttccctctagactgagacattctctaaggatgatattttaccaaatttccttatcttagtgtctagaacattatctgacatagtaggtgtccagatatcatttgtcaaatgagcatttgttttatgtggtattcatcttccaggttaaatgtcaagatttttgcattattttaacattagaatatttattcaaaactactagccctttattgtttttattcaattaaattctttgtaaatagttctctatttatactaatatacattatcttccagatagtttcttattaattatgattacctcttgctagctttcattgataggtctcagatggctatacatctaatctactgtaccgagactgtagttctgattctataaaatacttataaatcattagggtttcttatattgaatctgatttattattagttggagccagagatcattcatgtctaacaaattcactgagaatacttgtactgtacttcaccaacaacatttaagtggcaagattctatattttacattgtcaattcctccttggatattttataggatcagtcttccattttctttttgtatgttaaaatcatcattgtgtattttaatttcatctttcatgtgtttatttttatattttagcaagagagtgataatgctcatatgtccgcacagtctccagtatcatctgaggtacaagttgttttaatgatttgtcttttatgtgttttccaaagagttcttcctttcttcctttctcaaaaaaatcttatttttaatttttataaactaatttatgcactttaaaaatctgtggttgattattttgtacgagtcttgtctgtaaaaattatgaataccatccttttatatgaatattccaagtaaattgtaataatttgtagttttctgtggaacataagtctacattactttgagatgtgtgctgtcttatctctcaccattttaaaataattggtagatcttaacaatggccttggaattttactgtgaaagtttcccttgagcattgtgcaatggcctttggttttccttgtaaccaattaggtctgaaaacaatgcaagagaaatgtcctttttccacgagaaacaatcctgcagtgggttgttcctatcgacaggaggttacacttttgcaggcatatgaaatctaaagaacaaggggagagttggtatatgaaaattattaattataacatgttgttcaaatactctgatggtttgaatgactagttcttttaactcagtttaatctattgctttgcaacaataaatttaaagcattttaaatagtatctcacttagtttatttagtattctacagtctattttcattagcaagaaaataactgttcatttggcgaatttaggtcttaaactgtttaactgatctgaattcattgtataaatttgattatgtacattttatgtaagtgcatttacatttttagaaagctggaattcattctgtattattttgcatgatttgtattattaaaaatttatatagctctgagcatggaagtaataaacatatttctaaattacgtggaaagtaaaatgatacacgtggtgttagggaacgatttaagttaggatgacctaaaacttgtcataattgcatgcttttgtagatctttctctgtaagttataacaaatgtaggggtagacatgactacagtggggtttgcatagttgatctatggactgtgtctaccaggtggtatattaatgtcatttcttccagctaagttatattgattttataacttttgcttgtgtttggatgactggaattcctgttcaggaatttataacaatttaaccaaacaaatgtggacagcatataaggctgtggatgggtagactgatgaccatgtgtattgtagctctgcctgacatccacactgagctgcctagcatatctagagaagatgctgacaccatgcagaattctgactgcttccgttgcatgtgaaagagaaaatgctaaagcctgtttgtatatcatattaacaaagcccctatgtttcatttgaacataaatatagtcctacttgtgtacttttatcattttgtagtgggaaagatcagttgcttgctcaattagcctagtcagtaaatgacagagaagtaactgaggttttggccctacctgcttcccagagttgtcaccctgagtaataagtcactgccatgcattatagttatcaattttttataaattacaaaatttttaaagcactttcaatctcctcacttaatttttacaacaatctcatttgaattgcatggaattattcacattaaaaataaatgtttccacaaatataccttaagcttttcattccaattgctgatttatttacatttgtctttcttttttttgatattttttattattacgtattttcctcaattacatttccaatgctatcccaaaagtcccccataccctcccccccccactttcctacccacccattcccattttttggccctggcatttccctgtactggggcatataaagtttgcgtgtccaatgggcctctctttccagtgatggccgactaggccatctttttgatacatatgcagctagagtcaagagctccggggtactggttagttcataatgttgttgcacctacagggttgcagatctctttagctccttgggtactttctctagctcctccattgggggccctgtgctccatccaataggtgactgtgagcatctccttatgtgtttgctaggccccggcctagtctcacaagagacagctatatcagggtcctttcagcaaaatcttgctagtgtatgcaatggtgtcatcgtttggaggctaattatgggatggatctctggatatggcagtctctagatggtccatccttttgtctcagctccaaactttgtctctgtaactccttccatgggtgattgtttccaattctaagaaggagcaaagtgtccacacttgtctttcgatagctcaccacagcttgcagaagcactttgaaataatgaaataataatgaaggaagacacagtaatctattatcatatattctgaaacccctgttcatataaatatgaggactggtctcaagtttgctactgctaagtgttaagtcagtgtagatacatagtccaggttgataaatcttttaattgaaatgtgcttctttattttagagactaactggattcttctttttaaaaaatctgtcacaccttgttaatggtctttcttttcatttttttttctttctataagaatctaggctggtgagctacttcactgggtaagggcttttgccaccaagctgaaccaactcagtttggttacaagcactcacatgaatgaaggagagaagtggcttcccagttgtcttctgactttctctgtccctctccctctccaccaattttcctcccttccccactctctctctctctctctctctctctctctctctctctctctcacacacacacacacacacacacacacaacttatttttttaaaaattaaaggaaaatttaaaaatccatacccaagtaacttagcagtatttattgacttttaaaaacgttaacatatcagtttgagttgaaactgagattgacttcattcatggaaacaatggaaataaatctgaatattggagtgggtatgaataagtaccttggtgactttgaaacaacaaaagttttcctctttttgtttattttttttttaggaatatgaccgctctgatggcttttcacatggtccctttggcttgaagcctagatcaggtatagtctttaaataaaatttgttgtctatgttgaatctagagtttctcagtttaaatgctttggaatctgtaattttgtgtactcaaagcttcttttccctcttctcttgatcttctttgcctttacaatttctgccataatttttttcttccccgttttctccaacctcctgtcacctccttcctgccttaggtatactgcagtctttatttcttctctgctgtgactgctgttagaataagccccttgacagcagataaaacactgtttgaaattatagcactccattagattgtggtttaaaacagggatcttttgcattcggcatgcccatgaggaaatggatccattttacttggcaaggtattgaattattccaaaataactatcttgaccttccagaataatttcctttttttctttagaggtagaacatatgttcaatcaacccttttaacctgggtcataagtttctcataacatatggttaagtaagaacatatgtaagtgttagaagtcactgaacttttgttgcctgttgattttgtattatgtagctaaagattacttacatataattaaaatattcgaatgtagtattaataacatcttctatagttctgtacttctgcttttgatcacacctctttctccatggatggttggtctttggattatctttattaaaagttagggaatttttatttctatacagccttcagtcgtgcatctcgtcaagaatacggggcagcagatccaggatttacaatgagaagaaagatggagcatttacgggaagagcgtgaacagataaggcagcttcgcaatgtaagtcacattgacctcgtgcatctcctttacaggaacgggtttaattcagcaaattcataaagtatattgaatttttattcttaatgctttttcaatttttgatcacatgatcaataatgtgaatgcacaccgtgttcacataagatacctgcaatttatccttatttctttatagaatcttgaatccagattaaaagtcattttacctgatgacataggagccgcactgatggatggagttgttctttgccatttggccaatcacataaggccacgctctgtagctagcattcatgtaccgtcaccagcagtggtaagtagtgtcaatagattactgctattcctttaaaactctttaaataatgcccacaatacattttccaatatcaactaagttcttttagaagagtacttatcatgtgtgtctctcttctcctacctcacagcccaagctgagcatggcaaaatgtcgaagaaatgtagaaaattttcttgacgcttgcaaaaagttgggtgtttcacaggtaattatctgacaaacttgccatttaactattaatctgttacaaggaaagtaaaatcatcttcatagtggggggtggataacattttgtgaacacaaatttgagtatcttctttttgtctctttcatgcacatatatgtaattacagtgttttaaaatcttttaaagatggcctttattaagcatctacctatatgtaaaatggttgctaatcgtagctacaactgagtaaacagaatttagttgtgacaactgaagcttaattgtgacaccattgctgttgttatttaattggtgttgctggtgttctgctgagggacatttagaccccttgttgctctttagtgttatgctgcggaacccaatgcctcatacctgcaaagcacacattctactactgaattatactcaagttcttatttgtaacttcatgaataaattttaaattccatctaatatagttatatattagtataactatattaaaaacaatgaaactgtcaaattatgaattttggtacagggcaagagagatagctcagtgctcaagagcactggttgctcttcctggagacccagatttagttcccaacacccatatggcagtttacatgtgtttgtaactacagttctaggtatctgacaccatcacacagacatacatgtaggcaagataccaatgcacataaaactttaaaaaataggtgtgtatatatatatacatatatatgtatgtatatgtatatacatatatgtgtgtgtgtgtgtacatatttgaaactttaaaatgagtatgaatgaccaagcctgctcagtcagtcaacaggttctccagcacgggagtgaggattaaaaagaaaaaaaaaaaaaaaaagacagacaaaaaaaagacagacaacattgtagtatgaccccagtcaattctgagactgaaggcaaatttaattttccaatccactttttataccattttaattacatgcaagtattttggtcatacagtacaataaggaactaacaaagcagtaagcaaagtcctgtcattactcccatgacagttgtttaaaagggcttgtcattatgaccaaaatacttgagcccacttccttgtccaagtcctaaattttgcctgaagcctagttcttctgttccaccctaagactaaaattcctgccttaccctacttccctattacagcctaaagttagattcttgctgaaacttacttccttattatgccctaatgtcagattcctgcccgagcttacttccgatgtcagattcctgtctgaagcccatttccttgtccttggccaatgtcagactcctgccaagcggtacccaaaaggctttccacatatgaattggcttgtattttaaaaagtaattgcagtattgtaaaatcaaatcagtgtcattaatagattaaaatgtataataaaaatgttcccaatcttgaggatttcataaacctaatgttaagatgtctagtgaggaaagtgacactacgagatttcaattactttgtgttcagctctcttttaaacagtgatgtcattgacttttcatcagatgaaactttaactcaactgaatagacacaatttatttttttaaagagaaacaatgagtccatgtgtactttgattttgctttctgttttctatttgtgatttctatatgatgccttaaatttttaaaaatttttattggacattttctttatttacatttcaaatgttatcccctttcccagtttccctccctcccagaaacagcgtatcacatcctccctctccctgcttctatgagagtgttcctccacctatccaccaactcccacctccctggcctcaattctcctatactggggcatctatcaagccttcacaggaacaagggcctctcctcctattgatgcctgacaaggtcatcctctgctacatatgcagctggagccatgtgtactcctttgttgatgacttagtccctgggagctctgaggggtctggttggttgatactgttgttctatgtatgtgattgcaatccccttcagctcctcagtcctttctctaactcctctattgaggaccccttgctcagtccaatagttggctgtggataaccgcctctgtatttgtcaggctctggtagagcctctcaggagtcagctatatcaggctcctgtcagcatgtacttcttggcatccacaaatagtgtctgggattggtaactgtatctgggatgaatccccacttgggacaatctctggctggcctttccttcagtctctgctcaacactttatctccatatttgctcctgtgtgtattttgttctccttctaagaaggactgaagcacccacactttggtcttccttcttattgagcttcatgtggtctgtgaattgcatcctagtcatttgtagcttttgggctaatatcaacttatcagtgagtgcataccatgtatgttcttttgcaattggtttaactcagcatgatattttctagttctatccatttgcctaagaatttcatgaatgcatcgttttaatagctgagtagtactccactgtctaaatgtagcacttttaatgtatccattcttctgttgaaggacgtctgagttatttccagcttctggctattataaataaggctgctatgaacctagtggggcatgtgtccttattacatgttggagcatcttctgggtatgtccaattttctgaggaaccaccaaacttatttccagagtagttgtaccaacttacaattccaccagcaatggagcagtgttcctctttctccatatcctcaccagcatctgctgtcacctgtgtttttgatcctagccattctgattggtgtgaggtggaatctcagggttgttttgatttgcattttcctgatgactaacgatgttgaacatttctttaggtgcttctcagccattcagtattcctcagttgagaattctttgtttagctctctaccccatatttttttaaataaggttatttggttctttggagtctaacttcttgaattctttgtatacattgggtattaaccctctatgggatgtaggattggtaaagattttatcctattgacagtgtcctttgccttacagaagctttgcccttttatgaggtcccatttgttgattcttgatcttacagcataagccattgatgtcctattcaggaattttccccctgtgcccatgtgttcaaggatcttgcccatgttctcctctataagcttcagtctatctggctttatgcagggtccttgatccacttagacttgagctttgtacaaggagataagaatggatcaatattcatttttctacatgctgaccaccagttgaaccagcaccatttgttaaaaatgctgtcttttttccactggatggtttttgctcctttgttaaagatcaagtggccataggtgtgtgggttcatttctggatctccagttctatcccaatgatcttcctgcatgtctctgtaccaataccatggcgttttttgtgttttgttttttaatcactattgcactattgctctctaatacagcttgagatctgtgatggtgatttcccccagaagttcttttattattgaaagtagtttttgctatcttaggtttttttgttattctaaatgaatttgcaaattgctctttctttctttctttctttctttctttctttcttttttgttttttgtttgtttgtttgtttgtttgtttggtttttcaagacagggtttttctctgtatagccctggctgtcctggaactcactctgtagaccaggctggcctcaaactcagaaatcctctgcctcccaagtgctaggattaaaggcacacaccaccactgcctggccaaattgctctttctaactctatgaagaattggtttggaattttgatggggattgcattgaatctttagattgctttcagaaagatggccatttttactatattaatcctgccaatccatgagcatgggagatctttgttttccctttttgttattattgcatgatattacatggtttttgttttgttctgttttgttttgttttgtttgtttgtttgtttgtttgagacagggtttctctgtgtatgcctggctggctgtcctggaagtcactctgtagactaggctggcctcaaactcagaaatccacctacctctctgccttccaagggctgggcttaaaggtgtgcaccaccactgtctggctctacatgatttttaaaaacatttttgttttaggaatttaagagttttatatttagtttccatttacttttattccaaacttggaagatataatgtgtaattattttactatttctttgctctaggacattttatgattattcaacaactttattcgtgtgatatcaatacataataaggttcatatggatgttttcttatttttaacatctttattgaggtgatatcaatatataataatctacacataaataaaaacatgaaatttcatacttttatgcctttttaaaaattctgaaagtctaccttaatgttccatttctggcagctaaacagttttgcactggcctgcatctccagccctaacaattcttgatctaattgaaattatcagcacactttagtttccaaactttccccgtgggtttctggaagccatgcctcctggtataaccaccaatctgctttctgtcagtatgaactacttcacatttcctaggggttcatgtacatggaatgagacaatatggttgatcctttcattcccagttttcacttagtatagccatttttcttccattaattaattaattaattaattaattcactttacatctcaataacagcgctccctgtcatctgagttcccactaacatccatagctcctcccccaacccctcccagaaaaggtatcccccccccaatagcatttcaccctgatacattaagtcactaaaggattaaggacattgtctctctctgatgccaggcaaggtaacccagttaggggaatagggtccttgggtaggcattagagtcagggacagcccctgaccaagctgcacatttggtacatatatgttgggggtgatgctaggtctggctcatgctcgctctttggtggtttcatttgaagtacagctccccactcctcttttcccctcatctcattttgtggtcattttcttcttgtttgacattgattactgtcttggttagggttttactgctgtgaccagacaccatgaccaaggcaagtcttataaagaagagcatttaattggggctggcttacaggttcagaggttcagtccattatcctcattgtgggacacatggcagcatgtaggcaggcatggtgctggagaaggagctgagagttctacatcttcatctaaaggctgctagaatactgacttctaggcagctaggatgagggtcttcggcccactcccacagtgacacacctactccaacaaggccatacctcctaatagtgtcacacctccacatagttccagtccctgggctaagcatatgcaaaccatcacaattatgatttgttctttttgtagtttctgaggagagaagtattgtctgtgctttgaaacttacttctttttataatatcaacttaattgattaggtaaatatttgagtaaaatactttaggggcacaaaatgtagcaatgactactgagatacaagtcatttttataagggtgcttttagatatcttcaatattattcagtgaataccaatttggttacacaagtaaaggaggtgaaggctgttaaacttcctatttttgtatcaatgtagtctgaaaaatgactgagattcaaaattcaaaagttcaagttcacttataaaagccattctgtcatggacatgttgatttttatgtattcgtaccacttaacatttggccgtggctcactggtatttgccatatgttctgttagtggaaataaagacttggaaatcagggagattgtgagagttaaaatgatcccagagaatactaaggagtactgtagtaacaaagagaagcatgggtgttgtgtgcttggaaatatttaggacattagaagaggcttggtacagacagctgcaattgaaagcccagtcgatgtaggttaagttgaagaattaaacaaatttgtatcatagaaaacaaaagaggattggtattgcaaactttatttgccccaatacaggggaatgccggggccaagaagcgagagtaggtgggtaggggagcagcgcggagggagggtatagggaacttttgggatagcatttgaaatgtatataaagaaaatatctaataaaaataaataaataaataaataaataaataaataaataaataagaaaacaaaagagggagaaggtttcaagtaaagcactgtttaaagattgatgcaacagagtagtcaaatatgtatgtgcatcattggttcgaacaacttcagtgggaagatagatgagaggtacttgtaagatagtagagactggataatggtgacctatcccataactctgagtagagaaagatgtttgtgtataaaacgatggcattagtgaccaagctaatctctatagtccctttcttactatatggtatgaatctaaccatattttctattgtaatgtttaaaaggtaaatgtggaattaatgtattatttacatgaatttgaaaagaaagcatatttaaaagatctgactcttggagctacagagattgctcattagttaagaacactaactacttttccagaggtcttcatttcaatttccagcactcacatggcagctcacaatcatctattactgtcgtcccataggatctgttcctctttttgctgtgcagatgtacatgcagacaaaacatctatatacataaaatacataaataaataaatcatttttatgaattgaattctttgtgtttggttgaagggaggggtttatgagtgggtttgaaaggaagaatgagaacgggactctcaaaaattaaaaaaaaattaaaactaaataattttaaatctccatttctgtctcagcattttattcaactgtgaaaaatatgaatattcaaatttctttttctcttttcccaggagagactgtgcttgcctcaccatattttggaagagcgaggtcttgtgaaagttggtgtcacagttcaggccctccttgaattacctactacaaaggcatctcagctttctatggcttgatgtgacattacaaacattttatgtgtataatttcatgtatttgaagtgatttcagatatctaaaaaccatgaagaagaatgttcagtaaaaacagtttgccttaggattcttttttaaaatttcaataaaatatcagatataaactctgagtggtccaagcaatttttggaggaaaattggattaatttcataagagtttttgataaattaaaattctccttttattttgtgactcagtaaccttgaagaattttcaaaatgcaaattgatacaaaattgaagatatactttcaatttagcaatcacattaagttgaatattttttacatcactgtatactagtgaacatctaggtaaagtaatcatattttaggaaaacaatgctatatttgagttatttcatatacttctagcttataaacaatctcttcaatattttgtctttgtttcttagcaaaaaaatgagtagaaaaatcaaaaccctggcattattcaattctttagtattatcagttggtgccaaaatatttttcagttatactgtaggttgtttacatgtgaagtgcctgtgtaattgatgaatcttaaatagtcttaagcatttttgcaatttctttttatgtattaatagaatcaatggaatttttaaatattttggtaggttttgtatggtcagtagtaatgtgaggttttaaatgtccctcacattggtggtttcttagttaatccattgcagtttcccttgaattggttatttcatgttgtcaaaaaatgttaatatgcttaatttatgctatttaattttgcaaaaccgtaatcgtcgtttaaatcactttatctgaagagtattttatttctgtgttgagaacattacacaaagcagtaataaggctttggaaagctagggaagtactaattgtcaaggacatttggatgcaactgctacgtttgggttcttatctaaacttatttgaactttcagtacatcagtgctgccttccacattcagaaagcggccactaaaaaaacaggttttgattcaaaatctggccctttctggagcatgtataaaatatgatcctcaagtaacttgatgttgaatttaacacagtctggctcatggaatagtatgtttaattaagtccttccttgtttggagatggataaacttacggtgatactaatgcaggaatttttccaaaacattactgtgacgactaactcaatttcctataaaagagcctacatattcacttttgtatagccaagcaagtatcatttcttaactgtgtaattatttgcacttattacctcttaatatggatgcaacttagtaaaaacgttggtctaggatatttcaaagggcatttatgaagtgtaaaatgtcatgtgccaaatactatggtaaggattggttttaggaataaatcaacttttttgatcagtcattatgaaaccatacatttcaatcttggcttcagaatacagatatgtttttacattccccagaagtcaaattggaactattaaagagtcaaagctttttatactgtaagttttaagaattaaattattaataatttattatttaaatatttgatcaaattagttatgactaaatagttggatctgaaaatatccccaatggcattatgaatctccttagtgaaaatttggataatataggtaatttagtaagtaccttagttgatgaatttttaaccttgacagttgacagcattacaagtttaaaaacttttaacaaccaaaacaatcattcacacttctctcctggttattgtgctctacaattgcttctattacttaatcttgtattattttccaagtagttttgtgctttgttattattgaaatagttgtgtttttttttagacaattcttttactacatctcacttgtcagttaaatattaccttaaagagaaaacataccagaactttggtgttccttctttatagcaaatacaaattgttttcacgatgggtccccttgaggtccttgacacagcagttcaactattattgtgccaaaaggcagtaacaacatcacttctaaggcagtttttcagcacagtccacaatgacaaacatataccaaaaccctaacatatttctcttagtagtttttaagtgtaaattttatgcaatattgtttttatgacatatatttacttcatcaattattgttttaggaatcattatcattatttgggtggttttgtgatttgaggaggattgaataaacaatattttattgggcccaaaatatcattagatagctacttctgttaaactttatgaccatatggcacaagaaagaagtgatgttggatatgattgaactgaaatgagtaaaaatgcgtaaccatttgtttaataattatctttatagaatgctagattaatgacttttctaactgaattttttggagaattcagaaatgtttgtattagtcacagatttatcataattgattttctgatgcatttaaaaataaatggaacactaaatgtatattaccgatgcaaactgtggataaaattgaatgaaaaaaatctaa

SEQ ID NO: 619 - DNA, 45246 bp, mus musculus
  misc_feature (34240)..(34240): n is a, c, g, or t
ggggggcagggggtggggggaagacatggctggggctcggcgcggctggcggctggcgcccgttcgccgtggcgtctgcgggccccgggcgcgtccgctcatgcggcccctttggttgctcttcgcagtgagcttctttggctggaccggggctctggacggctccgggggaacgaccagagccatggacgaggagatcgtgtccgagaagcaggcggaggagagccatcggcaggacagcgccaacctgctcatcttcatcctgctgctcaccctcaccattctgacgatctggctcttcaagcaccgccgggcccgcttcctgcacgaaaccggccttgctatgatttatggcaagtgacttggacccctgtcccctagctggcacggtccctttctctgcttgccggttccttcacctcctgtcctggtcctgctcggcctacattctgctccccttctcatttcgttttccacctcgccttaaatcgtcctccgtttctctggctcacccccttttatttctgctacgccccccatttttcctatctcgttctcagcctcgcctccccattttgtctggctctccttgctgttttcgcctccgaccccaccccctttttctcagctccctgctgccccttctctgccttccaagttggggagcaggacgggtgggtgtagaggatgtgggaaagagagtcgggtgcggtggatgggatggggctgggggcggggaagacatctttgcaatctctgtctctggggtgtcagtttgtttaaggttcgttgaagctgcagtagtagctgtactgccagcatctggcattcatttggaaccagagtcgacctttacttattgcccagcttttgctatgccgcctttctaggtgcaaatgataaccttactcccgtgggacccacacaaactaaaaacctgaagtaggctacagaaggcttagggcattttaaatattgtcctcatttattatactacacctgatggggagccttagggttgaccctttggattcaggcttatgaaagtgaggactagtaagagttatggttcttccagccgcatgttacgtaccatatgatgagaattggccagccaagtggtaattacgaaccttcatgcatatgcatacgggtgacttgctgttggcatgaggttattgatcaattgctgtgtaaatgattttggttcttcattcactgtgttttcttttgaggttatttatctgtgtgtgtgtgtgtgtgtgtgtgtgtgtgtgtgttgggggagggacagatgatacatagggggtggggggcggagaaaaagagaaagagacagagagacagaggagaggaggcaaaacaaaaacaaaaacaaaaaaaccaacccatgggcttagaagccttttgaaccatttctctagtcttgtgaggggaaaagatcttgctgacagtctcatatctgcctaggagggtatggctgaagagatgagggtagacagacaatcctgtctgtgcagtgcatgtgtgacgattatcttcatttggtacagccttgaattactgagccagttgaggtttgtttctgagacttgaagatgggcatgcgaaggcttggaactaaaaggcgtttttttcatgcagcccccacccacccacttcaaggaaacccagacttctagaatgtgtgtgcatatcaagggtggcaataaaaggtagttgtgtggcttaagaaagtgcatggactcaggctcccattccatttgtaaggtaataaattctaagcatgaggactgtccctgtttgctaaaatgtcaaaaatgccattcaatttgtagtgccccttaaggctaatcggtcatacaagctatacatttcatctcctttctctgtgtgacactgtatgtgacttgtttactatcttcagcgaacatatactgggtagtttattattatatattatatacaggaactatagacatgcatataatggtatttgaactgtggttaagtgcaaaatgagccttatattgttaaaataagggcttgatcacagataagctctttcctattgagagaaatggtatgccatggtagttgatggtacgagacttcagaccagggactggcatatttaaagggctgattgtgagggtcatgaatattgcattttattctctttttttcctttttgaaaacttaaaaaaaaaagaagtaagaaaccaggatgtggagagaagaagaagggggcaagagcactggctactcttccagaggaccttagttcagttcctaaccccaacatagtggctcagaaccatctataactctagttccagggactctgatgcccatttctggactgtgggcagcacacacacagagagataaccagcatacatgtgagcaaaacatgccagccacacaaagtacaaatacatttaaattgtatgtctttaggcttttaaaaaaaatgtaaaagccattcccaactcttgagccatgtaaaaacagactgaggcctgaagctgcaaaccccttgagagtcagccccagatttctgttccacagagccagcaactctgtgtgattttagcaagcctccgctcatcttttcctcttacctttgtattgggaataaatgatgagaaaaacctttttgttagcctagttcttgactcctgagtaaatgctcagtaaatgatagctgttcctgttgctgttgtagctgtgtgttctcagggtcagaaaaggttttttgtttttttttttttcccttgcttagtcttacaagacacaaacagtatggcttttttaaaaaaaatcaaatagggactttggacgagcctgaaaatgtttgttctttgctatctcatgtctgaagtaagaaaacacaggattgctgatggccttttctaacacttctacaatgagagtgaatagtaccttagtagtaatattccatgagggaacaacaagggtatcacttgaaaaccatgagatgcaagagtgttagtctaggagtcaaccctgggattggcttggcattccacagcttgtcccactttctcatgagaaatgacaacgggctatggaacaattcctaactcccaaatccagctcccgactaaatgggattggaacgacgtgtttcaaaggttcagcaaactgaagaaaaaatgctatttatttaatagaaagttatctggtccttttccatagcccaggctagtcttaagtccatggcaaattctgtctctgcctcccaggggctaggatgacaagctttcatcggcatgcctaactcatttatccttgtaagaaacaagtgtaaaaaaccttaaagcactgctggaatgtgctggggtgtacacctgtgatcactgaactccggaacttgaggcaagaagattggaggctgtcatggtgtgcagagtgagaccctatctcaaaacgaacaaacaaaaagtgaacttaagtcacccgtgtggtcagtttctagattgtaactgagattaatagttgctctagttaaaagcactgactctgacatgtcgtatgggtatacaatggagaccagcgctcagcactgggtaccttcaccttgtttttttgagacggggttttccagtgaacctgcagcccatgggtgtggctagagtagctggccagcaaatcccatgggtctctctgtcctctacctctccagagctgggagtgtaggtgtgctctaatggaaccctgttggtacatgggcttgggggacccaaattcagaatctgcgtggcaagaactttgccaattgagccatctcccgaagccctgcaaacacagtgtcaaggcgcccacgtgttttgcttattggactagctttcttaagaagcttaaaagtgagtcactgttagtgaaaattgttgccatcgttaattaagtctgaaaagtgttcactcactgtgcttggacataagaagcaaatgacagaaaaaatatttgttttgccttggagaatcttacttagtcctaggataaactgttaattttgtcagtaaacatttattattaaatgtctgtgctatgtggcatatggtgagaaatgcatgttcatgccacattccttggcctcaaagtacttacagtctagtgacttaatagatagtgtttgctgggcagtgatggcacatgcctttaatcccagcacttgggaggcagaggcaggcagatttctgagttctaggacagccagggatatacagagaaaccctgcctcgaaaaacaacaaaacaaaacaacaacaacaaaaagatagtgtttattgaggattacagtgtgttagactttgtgtaattcacttttaaggaacatttcgtttaaacctcataactccatgatatgggtactctttactgtgtttctcatttacagacatggagattagtgctcagagaggttaactggtgagctgcttgatatcctaagtctagttaggattcaaaaagtctatctggttttaaagtcccgttttcttagccagtaaatcacaacagctgtcagtaaaagctttgactttctttgctatcttgaaattcaattagccattgccacagaattaacagtgttgttttaagagattttctttttatacatataaatatgttgtcttcatgaatatctgtgcatcacatatatgtactgccctcagaggctcaagacagcatcagaacccctgcggctggagttaaagatgactgtgatctgccatctgggtactgggaatcaaacctaggctctttgcctgagaagcaagtgcttttaagctgctgagccttctctccaggcttctctaacagcagttttgaaacaagttattaatgttttgatgaatgtatgcagacttttgctagggagccctgggcattgaacccaggacctcactcatgccagataagcatcctgccactgagctagaccttcatagatagccctttagtttttgttttaagacagggtctcactgagtgacctcaaacttgctctaattcttcctctgactcttgagtgctgggactatagaacaaacgcttctttatttaacttcattattattgtatggatatgtatgtttgcattatgagttgtgagtgctggcatgcttattccacagtgtacattgacggtaggaggataactttatagactgctttccagagactgaactcaggccattaggctcctgtggcagacatcttgcgggccacaaacacttcttctttttttttttttttttgagacaggatttctctgtatagctctggctgtcctggaactcactctgtagaccaggctggcctcgaactcagaaatccgcctgcctctgcctcccaagtgctggcattaaaggcgtgcacaccatgcccagctcacaaacacttcctaaggagtagaaatttttatcagttttgtctatacttaattcttcagtgatagtacttccatatttttgagctccagagttttcaggtgcaataggcaggaagactgggctggaatttctgagaaggcggtgttccattatctagagaagcagacagtagtgggcccaggttgtgctaaattccttatcacagggtgtgcttgcagcacaaacagatcatgaatgcatggtaggggtaggcttctgttttgtgaaaagtatctcttgttgcctgttattaatttaaattttataatatcagtatattctatgcctccatatgtgtaggatgctagaagtttctgctttatctcccggacaaagcactcttttgtgaccttcctctttactaagaattgttttaattccatgattaggatttgaccttttacagacttgaattttgttgatctgtcaacattttttcagagaaatttcaattttccagatgctgtaatgaaaggatctgtcttatttccagcataagtaattgttttgcatgatgttgtttttacttttccaaagtgtatgtttcaaatctattcaagtcctgggcctggatcagggcaccggatgtttcaacgtagcttcaggcatgcagaggagccagtgtatactgttccttgcattggaaagagtttatgcttctgtttaatatttatagtagctaaactgtgaggctttttcttaacatgtaaatgcaaaggggtaacttttactatgcctctccactgggaaatcttttgggataagagagaacaaagttatgatctacacagagggattatatggagacagcctttattccctcctaggttatatctatcaaggatggctgatatcctggcatggtgttcttccctatctttccctgtctatttctccttcttgttccccctctctttctctgtcccttttcctgctttctttctttcatcgtattgtggaggttatatagactcaagatctttctgccttacagatgtgctcaccacacccagttgtgtttgtacaactggtgtgtgtgtctgtgtctgtgtgtgtgtctgtgtgtggtgctggggtttgaactaggggctttccaccaagatgtacctaccagtccagtaggtacagagggttttaaagtgattcttcattttaggtcaggacattgaccaaaatatttttcaaattcatattgtgctgttccgcaaatcatcattgctgcttaccttaacaaatacacgtggtggttgggagttaactataaggacctgttttcttttctccctcccctttccctaccagctaagccttttacttcctcatggctttttccacttaattctttttatacaatatattttgatcatattttcctttagccaacacctcctagatgctcctcacctccctatccacccaacttcatgttctctcacttagaacaaaaacaaaacaaacgttaagacaaatgaacagtaaggtaaaaaataataaaataaacgacctcaaatgaaacatggagtctgttttgtgttgcttaactactcctgggcctggggcccggcctgggtgtagtcaatatactcagtgacactatattggagaaaccagattttccctttcctagtaggaataacctgcaaatagcttcatagttggggtgggactgtgtctccatctccccttctcagagctgggactttatctggtttgaacctatgcaggtcttgtggatgctgtcacagtctttatgagttagtatgtgtatcagttaattgtgtatacaagatgccattttcttagaatcatccactacctctggctcttacaatctttctgcgtcctcttctgcatagatccctgagcctttatgggcggggtttgatagagacatcccatttagggcttggtgctctaaagtctctcactctcttcatagtgtctacttgtggatccccatgttaatttccatctgctgcaagaagaagcctctctgatgaggactgagtcatttccttttcttcctgaatgcttagccaccacttctttctttcttctcagtcctaaggttttttctccttacattcattatcagttcctcagttcctattggcaccacaatgttggttgttagggatcaaacctagggcctacatctgtgcttccccccatactttttgctcccagatgattatctcatgcgtgtactaacttctaccactgattaccaagttggggctccctacttgcattctagactctgcacatcaaatttagcatgtttgaacttaaacttagggggctggagagatggctcagcagttaagagcatttgccgctcttccagaggtcctgagttcctgtgtcaggcttctcccaactgctgatactgctgctctaggtatccttcttttgtcttccatgggcacctgtgcctatgacaggcagattcatacataagaatcaaatcttttaaaaactaacttggcgttttcctccagtgaagccattctctctgacgtgttcccacttcattaaatgaccctgctttctacctgtctgctctggccaatgtaaccacctcattgacaagtccattaagactcctctagtctttcatttcattctccctagcctattctacttagccaccaaagctttctaaaacctactatcttccagccacccccccttctggcattattctcttacatgaggtccaaagctcttattgtctaatgactacagtgttcacctagacaaccatttagatcctttcaagtctagaccaatattttaaaatagaactataatgtcaagctcatactcaggactcatgatttctttttgctttaggacaataaagtccaagccccatccattctttaacacttgtggttgtttatgattcagttcctgcagcccttacaaatgtcactgcttgtcagctgctaatgtagccacactgaaacaccttgtgattctccttatcagtcttattgtgctatttcttgagtagatatatattctactatgtctatacctatttacttaggtgacattgctgaaaaaaaaaaagccctctacagtaccattcccttaaacttagttaactattctctgtatttagaacatcttgtgtgtgtgtgtgtgtgtgtgtgtgtgtgtgtgtgtatgtgttacataatgattattaaaattgccatttttgctaactggattgataagtctctgaaatggactgggttagcaatttatatcttaaatgaatggatggccagtcagaacaaaaggccataagaaggtaaaaatctatttagtactgtgactcttggccttaaggaaagttccagaaatatgagttcagtgtgtagttgaggtatatgcatataatagaatatcagtttgccatgcaaatggagttttgatacattctacatcaaaggtgaatgttcaaatattatactaagtgaaagaagctagacataaggggccatacatcataggattccatttatatgatgcctccactatatgtaaatctatagagatgaaaaagttgattattaactttcaagtgttggtgcttacagggctagacagttagcttagtcagtaaactactgtgaaggcataagaatttgagtttggcttcccagcacccaagtaaaagcaggcacagtggcatgtgtctctgagggagggcagagacaggcaggtccctggagctcaggctagccaaaatccgtgagttctaagctcagggaagaccctgtctcaaacaataaggtgaagcctgactgaggatgacacccaatgttaacctgtaccctctactaccacatgtccacatatgtgcatgcatgtatgtgtgcacacatatgtatatactcttttttttttaagttttaacttaaaaagggaccaaaattagagtttgtatataggggagtagggagtattgtaattttttggagcattgaaaatgctttggaaatagtggtgattgagttacactcgtgaatattcaatttgtgaatatactaaaggtcactgaatcatagaattcaaaaggataaattttctagcattagaattatgtctcaataaagctatccctaagcattgtagtttatcgctccaattttataaaacccagagaagtgattaaatctgcatatgtgtaggagtaaaacctctgtgctgattccacggaacagggatcagggccttttctttcacgtattgattttgatgtgggcattttacattttaatcctgacctttcagtggtagaagaattcagtaaatctacaaatagtatatatatttactttgccatttattaaatatatattatttgatcacctatgtgtatgtgctttgggaataaatacaaggagcatatatgtttgtctttttaactgatggatggggtttttagaaacgtacccttttatggtcttgggctcaaacccaaggagcggcgctaaagagagacattgctttttccttcttgcttgaaagcagggtctaatgtagctcagactgcccagtaactcactatgtagctcaggcaggcctggaacccagtctttcctcagtctcctgaatgctaggattataggtgggcaccaaattggccaggcttacaaagaacacatttccagagtgactacattttcagctcgacgacagttagagcataagctgtgtattgatgacttgaaagtatttcctcatttggttactttccttgtcagttatgaatatgatggcttagatatggagtggcctttactgttactctaaggcacgtttcccccccccccccccactggattacatgaagattggactcttcgacataggaattcagtaatacttcaaactgtgacagcaatttggtctgaaaattggttctgatccacgaaggactctcatcagaaaatttctgttcttaatctagagatatgtattgggtacaactaagcagtttctgtgaaaagagctgacggttctttcattttcaggtcttttggtaggcctcgtgcttcggtacggcattcatgttccaagcgatgtgaataatgtgactctgagctgtgaagtgcagtcaagtccaactaccttgttggtcaacgtcagtggaaaattttatgagtatacgctgaaaggagagattagctcacatgaactcaacaatgttcaagataatgaaatgcttaggaaggtaagttttcagttgagggggatgtttgggtttttaaaagctgtgtaaggagcaactaggtgaatcttcagaaaaagaactacctgttttgttgtgcttcttttaattttgaggcagcatcttgtgttgtgggctgccctggaatgggcgacagagaacaggctgacctggaatttgtagcaatcagtcctcctgcctctgcctccttagagttatacacatgtaccacgtacctctcccaggttgtgccaccatgcctagctgcaactttttataattaaaataataattaatttaaaatggaataaagcctgttaataaatgtaatgctctcaggagatagacctgattatattttattgtcatgattaaggctaagatctgtaactctttattttactgtgtgtgtaaggtttttataactgacactgtccaggacctgagttcagaagaatgcatacacacgttttcagtttacaaatggtcctattgctttagcacatcgagttcgtttagttctaccagtgattccaccaatgcttcactggattctttcatgccttgcttgtattcaagacaaatataatttcacctttctttgaagtcttgcacaacttctggggccctagtgagagcctcgggtattgtagcatgcttcccatgggagggtggcttgcagtctcaccagctctcatgattcctggctgttctactctttctcccccgaagcagtaccacttcacacatctgtctgttttcaccaccacccttcctgtcttctggttagttcgacttgatttttacagcctcttagttgtgtttctgttggtttaaaattttacaaactcaaagtgtactttaaaaccagagaatagcagccatggaaaatggccagtttcttaaaaactctagtaaatgctgctttgcgttcatagcagcttctcctgcagcctttagaacagaaggaggtcatctgcactgttagagcaagtaggatttaaaatgagtggagctgtgaggactggaaatgttgggttgtatagagagttttgactacagtattacgttatgtagctttagattccctgagtaccaactcggttttatttatcaacaatgagtataacctggaattctgtttctggatccaggcctctttttggataaagcaaaaaatatgtttatattttctctactttttaagatttttaaattttattttcttgagacaaagccatgctgtgttaatctagctgcctgttaatctgtagttcagggtgcctttgagctcacagcaattctcctgtctcagacctgtctcaaaatgcagcgattacaggtgtgtattattgtcttctgctaagaatttaatataatattttagcccggtttccatagaaactgagtaactgattattccagcattgtcatcctgtcactggaggaaaagaagaacaacagctctcctctattaaaaactattgtgtgtaaagcatgcaagaaccggatccctatctagaatattgacttttgagctagcatgtaggataatacatatgtgtcatatttggctgtagtttgtctccctcttctattgccctcttctgtgtcccctgtctcctctcatacatgatgtattcgactaccctctttttcctttccttacctttttctactttcatatcacacacatacatacatacatacatacacacacatacacacagacatacacaaagagaaaatttgcttaaggggaaaagaattgttaccaagtacatatcaatgagaatattaaaatctaggatatgtaaagaactaccaaaaaacacccctccaaatctatctggttaatgtgctaataaagtaaatagttaccaaaagaggaaataaaaatggccaataaaaagtgttcagcatcagagaaatggaaatgtatattcctacatgaagtgttttgaagttgacatagaaatgttcttgctgttgaccagtttaaccttgaatcccttccttttgatagtctgatgatgtaagtgagatattctgaaggaaatgatcgaaaagaactctgtgtcttaacaggttacttttgatccagaagtctttttcaacatactgcttcctcctatcatattttatgcagggtacagtctcaaaagggtgagtgctttcgcatttcctacactttgactggccttaactttcccgtgcttgacagctcttctgtttcccatgttcttcttggtacttagcatttcttccaggtttcctttcttttctccctgtcttcaaaatgttgaaattaatgccagtgtcagaatgctttccctgcatggcttcttctagagtatgatgcacttaatattagcagagaaaattgcactagagggatgttctttgtcacttgttggtggatattctaacagagcctaacttttcttttctttcttttttatcagagacatttcttccggaaccttgggtctatcttagcatatgcctttcttggaacagcaatttcttgtttcgttattgggtaagatttgaagcttggaatgcctttaagctttcagattataattctaaaagaacagccccgcaaaaaaaacagcatttgatttttctattactgtattctcaaatgtgcgggttttgtggtacttgtttgagttttacttaaacctaaagtattagctatatttaaatacccattattccaatccaggattaatcatagagtaccatagtagattacttttcttattcctcctttattctaacttctttcatagttggcatttttataatataggaatgtgtttattggacaggtccatcatgtatggctgtgtaaccctgatgaaggtgaccgggcagctcgcgggagatttttactttacagattgcttgctgtttggtgccattgtttcagccaccgacccaggtatgctttaggagtggagtggaactgtttcagttgcagggttccctgttaaagcccatgtggctgtttctctgaggtatggaaccaggactaggttctgcactagcactgtgctgtcctatggggagggaggcggtaaacgcttttcaggtctttttgctttaagcagatacttgctcatttggctttttcattacgataactgcttcacaaattgatgctattttgattacagctattaaatattttcctgagaaaactaaactggtctttatatctgtattagtcagggttccctagagtcacagaacttatggatagtctctatatagtaaaggaatttattgatgacttatagtcggcagcccaattcccaacaatggttcagtagcagctgtgaatggaagtccaaggatctagcagttactcagtctcacacagcaagcaggcaggcaaaggagcaagagtcccttcttccaatgttcttatattgtctctagcagaaggtatagcccagattaaaggtgtgttccaccacacctttaatcccggatgaccttgaacttggagatttaatcttctggaatccatagccactatgcctcaagatctccataccaagatccagatcagaaacttctatctccaggcctccagataagggtcactggtgagccttccaattctgaattgtagttcattccagatatagtcaagttgacaaccaggaatagccactgcaatatcctagtgattggatatagcaaaagaaaagttaggttatagtttttaaaattgattgtatacttatttttgcatttctagacagctatttctccaaaaattttctatttatatttaagtatctatatgttcaaataagaaaaataatttaggtttctttctttctttgttttttgagacagggtctcatgtagcccaggctgtcaaactggcctctaactcactaggtagctaaggctcactttgaacatgttctgagtgctgggattactggggtatgccagggtgtctggggatcgaacacgagcctgtgtacatcctcggcatgcactctactgtttttgttcttttgagacacagcttatctctcatctaggctggcctcaacctcacgacagtctgtatttcacctcagcattgcaatatgctatgatcaccagcgtgagccatcatgcctacctaagaaaagtcagtttaaaatggttgctgtacagcagctatgctgataggtgtatgctttagagaatttagcagtcttcagtatactaaagaattactttctataaaattggccttatgattatgaaacccttttattgacaaagcttgcttctttgttctttcagggtaaaatctctaagagtttgtatgagtgaatgaattggcttgctagataaaatttaaaattttgaatgtgtattgataaactaaaagctatatttaaatgaggaatttgtagaaaatttagaatgaaatgttcagagtagacatccagaatgtatgtagattcagtaagctcaacactaaaggaataagtaatccagtctttatgttctttgatggagtgattagatactcctcaaaaatgtacaaatggccaaaaaaagtttttaaagtgttaaacacttttagtgattggagaaatgaaaatcctaactgcaccgagattccatctcgcctgggtcaagaatgtctgtctgttatcaaggaaaccaatagaaacgtatgctggtgaggctgtgggggaggcatggacaaacttttgctggatgcagtagcttatgtctgcaattctagcatttgagaagctgaagcaggtgaattactgtgagtataaggatagtgtgggctacagaatgagatactacctcaagaaaaaagaatcttgtacactgtgaattagttcagccaccatggaaatcagtataggggctcctaaaaaactctctaaaactagaactactgtattacccagatatatcactctttaggcataaggaatataaatcagcatagcaaaaatacctgtactccgatgttcatcatagtactgttcatagtagcatactgtagaattaccatgggtagtcatctacaaaggaaataataaagaaagcattatatatatatatatatatatatatatatatatatatatacatacatatatacatatatatacatacatacatacatacatatacacacacatacacacacacattgatgcatacatatataccatggagttttgttattcataaagaatggagttatgtcatttccagaagtatgggtataactggaaatcacattaactgaagtaagccaaactagaatgacaaattgcacatatttccttttgcatgcaaagccaaaaataacaaaagaaatcaaaacatggaagtagacaggtaactatttggcaagagagagggcaccagctgattagggagatcaggaatggtagtaggctgaatagggtcaatgttcattgtatagatggatgaaaacatcatagtgaaacctattagcttatgacgttaacatgtggtcataaaagtagctgagaagaaagccagcataggaaccaacttaagggctttttaagggttttacttgtttggtgttgggagctttgcttgtggtaggcaagtgctgtgccactggcctctgtctctatcccctaaagacggagaacctgaggagtcaaagccttcttttattagtagttaggatttggtagaggtctgtactagttcaccctttgcccttgtaagttaatcatcctctttaattgtcatagggcacaattgaagtcggtgtcctcaggttatctttgaattccttccttaactttgataacccagggaatgatagagaggagaaagaatgtgttccatatgctatgagagataattctaaaagattactcagagctagctaggcacaatggtacaggcctataatctcagtgtttgaaagtggagtcaggtatttagagagcttgtggccagcctgtgctatctagtgggactgcttcgaaatgaataatttaaaagacaaaaagagtttccagagctccgtttcagacatttgcatagtgtaatttttatttcttgtactactgaggatatatagaatgtagggaatcacacactctaggcaagcccttcatgcttgagtccttttgatgctaattaatgaattaattaatgtggcattgggtatattcatggtgcacgtgttcctgtgggtatatgtatatgcgtgtgcgtgtgtttgtgtttgttcttccaccctttctcccttcattttggtgaggctggagcttaccagtgtccagagtggatggccagtgagctgcaggctttccctgtctcttgctccctcccactgagctagcaggcatacctctctgtgccttctccagtgggtgctgcagatttaaactgcggtcttcacgcttgcacgacacgcgctttatgagcttagccagcgccccactcccatctgtttgagttttgataaaggtccttgctaagaccccaaggttggcattcatctcactttgtatctattcctattaatttgcattatctttctagaagtttgaaccatgggttctctattcaaaatatgacagtatttttcactctcccctttactttctcttggtaaactttaacaaatcgttctcttggggatggagagatggctcagctgttaagagcactagctgctttttcagagagccaggctcagtccccagcactcacatggtggctcacaactgtccatttccaaaggatcctacaccctcttctgccttccaactgtaccaggcattcacatggtacacagacatacatacatgcaaacaaaacactcacacacataagataaaagctcccctaaatatttcttcttcagaatatttagaaagtttttctttattttatatatgggtgttttgcctgcatgtatgtctgtgtaccacatgtatgcctgggtgtctgaggaggccgaaagagggtgctgggtccccctggaactagagttagagtctgctttgagtctccatgaaggtactcagaactgaatcctggttccctggaagaacagccagggcagttagcactgagctcttgctctgccccccccccaggtttatgtatgtatatgtagacatagaacatatctgcgttttgatataagtgtactccattgttttgaacaatgtgttacccagcaaagaaagctacaatctagcttatcagtcttatctgaatttctaagaattctaatatgatctcttccccaaaggaagggtgtgttgtgctttctgtcctccttaccctagaatggcctgctagttggcttcttggtcagttaaatgcagcagctgttactctggtcataaacattgtgccaaccaaaaattgaagttgtgttttcactgcctaaggtctttactgaacttggtatgcatccagtttgcaagtcaaatagaagtgggttgtaaggcttcaaggaacaagggctccttacagaaagggacacttttcatgctttcttccttattaaagattaattgccagttagactacaaaaatgctgaatatactctttatagaaaataaatatacaaaaccagacttttcaaattgtaggccaactcaggccttcaaggttattttcagtttttttttttttttttttgagaaaggtggtgtaacatgtagccaattaggagcacatactgtcagaaaaactaaagctttaattcagtaggctattagaaaggaagaaatgattaaataacatccaacagctgtggagggatatgtgctgtgtttgtggtgtttaagtattcctctgattctttctctcttagtgactgttcttgccatcttccatgagcttcaagttgacgttgaactctacgctcttctcttcggggaaagtgtcctcaatgacgcggttgccatagtgctgtcctcgtgagtgtgcacttcattctatactgaatgctccatgcgcaaagccagctgctgagtacagcacattatggatagaaatattccaaacaatgagtctttctgccctgctctgagaggaatatatattttatggataaattggaaaatgaaagaaaaattatattcctgtcatataaaaatagttcctataaagataacaggacagttccttctactgtttttctgtttgtgatgtatttatataagagtcattttactgtctttaattttattatctgttttaacattataacatgaatacatttttacttaggcttaagttttgaattcaaaactacacaaaaaggtttgtatagaaattctgttcttattttactccttgattcctagctccttagagctgtttagtaaaaaagtttcttttatagctttgtatttcttaaaatccaatcacagacatgaatatattttatttgcctctcatttctgtttttgtttttaatttttggcagtttttgagagtgaacctattacagccttgtgcatgctaagcaagtaccccaccactgagctacatccccagccactcaattcttagttggaaagcactttactgtattgtatatgagatcatgggtatagtctggctatgttttcatgtcaaaggcaggtcttaggttttgcagctttgcaggattctctgtgaaccctactttagttctttgctctctcagtctcttgctgctggctacttaaagaactttcagtcctttgctatctcaaaggaagttgcagtatttgacctagagctgtcttcagtttgcacaggcatgggtatatggtagaatacattctcaggagtcactgagatttgtggttggtttaaaggataagtgcaaatttaagttttatttattattggcaaatcgctagtcaaaggattgtatcactttatacttgaaaccccacactacgggagtaactctttctttcgagctccccagtagattacatgcccagctttttttgagaaaatatattatagtttaattcatgtttctcttatttaccataatcatctgagaaacacctttatcttagatgtgttgaatatacttttagtgaggataattgttgaatgagtaatgcattttatctaataatagaaattgttgtacatgttaatacaaggcgtttgcaggcagaagagcttctgcacccccggggaactcacttttcactaaggacacatgcagtcatgtgggccgccaccttcatcttatactagaacttgtcatgagcaggaagagaaagcccttcacattttctcattatttaatttctctccttaacttctactttgttagctataaaagagtcgtaagtcacagactctgctttgcacagcctgactgccactgttaccttactatacagtgagaaattaccctttcagagaaatgacactaaccccttccatgaggtggatggcactgttttaaaggtcaaatccttttctgtgaatgctctatgtataagtgttgctgccttccctgctgtgtctattgccagaatattttataagttatataaacctaaattaagaaacaaaacctggggctggagagatggctcggcagttaagagcactgactgcttttgcagaggtcctgagttcaattcccagcaaccactggtggctcacaaccacctgtaatgggatctgatgaactcttctgctgtgtctaaagacagctatagtgtgttcatattcataaaaatattttttaaatcttaaaacaaagaaacaaaacctaatggctataactaatgttgatgttgatgctaaatgtaccttccatgaagataggtacaaaatagaagttctatattatgtgaaaggaagagtagatggatagtgtaattgtaatttaggcatttcagaaacatgaaatgataaataccattgaaacttctaatatatacatatatgagagacccatccccttcagtcctaaatggagagagtaaggcataaagaaagttattaacatcaatttggtatcctagacagttattgtactatttaatcatccaactgataaggagtcctttcttgttgctctaatgggttatgagtcaaaagaaaaaacaaactttgttctattctggtcctaccttaaaccgttgttcactgtgccttacattttccatcaataaaataacccattgcctgtaactttagcatatgagtagtgttaagaaaaacaaatacattgaaattatttgagctttagtgatgaagaaatgtgtttaaaagaaacggctttgtttcatggaagttctcacaaaggaccacatttctattgcagcctttctcaaattgggttttgaatcatttctttctgaactctctaaggatgaggcatgtctggtccccttttgaataggaattaggttaattcatgccatctctactgcagcgttcacagaaaagcactgtatctagagggtatcattgtaacaggggagcttttggttatggctgtgtcttgatggagctaacaagtgagctcctgccccaaaatgggagggaaagcagttgtgttgcttgtccatggggagttactagatggaggtactgagcagaccattgacagtcatcttgtattcacatttgatgtgtttcaaagggtgttaagtttactctgcttgaattgcattcccttagtttataattagttcataattgctgtttatattctgtaaggcaattttgtatcacaggtagggatcgaatgtctttatgagagaattaaagagattaaggcaactgtttagactgcatagaatgtattttggaccttgtttctgtttactgggagccagttctctccatctaccacatggattccagggatccaggtcatcaggcttggcagcagtgtctttatccactgagctgtctcctggactccaaggatatgtttctaaagtggaatttctaggccagtggctataactttttaaaaacagagagatattgtcttaattctttccagaatcagaggctgttttggaagccgctgattgacacatgaaaatacaggtagattcagcaatactctgtttctgtgaatggaacagaagggaatagtccaaagtatatgaaagtcacaaagggattcttctctaactatagaagcaaatatttggaacagtatttggttttgtttttatttttgtggtataagaatcaaaacacagcatccttttcatgtctttttgtattctaggcaagtgctgtgttactgaattttatccctaaaagcaacttttaaattatagtaatgggcaaatggttaaataaattatgctgctaatactgttttaaattattaaatatattgtttttgtaattcttgttacattgttcattgaagaagcacagttataaaccagaggctaggtatatagcagagttgttaggctgcttgcttagcttgcaagaagctcagggttcaatccctagttctgcagtaaaaccaggtatggtggtacacacctgtattcctagcacttggctggtagagaggcagaaagatcaggagttcaaggtcatcctcggctacatagtgagttcaaaaccagcctggcctacttatggaaccatgcctcataaagaattcaaagcaacatgcatgtaacaaaatgagaagatacatacagaaggataagacacatagagcagtagatggtggggtgatttttttcccttgagccatatgttatattggtattagaattttttgaaaagtgttcatgtaaatatttatgccttaagatgaaatgtttcctgatatggaaaaaatgagtttagattgcaagccagaggccagcatttgcctaaaacagaagacacaagcccattatcacgttttcatgtgttcttcattttgtgattaaagagtcaaatttaattaattttgattaatgtgaaactggaacctagactaatccaaagagagcaatctcagaaggtaaagaatccatgttttgtttgattcaatattttataaatattatcaaagaggatgaaggttgctgtagagaagaagtatgtcttactcctggcaaggtatgttttaacattacagagcatagtcatatcacacttacagtggtgggacttatgctgttaaaggccatttcatgtttgtcaaagcatagttccaaagtgatctggttactttcagcattgaaacacaaaaatatgtaaagatttcaattcagattgagtgtcagaaatttcttaatgttgttactagaaattgatgttgtgctttaataaaatagatactagttaggacatcatactgtgtggtcttaaatgaacagataaacatataacaagtggttttcatatctcccacgctaatttaatctgtgaactcattatttcttaggaatgtgtgttccttcctttcctttgagtggcttgaatctgtacttgtcatgaaactggtgcgttaattaactgaagtgagaactgattcagtaacagtaagcactgtcagcagagacctgctggcaagagtagttctcttgctcattgctgcttcctgagatgactgctataaaagaagctttttaagaccaggtctggactttgagttcaagacagagagtgtccctttgaattgtctggcttgctttggtaccgagtgactctttctgaagtgtaggctgtagggtcccacctgggtatgctcaaaatactccagagtggatcctaattccttggaaggccttttcagccccatttgtctaaatgggtaaatagtgataggcatttagtgattctgtcattttgaaagttggaaagatccttcattttcccataagaggaaccaaatacaatgtggttgagaataacctgtccttttgtagctcaatagtggcataccagccagcgggagacaacagccacacctttgacgttacagccatgttcaaatctattggaatcttccttgggatcttcagtggatcttttgcaatgggtgctgcaacaggcgtggtaacagctttaatatccttttgttgcatttatttttttcttattaacctaccaacgttgtttaatgaggcatggtttttcctattcccatgactagaattgtttttatagttattaaccttttaaccaagaaattcttctgaaaaatgaagcaaaagtctttgttaataagtcacctaatgaattttattgttttgcatgggctcagtgacttaaaacatgtatttcaggctggtcttgattttgctatggagctaaggatgcctgggaagttttgatcctcagaagcagagaacattgaatgccctagggctggaggtccaggtggttataagccacccttaaaactcagctaaggtcctttggaagaacagcaagtacccataaccactgagccatctctccagcttcatccaactagaaatcttttaagacactttcatgcaaaacagatgtgtgcttatttctgaatcctcttggtttgctaccctctggctttatgctggaagatactacatttttaataggtgaactttttactaggtgaactgagccataaagggcagtaaaagggttttggtgggaactggctcaggctgtatctcttctctggtacaagagccccagggctaggtgtttattatttattacagtgctcgttcatgaatcggctctagatctagtcttagatttattacaccttggcactgttacctatgtatgctttttttagattagtataagggagtggagtgcctcaatttcttcatcatggaatggatactttgtggtgcagataagctagaagatctaattactgtgaagttccatggtttttatgaatgcaaattattgtaataatggaaagggtcttgctttgggacacaagttaatagagtattgttacagtgtacctcagcctgatgctcctgtctctgtcgtttattatttatattctggcaaggcatgtcatacccataaatcaatgggaacacctaatttttgagatttttctcctgataggaggaaactccataagattttgttccaagaatttatcactggagcctctttattgtgtcttttacgttaaggaggccgaagagcccttccataactttcatgactctcttgggttgacttttatttttctagtcactgttgtgtattattatgcgatcttgttagcaagcttaacagtcttacgtgacaaagttcacaaagctgagagagttccagctgttggagacaggccttttcttcttgatgtcctggagcacctttcttctggctgaagcatggggtttcacaggtgggtgacttactttgcattttaagtccctgtgaggaatcacttagagaggcacttttccaagtggaccaacttctttagagtttgaacatacttgttatggttgggagtcagattagaggttcaaatgtaaaaaagactttcaatggaaacaattggttcctcccaacaaaataagtctaagtaaatgagaatgtctacactaaaaatggaatatccttctgtaaaataagatgcttaggatccagtttccctttctgtgaattggactttgctgtctttgcaggtgtggttgcagtattgttttgtggcatcacacaagcacattacacgtacaataatttgtctacagagtctcagcatagaacaaagcaggtaagaaaaactttataatcagcaaatgaaattttcctcctcttagcaaaatgaaagggtttttttttcaacttaaatatctgtgatcatttcaacatgatgtcttctcttctttgactctggaaatgactgggactgacaaggggcaggtagcagcttctagcgtagcagttagcagagaagccaggtgctgttactattgggcttctaaactagccagttggctccctcttctctttgtgtctccctaacccagtagctgctaagagcaccgatttgagggcccactctgacttgatcggagtttttcctgtacaatatagaaaaggttaatttcttactgggatctactaaactacgcagatactaagtgtcctgaagtctgcctcaggactgtcattgactgggcactgcatgagcaggctacttgaaaagaattctgaaggaattaggcactagacatatcattttccagtcttaagagatagaaaacaaattcacaaacaaaatgtaacgtctacaataggaacatgtgtatacatgagggctgtggtgagaaccaggaacttcccgttttgcagaaggctagaaggtacgttgagtctagaaaggctcaatgctaaagcaaaatagctctctttctctctctctccttcttccctctccctccctcccttcctcctcccttttctacttcctccttccctcctcttccccctcctgccccttgctctgtcctggagccacaaagctagtatactttccctaacactccagaggaagttaggctcccactctagagcatttatatggaggttacaaatctcttttgccaaataatttagtacattgaatgcacagaagaaaaatagctaggtcttgttttaggtagcaagatagggcataaaaagagcaagctaagagcttccaaccttgttggtgatttgaaactagcataaagaaaacacagacatgtatatgcatgcacaaacaaacacacacatacacagagcgtacgactgcttttgtgctaaactgcctataataggttgtggcatagaccttgtgcttgtaaaacctcaaatatttattctctggcagccactgggttttgccagcctctttgttcagagttattgctaagactctagatccgcaagagctctgaacactgattcttctatttcgtggctgtgtgatcaggaagaagttaaagaatttcttcgtgtttcagctttgtcctgactcataagattaaaatgtgatagtatgcatggagcctttacttagtactgtaatcaggcccacagtaaaagggaaagaaaccatacttattgccattaaacaagcaaataggaataagaatatagaaaataaatacttattttaatgttcattcttatttttggtagtaaacctactgtgcttttttgttaagttctggggatagaacccagggtctcttatttggtgggcaaatactctaccactgagctatatacccagacactccaactctctataaaaacattttgaaaagagtaaggtaggtgtgtggtgtgtatctataatagaaatacttgggaactggggagatggctcaggggtaaaagtacttgctgtgcaagtgtgcagacctgagttcaaatatccagaatgcatgtatatgttagatgcatgacatgagtgtctgtaatcccagtgctcctaaaagaagatgcgaagtagagacaagaaaatcctctgaagcctggcagtcagctagcctgctttccacagcataacaaaacaaaaaacaaacaaaaaaccagggctggtgagatggctcagtgggtaagagcacccgactgctcttccgaaggtccggagttcaaatcccagcaaccacatggtggctcacaaccatctgtaacaggatctgatgccctcttctggagtgtctgaagacaagtacagtgtacttacatataataaataaataaatcttaaaaaaaaaaagaaaataaaaaaaccagagatcctgtctcagacaagccaagggttaacactcaagattgactctgactttcacttgtgtgcagtaacacatgtgcctatattcatatacacaacacatatagacaaacacatggacttaggaattaggagcaggacaatctggagttcaaggccactgtaagctacatagtaagactgttctaagactttcctacaaacaaacaaacaaacaaaaaacaaaaaacaaactaaagcattaactaacttgttcaaagccatagagccagcaagtggggaaggtgtggtttaagcctaggcattcagactcctgggtgcaggttcttctatctctttcctattgtggtggggcagatgactcctgggaaagatcaaagaaatgtagagtttatggagggccttcgctttattagacagttcctgtactgttgctatagtaaccattaagtgaataaatgggctccagcaggcatcaggagggtgctgagtacatactatcctagagaaaccctgttaaagtttcggagtgttagtgagaaagtaaaggtgacaacacaccagtggtcatgcagcatcttctgccagggcagaagaagttgaactgtgttctctagcttataaaggtcatcatcttgaaactcattttaagagcaactcgctggttggagatgagaagtgggcatgaagggcttaccatttaggtttcaaatcacatttaaagtgatgaaagctaggctggggcattcaaaaagcaacgctgggtttggaggagcaggtaattgatgaacggaactgtgagaagggtgctgatgaaggaatgtgataccattacgtttctggctctttctgcgggtttggaaatgccacctctacatgtgagccatatgcttccagaagtatatatgagctgtacatatatgaaataaatgtctgttactcaggttgtcacagtgtgatgcttacttactggagccttttctatttcatttcagttgtttgagcttctcaattttttagcggagaatttcatcttttcctacatggggctgacgctgttcaccttccagaatcacgtctttaacccaacatttgtcgtaggagcattcgtatcctttatcatgtgtctgtttggagaccttcccgtggttttaagcatgtggttgataaaatattgcattgcagaaggttctttccgagaaataagtaaggatgccaatgttcttcccagttccattcttgtctttttttcctgctgtttccattcgaaatttattccacaaaaaaaatattggcagagtgaaatgatagaaaagtctcctactactttgccaacctcaaaggtaaaaatatttgtcttaagccagccatgcgccatgtaaactgtaatccccgtgaaggcgggaagaactgaactgagtctcaggctgtcatcaccaaccctgtctcaaagtcaaatttgaacatggagcagtggagcaacgtagggaagctgcttccctctgggcaagttctgacttccatctctagcacagcacaacggaaggaaccaacactctccagttcctaaaggagagcaagcttgagtttgggaagagttagagtctgtgccacagggcaatgtgtcagacgtgttcccacacttttctctgtttcctgtgaatgagcatttttaccttgaaagctaacttgaggggccagcaaagtagctctgagagtaaagatgattgctaccatggctggcagtcttaatttaattccttgggacccgtggggggaagttgaaaactgtctcctccacattggcttctgacctccatacttacgttgtggcatgagtaaataaatataataaagtaaataaaaagttaaaaccaacttggaaggaagaatctgagaacatgaaagacaacgtcatgacaagatgggttcaggtggcctctgaagtagaaaggaactggactctgatcatggtgacttctccagttgttgaaggaggtatggagagaaagtggagttccaagctaatggcttctattttcatcaagtaggaagtgatattacctgctgagaattgaatagcaaggtatacaagttatttattatgtaagagagatgatctagaaacttgctctttaccttacatggtctatgggggttaagaaccctgggctatcttagctgggtgactccaactccacagcctcacaggagcctgtagtgacatggttttctgctttgctgctgaggacttacctaggcctggaggagcggtgccaacctcagccacacggctgtccacagaaaggatcatctctctgcaggacctatccatgggagaagttttggcttgcatttcccagagtgagtgagtcaaaacagtccaagaatggaagccagggtgccttttatagagtaatgttggaggtgaatctcatgatcacttctgcagtattctgctggtcacacagaccaaccatggtacagcataagtagggattgcacaggctataagtcctatataacacaaggtaggggcattagggaccatcttgagggctggctccaatagttaggagtttggggaaaggtagaaagaaagtttttgaaatagtcacggaaaattcatagagagttgaccaaagaactgctgtatggttggacagcattaaatggtggccagtttaactttgaggaatagatacttacaaagataccaatcttccatgtccagtgtctttgtccaggaagacttagcagtaaacacagaaaacaaagaaacattgtgtcccttgaggtttgtggtttctttgagagagttcactggaaacacaaaagagcaaagcagatgtaggtttcaggaagagtgtttgtgtttaacacgtggagaagaagtagagtggaggaagaagggggctgagcatcagagagaggccagccagggagcacaatagttaaccctgaaatgtgtacccagacaatgagtgcttaactaagggattctcaaaagaatccagacagtgtgtgaaatctacattagaaagggagcttttactcaaatgccaatcttcagtttacagaaaaacaacaaatctcctgtcagtaagaggagccttaggcagaagacaagtgtgagttcaggagcttcagagctatttgaaagttttttatttattttttttaataatcccagttgtttatagtggttaatctacaaataaggttaaattggtcacaaggtttctgagtctgttaggatttaaaattgtcaataaagaaagaatctgtgaaaatgattctccacaggcccaagatgccctgtctctagtagcctgggttatatgacaacaattccaatgagcccaggtttaaatgagataaaagagacagaagtttatttcatatgtaaaagtctaagctcttgtgaccaggagaattgttaggaacgcaggcagtcttggtgctgttttccttagggagttggctgcgttcttgtggttcgtggcatctgacccttgtgcttcctaaattacctctaagggcactacctagaagtgtacataccacttgtacataacaacgttggcaacagctacctacaagggaagcttagaatcgtactctttatctgggtggctgagttctccagaatctgagctaaaagggaggagggtcttgtacttagaagacaggacggggtacgggctaaaaaaaagctagcagcgctgccacctgcctcccatgtgttaactgctgccagtaccttctcttttttccttaatggagttgcttttgaggaaaaatgtcattttactccattttatatttacaaaaggaataatgaagatagtacagaaagctgtcctacacttcacagcccatgcccccaggctgtgaagaacatcacattattgatgttcgattcaggtgtttatttatagcattgtttatatattatttatatgaatagtagttattatttcatataccagattatttacaacattttaaagagctttagtgttgtagcattagctatcaggagcttgttcggtagaaccctgcttccatttgatgccttgtcatcgtggtctgggaatgtttttaacacttcctcactttctggaactacaaagtgcttctgttcatctcatgcactttccactgtagcccaagaactctccatttctccaaggatctctggtttctttaattgggaaaaatggtattggaaagcaagatctggtccttgggtgtgtttaggacactgggtattctttcttccacactgtgttcatggacagaggaaggtacatagtacatcatgtgcatacacacatgtctctaagcatttctgtttgtaactgtctgaatctcccatcatgagtttgtactgctatctccaactgtaacctattgctgttaatcagccaaccatctttccttgttggtctgtacatttctgtcccgccataaagaactcgactgctggtacttccatccaattatttagttgtttagttgcagtatatgtcatatgctgcttaaaggtagggatatatttgagaaaatgtgttgtcaggcagttttgtcattgtgtaagtatcatatttacataaacctccatgatataaatcagttattgaaagaagcttattgattcagttaggtcacttgataaacataagatatacagggctgttgctggcgtaacagcattgtttcacagtaaaatattttttacacatgtcacgaagatacatgtggatgtcagaggacagctttcgagactcagttctctccttccactgtgtgggtcccaggaagtgacctaaggttttcaggcttagcagcaaacacctctatctactgagccatctcctttgcccaaactttttgtttgataagtagaacaaatgcactaaaataatgacagaaagtataatatagtaaacatgtaaaccaatgtaacagtcccttattaccagattttatgtgttgctcttatatatgagtgacaggacagtaagtagatctgtttgtgccagtatcagcatagacacatgaatgccattgtgatgtcattaggcaaaaagaacctttagctccattataattagatgggactaccatgatgtgagcactctttctttccataaattcttatgcggtacatggctacatgagaacgctagtattgctaattactatttccttggaaatcaactccatcagtccatatatcacttttctctcttcttggtttttcatttgctatttttcagatggggtctcatgtagcctaggctagcttcaaacttcctcttcagccaaggccaactttgcattcctttcctcctgcttctacttctaatgcccagctaatgagtatataattcttacatgcagttcctttgcctttggccttaacaacggcactctccttgaatactttttacatcagcactgtttagactatgatgctttgctttgaatattacatttccctttctactcctttcaggaaatgtagggttggcactgcaaaccctgcagtaaaatttactgctacaaagcacaggtttctgtagaaaaagacaccaaaactgtttcttagtgaagacccatctgaactgacatgaaaactaaacttttttgcaggttggaagtgtacatttcgtgagagccagctaggctctgcaggaattgcagcagcatggagtggccgagctgcccttttcttgtattattagaaaggaagaggacagttagccagcattccccttcatcctctcaacgctgcagtggaagtgaatgagtttgtgatgttgtaatggagaaggtccacttttatacactcctttgttcactacatgaatttcctgcatgcttgacatgcactatcaagtttggtagcaactacccatatggtgattatttcaattcaagtgccagttggtcagtcatactgacagtattccaggtgctgtgtagatatgataaacagagtgcttgctcaccatcttgaatgtatagattaaatttacattggtaaaggaaatgatccttaacctcttgatgattttagattgctattttcttgggaagagctgccaatatttatcccttgtctctcttacttaatttgggtagaagaagtaagattggatcaaattttcaacacatgatgatgtttgctggtaagtttcaatttcctgttgtgtctacctttcagtctaccatttggaagagtcagaaacactgaaactgcatcctcaaatagaaaattcttcctatcttctcccgttgctttctgtaggaacttttcaaatgctgcttctttggttacaaattatgtcacactaagtaaagaagttaaagatgaatacattttgacagaaaaacctgtaaatgaatattgatagcagttctagccataatggctaaaaccctgaaaaataacttacttgtttttctattcagtcctgggattgaacctagtaacctaacccatgcataccaagcaaaaaaatctaccattaagatatctatatcgggactggagagatggctcagcgggtaagagcactgactgctcttccagaggtcctgagttcaaaccccagcaaccacatggtggctcacaaccatctgtaatgagatctgatgccctcttctggtgtgtctgaagacagctacagtgtactcatataaataaagtaaataaatctttttttaaaaagatatctatatcaatatcacctatatttatatttctcagcctctcgcctttanaaaacattttgctttgttgtggttgctgctggttttttttcgagacaaggtttttctaggtagccctgactatcctgaagctttgtagaccaggctgacctcaaatttcacaaagatctgcctgcctctgcttttcaagtgctgggattaaaggcacatgccaccactgcccagcaacattttgctttttaacatggggtctaagttgttcagacttacactatagttcaaacaagctttgaatttatttgtgactctcctgcctcagcttcccatgtaattgggattttagagatctgtaccaccagacctggcatttgtctgtatttcaatggggaaatggggcagggaaggacctgataaatctgtgctgtggaaaaagcactaaataataaaaacaaacatttactcacatagtggcatggatgagtctcagaagtgttatgttaaatgaaagaagccagccttaaaacttctatgtatgattccattgataacattttttttcattttttattaggtatttagctcatttacatttccaatgctataccaaaagtcccccataccatcccccccactcccctacccacccactccccctttttggccctggcgttcccctgtactggggcatataaagtttgcatgtccaatgggcctctctttccagtgatggccgactaggccatcttttgatacatatgcagctagagacaagagctctggagtactggttagttcataatgttgttccacctatagggttgcagatccctttagctccttgggttctttctctagctcctccattgggagccctgtgatccatccattagctgactgtgagcatccacttctgtgtttgctaggccctggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatattttttaaaaagatcaaataatagtgatggagagcaggttagggtgatgaagaggttgggctaacaggcagcacaaagtagtttgcacaggaagagcaaaatgctcattcttgattgtggcagtggtcacacccttctatgcatcatcaaaactgtagaaactgaattcactatacataaattactaaatggtaaagagtttttagagatcaaggtatgtgtggtagcagatccatgtactcccagcacttgggtcactaatgcgtgaggactgtgaaattgagaacggcctgggccacattagtaaaaccctgtctgaaaaaaaccaaccagtgaaagtcagtattatatgctaaatctgctgatcattctttatgtatatcagtatttatttcatattttctatatgtttccaagtattgaggttatgttttatatctctagagcttatatagcctgcaccagtgatgagttattgaagatgcacttgtattccctgtaggtcttcgtggtgcaatggcatttgccttggccattcgagatactgccacttatgcacgacaaatgatgttcagcaccacacttctgatcgtgttttttactgtgtgggtatttggtggtggcaccactgccatgctgtcatgcctgcatataaggtaagtaggaacaggggacctcatctccatattccgttctgattcagtttacttttattttttgtcatgagaagattttaagctttggaaaaaaacttcaaaagtgcaaaacaagatatagaaaaaaattaaactgcaagtaaaagaaatggagagccttgctcccactctgaaagggcagccctctggacattttacacatcttaggaaatgggcaacactaacgtgctcttactggttttgaaatgtggtagtagaagaaaatttattatagcatgtgcatttgcactggtaaatatcttcatattatttgaacagctgtatgtatcttagctaatttaatcaaatttttgttgtggtagtgttatattgattttaggctttggctatttccatttgcatctgagggtttttgctattgctattactattactaaacaactgaatgctctgaagccagtgtgccaccatgttcctgtttaattcttcctttaggatgcatttcctgaagtggaattgattgctccataagctatgcatgtatttaaggtttttggtcaggttaccaggtccagtccattggcagtgtgtgagtccagtttaccccagatctaatggataccagacaatattgttccttttcatcgttctgatcagcacagtttctaacctaacaaaccaaccaaggccaaaatcctgcagtcatgatcttcagtgtgtcttgcttaatgtattcagtttgaaagctctcttgtatctcaagagttctgcctttgtttccatggatacagcagccagggtctgaagcctttgtggattgtagttctgtgtttgactgaaacttcataggtattaagagctactgagcttccagtctcattttgaaaaacagtgtctcacctattagagaatctgttatctgtttctttaacttatgccttttatcattgcaaagagaagctagccgtcatttacacagaaaatgttgttaatgtcttaatatttctttaatattcaaataccttgtgatttttgtgctatttctgtgtgtagtagataacatagtgcagcatgtatacttttatacatccagtaatgttcttataacgctacttattacttgtagaaggacttgacatttattaaacacctactatgtgccaggcattccattctatgtgtttaatatgtttatctaatcatagtaactgttttacaataggctttaaaaagttgtaagttgttcaatatcatgctgataattgaatagtacacagagaaacctatgctcttagttccttcagagaccatggtacatcaagaaatgagtgtgatacatgttgaaaggactaaccttcttttttctaaagtttgtaactgaagacacttccagaaagagtgaatcagattgtgaaacagcctagaaaaagtgctcagtcagttgtgtttccctcgctgtcttctacgcagagcaaacaaggcctcctgctctctcatccaaccccatccctgttcacactgacttttgtctacatcactagatttcagagctctttggatggtccttacctgcctggcagcaacattggaggcttacttatacccactgccgttgtgtcttgtcttatgagtatgactaggtttcttgtcttattgcagtgccttggcttgtttgtgaataagctctatgttaattttaaatatgtcctgattaatagaagtacatctctttcctccatctagcccctcccatgtccttccaccctcaagtaaactgtatattttgagagtcctcactggtgcttctgggtttttttgttttttgttttttttaagattcatttatttattttatttattgcgtacactgttgctgtcttcagacacaccagaagagggcatcagatcccattacagatagttgtgagtcaccatgtggttgctgggaattgaactcaggacctctggaagagcagtcaatgctcttaactactgagccatctctccagcgccctgatacttctttgaatgcagtaaagactagcatgtcaaacagttgtgagacatatagtcttaatttttacagttcagttcacattattgttttatttttttctaaatacatgttggcttaaaatattatcacatttactcaatagttatatcacaaatattcaattttctctattttaactgttagtaaattcttagtaatcagcataaatagtgaatgtcagtattttgtggcttttactattgctataattattattagttacctttatattgtcagttaaagcctaaatagttggattttccttcctagctctatttgggagtaaaggtaaaggctatagtttaagcatctttcctgcccctacatttttcagttaaactttgaagaagtgcctaatgagttgggactaccgaagattcatgtacatccaaacttaacctttgcattcttgatctttccttcttccttggtttctacatctgcagcatgacacctatgtcccagagttgcgaggatttggtgagctagcatcagcaaagctctttgcacaatatttcaagtaatatttactgagcactcgctatttggtggagcctccaacccactggtttttagcagattattttgtatccgcagggaactatttgacaacatattgaagtttttggggtttttttgttttgttttgtttttttcttttgatggtcataactaggagaaaggactgccattactatgtagtaggcagaggccagtatcctattaaacatcctacagggcactgaataggctactatctagacctgcaattaaagaattatctggtccaaaatgctggtagtgctaaaatgaaataaccttattcaaaaggacggtggcagtaaaagatagagaagttctttgttacagttagtgggtaaagtgataatacactagttaataaatgagcatgacagttttagatgatactacatgtgacagaaatgaagatgctggaacagtgcctgggaatggggtatatataatatgaagaagccaggcaaggtctctcagagaggttatatttgaactcagtctgcctgagtggcaagaccctgccagttcaacaatgaccaggaagagcagtccaaacagagggaaaaatcagtagcaaagacctgaaggcaggagcagattcggcctgtttgacacagagaaaagcttgcatgatgagagtgatcaaattggtaagtagaaaaacatgtagaccagacccaaagggatcaggattctgaaaactacccatgaaggaccagtagcaaaaccttttgacttccctagatctttgttacagctccccagatctgggtgatatggggccacatagtatggtcgtgtaccaacaagaccttatttaccactgggtgtgtgtgagagttatggtatcacttctgatgtagggttttgtaggatatagcaaagactttgggttggaaaattcagtggggattttgaagataataaagcaagagaaagacatggtctaatttctagtgtaaaaagatcatgtcccccgtcttagaagcatcagatccccagtgagttaatcagcttgcatcctttcacatgtgtgacagtcacacttggctccctatcatttagctagcacacatgctttgcatttctttgttgctgagcctttgcttggcctgggattctctttcattctcaagaactgacactactacccttccccctccccgattcttttttcttggagttgctgtgtagcattgggtctgtccatcacagcaattagcccattcatccttgtaatccaatattgctagaagagctacctaccacttagcgctagtgatgcatcaagcactttaaacgttttcagtacattgttctcatttaatccttgcaggaacactttgtgctgatactagatgcattgttcttaggaccacatagaatgactgaactgacatagctagctggaaattatcctggagaagtcccgacactatcctgccttaacggcaaactcttttgtgtctgctgtagttgggtctgtttctccactagtctgtgagccccttgagaacagggaccatgtttaattcatgtctatgccctgtgcctagcacagtgcctggcaaataataagtgttctgtaaatgtttattaatactggttttggataaagtgcgattttaatgttctaagtgttctatcatcttgaccactaggtgtcacttgagatgcataaatgtggttagagtccaatgtgactggaaagctattaaacagtttctggacatttttaacaagtgagcctttgtttgagctttgaatctggtctcggccacctgttttcagatacttgaccatgactccctcaccttccagatgtggtgttgtagcatcttcctcttttgagtgttgtctttgcagatgttgcagatgttgcttcttgtacttgtgtgttgcctgtgctgtctgtagttggtaaccgaatcaatacacatttgagcacctactgtgtgtcaggtactatgctagactctggggatacagagatgaattgacacatggcctttaccctcaagaagctcacagtctttttggggagacggacaggtaaataattatactgtactgtgatgtattttgtaataaagaactgagaaagggctgcagaagcataaagggaggtgattctgtgtagacatggcatagagcagttactttggcacttgacaagggagtagaaaggtgagaggacacacattgccacctaagggaatgagtggcatgagccagaacagtattgactcttgaagttgccaaaggtatggggaaaggagtgtgttatagaatgactgtcagtgggggggtggggcaaggtaggctggagtaaggggtggctactagtgtgtcgagaagtttgagtcctccaaaggactttcgacttaaaaggtttaaggattgtgagctgttctcagaagcttctgtgaaacagtgacctgaagagttccatgcctggcagctggaaaggcttactcaacagaacccatgagtcagaacggaggctggaacagcagggacagatgacgaggagagacctgacaggcaggggaggggaaagaacagagctggcaggtcttaaactagagaagagactcagagctacctaatgaacttgttccctggaatgtccaaagaaggaatttgatgtaggtacacgtgttctgaggaaccaagactaaatgcccatccagtcaggggaccctgcagtccccctggaaccgaaccctcttctgtcatcctaacaatgtcaccatgagagcagtatgccagctttgtttgcgaaactttctaatcattcttactgagcaactggggcagtgttcctctcccccactgctttcaggagaagtgctattgtactggaactggtaagtgaggttctaggactagaatacctgccctgcttgccttagacccaaagctcttgctaaagaaagcggcaggcgccagagaagagagagaacagtgaccattctggagcttctgtgttgagaaaagtatttgcccgacactgtatatatgtggggagaccttccattggatcaaaaatctcatttgctctttgtgtttttcctttagggttggtgttgattcagaccaagaacatttggtaaatatgcacttgtgttgtccctggcatttctgtccaatgttcagtcttttggaaagaaaactgtctctcttagacttcatgcctcttttttgatactcttttgtttgcctcggcttttagctgacatcatttctggcgtttctcactgttccatagaaacagagtcatagtttaggctgtaagtggctatcaagggtgacagcttgcctatctgtggccatcctgggtttctgccactgaggagaataggctcttaagtgctcctgggtgttcaagtgagtgctctggcacggggagcctttttccactctggttgcgcaggaaggctgggctctgatgtcagtccgctccagctgctcttcctgtgtaactttcaagttggatgaccagcagctgcccttgagaaccgccttgaagcttcgcttctgagtctccagctggtctcccctgcatgttttggggtttacactctcttaccctaggccttttcaacacagctcctcacttccttccttttgtgtttctcagctgtgagctgcagacttgtggactgggcacagcaaagctgtctgtcctcatgagactgaccacccttttctggtattttccaccctctttttaatggtttctgagcaccacagaataagtgattccctattacatattagatgagaaatcacatacgaggtttttgaaaatggaaaataccttttgaaacataattcctattgtttcctgaaacatggcatggcatattttttctacagtgtgtgctttaaatgaaaacatttactcaattcacttcctaaatgctaattttgagtgatgactgtgtgcatgtgtctgtctgtatatatgtgatatagtaagtagttgcctgttttgtggttagaatcttaaagtagaattccttgggcaaaccagattatgtacaccctcatccttgtaagcttctgggataggtccaagggctcctagtgtttcagtgcctctgcctctgtcataaaacactacattgacacagccctgttacccttgtcaccacagaggacaaatatggaaagaggcagataggtgactgccagttgtggtaaacagaaagaagtatatttctatttgctttcagagccccatggacagatgttagcaaggtagtccagtgagcttgctagaaaagcctgacaccctgactctgatcccttgaacccatgtaaaggtagaatgaaagaagtggctccacagagttgttctcaagacacacacacacacacacacacacacacacacacacacacgggagggggggtggagagggaataaataaatacaattaaaatataaagcccttcggacatccaattatattgtttactcagtaatgcttattatgtcccttatgaagcttgaggaagattctagtccatatggagcttaggagtacacagtaattaaatggtaagatctgaagattatttgctttacaaaaagtgaaagcagggccaacgcaatggctcagtgagtaaaagagcttgccgatcaagtctgatgagctaggttcagtccctggaacccatgctggaaaaagacagcccctaatatacagcacagcagcagcactaataaaaggtagtgctactaatgatgatgaaactaaaacaaagtgaagggggctggaaagatggctcagcagttaagagcactgactgttcttgcagaggtcctgagttcaattcccagcaaccacttggtgactcacagccatctgtaatgggatctgaatacactcttctcatgtgtctgaagacagctgcagtatactcatatacattaaataactaaatctaaaaaaaaaaggaaaaaatttgaaatggggcagtttcatggtagaatgtatagttagtttacatgaggtcctggttccagcctcagcatcaaaaattaaacaagaaataagtgaaggcatgagaaacttaagcaagtataggcaagttcaggagttcttttgtgcttgtgagtgcatgtgatgttctcagatatttttatagtttttagagtatgtgttgacccatgttgaagcaaaaagtaaactatttgagaaatagagagaacaggaaaaagacaaaactcagactctacattttgtgcccttagaaaaatcacaaaaccatggaacattagttctggaaagggccttggagaatttgtaacagttgtattttatacatgaagaaattcaggcctagaaaatgaaggaggtttgcccaaactagttaatgtcagtgagccaggactggagctagataggctgactgcctgactactgagcataccgtgttacaaataaggacagttcagatttttgaaaactattttagaagctgcctgcttgctgtgttagtttctcccctggctagtgagttctaccatagcattttcttgtcttcattttgacactatgttctgcatgtagtagcaactttgataatgccatttatttctgaagtccgtgacacagctcttaacagatagggtgagatgttttcttctatacatgccactgcatgggtggtggaagtcagatggagggggtgaattaacccatactggcttttctttatatatgtgtgtgtatttctgtgtgtgtctatgtgtgtgtgtggcatgcgtgtgccatagtacatgtagtgatcagagaaacctttggtagaataaaataggacctctttgatgttgatcactgtgtacaccaggctagctggtctgtgagcctccagagagtctcctgtcttcactccctacctgcctcattatgttagcattcgagttgcaagaattgttgctatgcctgacttcatgtgggttctgaggattggaacttgggtcttcatgtttgtatggcaagtacttttctcatagagccatcttcttaggccccacattgattttttataataattttataattatatatcatttccccactttgcttttttccctccaacctctctgatataccctccctcctttctctctgtctcaaatttatagccctcttttctttaactgaccccacattgactcttaagtggtaatagagtcataagttggcaagccacctgagtcacagagatactttggaaaccatttcagtttcctacaccaaacctgcagtatacaagtccttggttttctaatgttgcctatgttagacactatctttcgtgaagtctctacttctgattgtacagaggagtggctctaaataagcctgtctgcatctttggtattgactggtgtatcatctgtctgcagggtgttcctgacaacgaaaggagaaccaccaaagcagagagtgcctggctctttcggatgtggtacaacttcgatcataagtatccttaaagataaaacatgatagt

SEQ ID NO: 620 - DNA, 123315 bp, mus musculus
cgcgggcgtatctgtgggggctgtcccctctggttctcggtgtcccgcccctgatccatcctgttggaaactaggcggggacgtgggtgtacatccactccgagcggagttgctcaactctcagtagctgaggtcagaagtgctctgcagccagagtcttgaaatctctgcaagtttctgggctccctgtcctggggcttgttggtcccagctagggggctctagtcttctaagccactgagctgcgtagactgcgacccttctggccgcgtctgtgcttgcacagacgggctgctagcgagccagagtccggcagtggccagttgaggttggggtcaccaactagcgagtctggcttgaggatggcggaagcagggccccctccagcaaggttccctccagcaaggctccctccagcagggtcctctcgggctgggctccctccaacagggtcccctcccgcttccactccggccctggcctcgcagtggctggcggtcaagcgtttgcctagggctgccgccaaggcgcccaatctccagctgaatcaggaccactgttctttcgtgccgttcacgcaggcggtcccggtgcaggtggacatggccatggccctgcatcgcgttaggatcgcggagaagtacgggaagaactacctctgcttgctgcaggcagtcttcctagcaggtgagtaccacatccctgtgcactcccactcagttgcctggaacactgggctctctcccctcttcccggctccctcctcaacctgttcgggtaggggatgtctggtgcactttgtcttctctgctctctctctctcaatcaacctctctctctctctctctctctctctctctctctctctctctctctctctctctctctccctccgtctctgtctcactctctctttctccctctcctttccctgcccccattcactccataatccaccccccctgctgtggcactcctagtttagagccgcccagactgtggacctcagttcctcaggccagctgccactctgaggatgtgtgtggctctctgctcagctcaagccccgcaggtggacccccagaagcccgccatgcaaggtgagactgttccaggtctcttcctcacttcccaccaccacccacctggatgcctcttggtggagttgggaatgttaagggaggaatcttcctacaccgcattctgtaccctagagcggaaccttgctgaggaggaggatgcagatgcacttccctgtaacactccctgtagtttttaaagcgaggtttatttacttgtgtgggtggttgctgtttgtttcacgtacgcgtgctagggccaagtcaaaaaggcgcttggattctgaaagccgcgggcctgaagttggaggaggagtttgcaggcaaactgcggtcaagaatttgggttttctcactaggaccgccacttctttccagcctggtcctatgagcttcctgtcttccttcagctcttactacaaaggcgaaaggctctttcttacttgccttggagggacaaaaccaaagctaacaaatgtcttaactgctgccactgttttggtaaaaagcttaagagtagtgagaggcggcacttgatgtatacatattgagctagtcggagttgcttggctttggactcttggtgtaccgtgaagcatgcagaggctcctaaaatttaaagttcctctaataccattagcagtccaggaatatccgccaggtgctgcagctctggccatgtcttttgtgcgtctgtggtgcttgcttaccctgcggtgttccttgtaatgggaatttgggaattaaaaactagacatggtgtagtttttcttttctcaaatcaggtagccacagtgtgtgttccaaattcctcttcttgtttgaggctgtccacgaattggaaggaggtcacgtcgatgacttcggttaaaccacaggaaacccagggctctgtctaaagcttggtaacaaagaaccctttggtcttgagtattttgtttggaagcggtcaatgttattttctgtatgtaataataaatcattaagggaagtgtgggagtggggcacacactttttcagggtttcagggcagtttaaatggatgtgggaggcaaaaaaaaaaaaaaaaaaaaaaaggaagcctgtgcacaagtcgtgtgcagtgggggctaaagatcaacttcgtagaaaaaaaacacataaaaaatgaaacagtctcactttgtagctcaggaccagctccaaataatcctcagtgctgagagggcataggtacatcctcatgtctaccaccactcataacacataggcactcacatgtacacacacacacacacacacacacacacacacacacacttgtatggatacgagagaatgaggtgttctggggcctgtgtgttggatgctaggcaaatgctctacctctaagttacaatcctggtgggaaaatgccacaaaaatgaaatacaaagggatgattctattgccaggcatttctttctttgttctcagttcattttcttgatccttggaagtttctaacatgctgccactgtggcatggcaatacatcctagcactctgttgtgttttagtggaggtgggggtggggagagggatacagtagtggggtagggagactggcagctatttgtgttcaggtatttttcagcagttaccaccatgtccctgcaaagataagtatatctgtggctgggacacaccctataggatattataactttatgttgttgttgttgttgttgttgttgttgttgaggtgggcatttaaaaaacttgcctatgttgcttttgagctcctggtttaaaggatgtgcttcaacctctagagtaaccaaaattacaggtttgtaaccccgtgtacagcttgggacttattttgctcttttcaaaaatacactgttttgttctctttttagtgcgtatatgtgtgggagcaggtgccctagcacatatgtggaggtcaaagggcagcttacaatactctgttctttccttccaccatgcggctactcaggtagccaggcttcccagcatgtactgttttttgtttgtttgtttttgtttttgttttgttttgttttgtttttttttggttttttgttttttttggttttttgagacagggtttctctgtgtagccctggctgtcctggaactcactctgtagaccaggctggccttgaactcagaaatccgcctgcctctgcctctgcctcctaagtgctgggattaaaggcatgcaccaccacactgggctctgaacatagagtcttaaggttgatctcaaattctggctcttcctgcctctacttcccagatactggggttacaggtgtgtgctaccatgcacagtttataactgtaaatgcaaaaaagatttcatatacttaaaaatactcctgtatctacctatgtgttcagaaagctttttactgccatgaagaaccctttgaaaggtcacttattacgtagttatttgtgtgtacacagtttctcttatgaggcagcccagagaaagcacgcttttacttctgaggtggtagggtctcaaaatcagagggatgcacaaggcatgaggaattcattttttcctggtggataaggggtgggaatggagtgtggtagaggcagagaaggtattccagacataggaaataaatgagcaaagacaaagcagaaagggagaatacagttgctttacagaattacagagggttttccaaatgattagagcatgtgggcatggtggtacgcaccttcaatctcagcactaggaaggcagaggctggtggacctctaagtttgaggccagcctggtctatagagccagttccaggacagccatagttacatagagaaataagaaattatgtcttgaaaagccaagggaggggggagaacaggaaaggggataacacttgaaatgtaaatttaaaaaatctatccaataaagaaaagaaagaaagaccaaggaaccaggcagtgggggtgcacacctttaattccaacactcagaaggttggactttgaggccaacctggtctacagaatgagttccaggacagtgagggctataccaagaaacccctgtctcaaacagacaaacacacaaaaaagagctgagtcagggcttcggtttggggagaaagactgggaatggaggccaggtgtgatggtgcttgaatttaatcccagtactaggaagggagaagcaggaagatctccagtcagcgccacatagtgagggccttctcaagaaaaaactaaaaccagccaaccagccaaccagaggctgggaatggaagaggaagggcaagtttgggtttgatttattttatcatcttattttagtgttgagaatggagcccagagcctcatatgtggtaaaggaatatgtccaagcttttgagatattcttcccaagcctgggcgtcactatcgaggaggcgctttttgtggaacattcaggttgaactaaccaagaggtccagatccgggaagaagtagggagaagtaagccttatgtcttcccgttttctcttaactgcattttttcccttaaatctacttccgtatgggctatcttgatagctcagcctgagtactgaatagatacatgttcattagcttgcttctacagttttcccttctcacatgctaccttacttaataatcagtaggaaaaatactttgcactctgtgaagaatataaactgtattaatctactagagccttacccaactaagaatttaaggaggtgtggaaacctatccatgtacaaattttctttttttcttttttctttttttttttggtttgatttgtttttttattcttttggttttttgaggcagggtttctctatacagccctggctgtcctggaagaactcactttgtagaccaggctgaccttgaacttagagatctgcctgcctctgcctcccaagtgctgggattaaaggcgtgcgccaccactgcccggccaaatttattttcaactgcaatgtggcatcattaagttttagctcaaatataaaaagagtataaatgacagcattgatttacatacattgcacaatgctgtaaaatgtattccaacgaataatgggtctttaatggggctaaacttttattattttgaaacaaactctcatgtagaccaggctgccctgaaaaactatatagctggggatggccctgaattcataattctcttaccttcacctcctccgtgctgggattaaatgtataagccaccattccagatgtttttaatgtggttctctggaccacatccagggtttcattcatgccaggcaagcacctaactaactgaacaacatcttggcctgtagatcacattatatcgactattttctgtgtcaaacttctctctgaaacagcatcaacacttttagtgcctggtttattttgcttctcaaacttctaaccattttggaaggaaaggttttcaaaaagtttacttaccttctggacccctgaacctggaaataattgcatcctttcctgatgactcaagactgtccttaagacagcatcaattatgttaatctgatatatacagtgctcaggggttcgagtggaggctctttgtctctgtggcaaacgggcacagatctctctgccttttaatttgtaatgtctgctttgtctaatctcttcatatatcccttctctgttagctgtcacttcttgctgctgtcagttttttctactgtcttttattgtctctggttccaggctgcattctccactgttcattttgatgtgctgtaagctaaggaatattgtaacccaaatgtgcagaactatctgaaaagtataaataaataaagactctgggaagtcttcctttatttatttgtgtgtttggatgcttgcatatgcacatatttgtacagagcccggatgttgattatggatatctccctcagtagctctctaccttgttttttgagacagtgtcttttactgaacccctgaacctggagccataagctaccctgaaacttcctgagatttgcctgcctctgtctctgctagggttaaagacaccaccatgtctgaccacaggcagtgctcttaactattagaccacctcttcagctccactcaaaataaataaaaataatggtaataaaaggagcattttgggtcttctaggtctttgctaatcttcagaattttattttatatcattatcttgtcaatttgagaataaaaatctagttagcatttgctaggaattgcttagactctataggtcaatttagggagtttattttttcccttatttgggacacaatcttttaccaactattatgtaggctggcctgaaacttattttgtggcccaaattgtgaatattttttctgtaatttacttagtgagaatcgatttcttttctttactgtgtgctgggcagtggactcagagcccagggcatgccaaacatgtggtctaccattaagctctctatgccttatgtgtaaagtaacatggactttatatactatcccccccttttttgagtctcaaactcatgatccttttgtcagcctctctgaatgctgggaccccaagtttgtgccatttttctggctctgggttcatttttagtaagtttgagattccttgtaaagtttttatgtgaatgagaaagttcacctacattttgaaatcttgtggctggagagtctgatagacattgagctgcctgccctttcaaaatgtatttcagctaggtcagcatcagttcttgtgtttaccttcaggaatactgcaagttttttactccttagggtcttcatttgcaggcttgtgccagctggttaattagctgccatcttacctattgagcatccagtgtgttgacaaggaaaaccttagagttatttaaaaaatatttcctctattaaaaaatgaacaggtgtgatgaggtatagttattcttagcttgcttgatgccacttagaaggactatgcatctgctggggcattcttgaatttgcatttgcaagtcccatcatttgatttgtcattttgctctgtcagtttacaaaagagggtcagtttggcttcctttgttgtgaccttggaaggaccactaacagatattatgtgttctcccacacacattataaaccaaaggaaaccattttaattggatttgctgttgcagatgctgtgcatttcaaaattagattttctaaacccatgaagcaatgaatagccacggagtacaagagctggcatttagttatatggctacatgaataccctgggttctgttcaagtgggccaccttgtatacttttatagcttgtgtttttaatagctgtcctcaaaaggtcagatgttataataaaaagttaaaagaggtgaatgcaaatacttagtatgcttagatcattcagttggaagctgtgaccgttatctttgtgattatcattatgacatctttcaattcctgctcaagcatggctagactcatttgaactgtgggtactggtgttgatgattcagatgagtttaaaaaaaataaaaaacaagaaaacaaaaaaaccaaccaaacaatggctgggctgaagagtttggtcagtgtggtaaagagcacttgctcttcccgaggaattaggttcaatttccagcacccacatggctgctcacagagtgctgtaacttcacttccagggcatctgatggcctcttcgggctttcaccaacagtaggcataccatgcacatggttcacagacatacaagcaagaaaaacattgatatacataaaataatttaaaaggttattattgtgtgtatgtgtggtcgtgagggcatatgctgatggagatcagaggatagccttatgatgtcagagttctcctactagcacacaatttcaaatatcatgttgcagactgttctttaggaatataaattgagaatgaaaagagaaaccagttagaaccagcaagatggttcaacagataaagggattcattgttgcctgtaaacctgcaaacaaggcacagtttaatcctagcactcaagagtcaaaagtgcagcacgcccgccaccggaagtttttggtgcatttctctctatggactcctgacaaatgcagctcacctatgcagtgtaaggccgaccaatacatgcatgttgctagcaaagaatctttcatcacctgtccgttcatgtgcttgctttagcagaacatcctctctcctgtgtctgcttcagtgaaacgttccttcaccagtcggccttagcctttcacctgtgtccactttaaccaaacgttccttcacgtggttgccccagcaaaacacatccaaccaacttcccaaataacccttaagtttccacgtcgcaagccgggcatggtggctcatgcctttaatcccagcacttgggaggcagaagcaggcggatttctgagtttgaggccagcctggtctacaaagtgagttccaggacagccagggctacacagagaaacactgtctcaaaaaaccaaaaaaaaaaaaaaaaaaaaagtgagttccaggacagccagggctatgtagagacactgataaaaaaaaataaaaataagtaaatacataagatataattgtatatggaagagttttcttggtttaacttcttctccttcctttcttacttccttctttcccttctttctgtctttccttccttaatacttttgttttgctttgcttttggtggagggggcagggtctcagtctagcccaggctagaaatcagtttatagtgcagactagctttgatcttatggaaattctcccacttctgccttccagagttccaaactaggagtcactgtgtctgacttgtttgtttttaaagcatgctttcagaactatcaagagaggctgggcgtggtggtgcacgcccacctttaatcccagcactcaggaggcagaggcaggcggatttctgagtagaccagcctggtctacaaagtgagttccagaacagccagggatatacagagaaaccctgtctcgaaaaaccaaaaccaaaaacagaactatccatcgaagaagaatttcttttaataaaaagtagcttttacctgacaatcattttgaagatgattcaaacacaatcttttactaactattgtgtaggctggcctgaaacttattttgtggcccaaattgtgaatattttttctgtaatttactttatgaacatcaatttcttttatttactgcgtggaaaaaatgcttctttaacatagattttttttttccatttagcaaagagttgttatcatctgtaaaatttcaagctttgatcaagttgcaaaagagctttaggattataaaaagctgggctgctgctcaggttttaccctcttttgggttttaaggacttttcatttgaatcacaatgcttcatttttgcatgtcgctgcaataggtgtacacacatataaatgacaatatcagtgcatgcaaagactaccttttcacttgcaacccatgcaaatgtgtctggcccaggactggtcgaaagctgtctgaacccccttctaatcctttagccctctgaggaccttgagggtagtcctcaaagactaggttagaaatcccacttctttttcatttcttctgtgtgattatcttatcagtttagttctggatgtctttttactccattctcattgcatctacaattagtatagctgtaacattcatcactctggacagaaattgcctcttgcttctagataaagaggcactcacagtccccaatctgggctgatgcttaactgcttttgtagttggatctggctttcagctttgaacacatgatgtattagagtggctgatagatatataaagaacaaaatgtgttgaaagttggatcagtgccttgcagcccattcttctatcgcctcattcattccttctattctccaactttctctaggattctaatgtaagggttcttgatttgctgaagaatgataccctggactcatgtaagctcagagtgttttattctgcacaagtccagcatgctggagtctcccattatcaagatagagagacacccaagtgagctcacgggcctgctttaaagcacattaggggattcctgggtaggtgacctttatattgctccatctctaggaacattccattactggggtgggggctggaaactgttactgaggaagtaggtgaggaagtctggaaactgctgctgacccattgtccttgcctcaggccaggtggcaggcagcttctgaggcctagacttgcctagagttacccagttcttggaaacagacatttaggcctcttctaaactgccaatttgaagcctgtcgtggagtcaggctagccttctcacttacttaatccctgattcattccttcaaagcacaaataaaggtcttgtatccctccttcccgaatttggaagtatttcctaattatatgttgtgtatatcttggaatgttggtacagtgatggcagcttcatagcaggtacatttgttttgatatgacacatgaatttttctttccatttctttaaagacaagctctcagtatctcaggctgacttggaactcaactgtaactcagactggctccagatgtgtgacagttctccttcagcctgcctcttcctctcaagcacggctggaattaaagtgatgcaccactatatccagttagaagatgattagcttgaaggccatctcaaaatttctttgatctttcagttgtcacctttaatgatttccttcctatttatattgtctatattatgtaacccatattgattcttaatttggatttgtttaactctacttcatactttcttgtagtgatttctgaaataattttgtcttcataattcatgatttgtgacaaatgcaaagtaatcctgtggtaagaggcaaatccaaccctaacacacttctgtaatgataatattttatatatagacactagttaatgccagatttaaaaaaaaatactgtttagtggtaaagagatggctcagtgtttgggagtccttgctgttcttctagaggacctgagttcaactttccccatccacatctgcagctcataattacccgtgtctctagctccagaggatctaacatccttttctggcttcccgggggcacccacacacatttcctcaccccccccatgctcccctgccacacacacatacttaaaggcactaatctgagtctagcagagtatcgtgaagaatcatttcattgacttttctttaattttctttccttctcttttcctctttttttaaaagatttttttatttattatatgtaagtactttgtagctgtcttcagacaacccggaagagggcatcagatctcattatgaatggttgtgagccaccttgtgattgctgggattcgaattcaggaacttcacaagagtagtcagtgctcttaacctctgagtcatttctccagccttcttttcctctttttaaatgacagtcatatttggttctatcctgggtctctgggctgtccagcctctggttcctggacatccacgcaatgtcaggtgtagattccctctcatggccacaaattagatcagttataggttggccactcccacaagttctgcaccaccattgccccagcaagtattacagctaggacagactgtaggtggaaggttttatggctgggttgatgtcctagtcccaccttttctgcttgtagaagatgggtggtttgtgctctgtaatcctccattactaagaaattttgctctagattccaggtagtttccatgttgtttgtctttctggggttgggtcacctgactcagaatattttctagttccatccatttgcttgcaaatttcatgatattttgtttttaaacatctgaataatatgtgcaaatgtattgcattttctttatcattccagttgaggaacatctaggttatttccagtttgtggctattatgaataaagctgcaatgaacatagtagaacaagtgtccttgtggtaggatggagtatcctttgagtacatgcccagaagtgttatagctgggtcttgaggtagattgattcccagttttctgaggaaccaccatattgatttccatagtggctgttctagtttaggttttgaccagcaatggagaagtacatatttcatttttaaaggcaaagtctctctttgtagctaattagggctggctttgaacttaggattctctgacctcagccttctatttgctgtgattataaaagcatacttttctgttactttttttttttaaagtaaagagctttatgttcccatgcagagtggagccaaagagaaattcactagatgtttggtgaattgcaatagattagaaagaggctccaatgtatattagcaaaagaaggatttagcatgaatcttggcagaaaaatatgtgaggttttcatactgtacctttattgaagagcaataacagttctacatagaactacatagttctattgtagtctaataagaatttattttctgatgatttcagaattgcccttttagtcattcttccttttgaatcataacatttttgagggcgcatagccatcatttgcatgtcctatgccattgctgtttacaggtgctatggcatatctctctttcagactgaatgggaaaatttacctgtgtagaaacccatccatcttgtacacagacctggaatttacagcatcagccataggaaactttcaatgagatgattggtagagggaagcagcgctgtttaggttcagactgcagtggcagatggcttagtggttaagagccctggctgctcttacagaggaccacatcagaggactcacagccatttttagctccaggctgagggaatctgatggcacttctgacctctgtgggctcctgtatgcatgtggtgaacatacatacatgcaggcacacaaatgttcatgaaataaaaataaatattgaataaaagaatttcagactgcaaaaaaaatatttataaatgtccttgctgtgatttgggaagaatggaggctgtcaggttgtatctagttaataatttcatgagagctatttgagtgtgttttttttagtacaagtgtcactctatctgaaggttagcagacaagatagatgatattctacaactttttctgaatttgtgctagattctgcttcggattgagacagtgactggcatctagtgttctttaatagatttttgaatgaatatgtatatgcttgctcattttcttcatcatgtttgtcttaaaactggcctgtagggactggagacttggcttagtagttaagaggactggctgctcttccagaggacctgggttcaattcccagccctcaaatggcacctcacaagcatctgtaattgtagtttcaggtgatctgatgccctcttctcgccttcatgtacaccaggcatacttgagttatatagacatacatacaaaatattcataaacataaaatacataaatcaataacaataatgaaaagaggaggcttttaatagcaactttggaggtttgttttgaagaccagcaaagtgaatttaaatacctgtacagtgcctagaaagggggaagagcttcaagatgatagtgtcattaactattcatcccatttattccacttgttcctagatgacagtgggttggttgctataatcttcctggtcaacattttccattctgtttttatatgtgctttgcttttgctgtcagtttatttatttatttatttttttaggaaagcatgagaatggaagcatttgcttttaaaaggagtttatttgccatgaccctttggtgtgggctaagtggcatgtgtgtgcagtagattcagaaccagttttcttcaaccatatatgaacaggattcccagatggagcacaaatggacacaaaagagtgtcgatataaaaataaaagccccagggttggaaattatggctattaaatcttggaatctgaaataaaaatgctttttataaaatgagaaagcttgaacataccaattacttactttttaaaaatgttcattttctctatgggagccattactgaactctgtagaagtgaaatctccggagtggtaatctatactcctattatcaagacacacattccgaaataagactcctaagagcattgatcctagtccagctatatgcttgagtgtcctctctgtagcaattcatcacagaggtgttttgtctttgaaaactgcaaataagattatgtgactggttttctctgccttgcaaggcagccattttgcctgtagttagttctgatattttgaacaaagtacctctgcataatactctttctgttggcctttttttttcccggaggggaaagacccaaccatccaatcaaacaaccaaaagcatacttgatcagacagctgtgggagtattgtacacatagccagtacccaagaagttatacagatttgctaggaaatatggcaatatgtgtaaccttcaaaatttcataaatttatttgactctttagtttttcctaggacatctgttcaaaatggtgtaggatggtattttggcccatagtaattctcaatcaatgtttaaaagacagaaaaaagttagggtaggtgacacacacctctaattccagcagttgggaagcagaaacaggcagatctctgagtttaaggttagcctcatcttcagagtgagtcccaggatagccacggctacacaatgaaaccctgtcttgaaaatcaagaataagaacaccaccaataactccccccaccgagagagagagagagagagagagagagagagagagagagagagaggagaggagaggagaggagaggagaggagaggagaggagaggagaggagaggagaggagaggagaggagaggagaggagaggagaggagagaagagagaagaatgccccctgtggtggcatgcacctatcattccaacatttgggaagtaaaggcaggaagataatgtatttaagactagcctgggctacatagtgagtttgagactagcttaggctacagaagagcccatcttaaattagaatgactataaaatacatctttatgaggtgtaacacctactatgtaatggactgatggaaactgagtttctgcaagtgacacaatgaaaactgagcatctgactagatggatgcaccctccctccttttccatgttattccaaatacagtaatttctgtaccttgtagcacgtaaaaaagttgaattctaaccttatttcctcatttgagataaaagaattagtgattgtttccaactttatgatcaagataataggggctggagaaatggcccaatgggtaagaactcttgctgctcttacagaggacttagttcagttcccagtacccatagagtagttcataaccacctataactccagttataggagatcagatgcccttttctggcttctgcactacacatggtgcacatacttgtaggtaaaacactcatgcatgctttataaaaaaaaaaaaaaagactaagaacctgattcttcttatgtgagcgaacagcaagaggttttctcttttgttttcagtttgtgcctgattgtgtgtacaaggcttttcagcagagaagatttgctatttttcattatgtaaatctctgtgcatgtatgtacatgccagggcaatgcccataaggtcttagggtcttagaggcttcggatcccttggagctggagttataggcagtttggagctgggaaccaaacctcaagtcgtttgccagagcactgcatgcttaaccactgagctatttctccagctcccaaccggccctttgggggatttgccatacagttcaagtaaggagaattgagaatgtgtgtcttttatttgtttgtaatggatcagcttgccagctttctgtcaaaggtatctcagtgaggaatatgcagtaattcaactttggtcaaccattgtgatcaagatttaaaaaaaaatttttttttttttttttaccaaggtctcgtgcagccaatggtagccttcaacttgatgtactcaactatgaactcaaattctttttgtactcctgcattttccacctgagcgagtgctgggtgggattactagtatatgccaagagtcgtggtttatatattgctggggatggatccctgggctgcaagcatgctaccaactgaactgcatctccaatctttttatttcttatagtttgaagtatatttcttatacttatagggcttaagtagtctacaagagaaatatgaatcaccctcattttcacttctgtatcacaggaggaaatccgtgtggaaatgcaagagcctcagagtccaaacaggctacaactcaccgtgattgctttctttgaagctaagaagctagtgttctcggcttccttgtttaagcaacagtctcaccttgttctctctggatgttcagtgtcagccatctgtcttctgttgcctttctttgttagtttcctctctgtttagtcaactgttagactatttcttaaaacggtagtatctcttttaactcccatttcatcccttgtcattagtgtggcaatgttattttaatgagatggttgtgggaggcatctcctgtctcaaaaatcaaaagtatattttccttatgtatgtggttttctgtgttgttggtgctcctagaatgtaggtaccttagaaagtatctgctgtattaatgaggggaaaagtgcctgaatgattacagggccgagagaaaatgaaaccttgctcttcctattgtctgtccacagccttctgatttatgcataaggctgtttttattatatggatggatgtctgaattgtggaatgataatttttatagttctgcaagattctgaatggtgcaagaataatcagcttgcaatgtattattttcagtttgccgtctgacataaaattcatcaatttattttaatagtcttgctattcaaatcaggagagatttttttttaaaatagggatgtctcagtgttctaatgctatttgttttaagacagggtgtctctatgcagcactgaccagactggttttgaactcagagacccacctgcctctacctcccaaatgctgtgttgttacacttgcttctagtactcttttatttaaaccctaggccattactacttttggaagcatatgaggacagagaaaagtctagtcttttgttctgtgatccttctaccatacctccgtgtctaaaaatgtcaacatttgacacagttttgactgttataaacattattttatatttgaggcactgtagtgttcaagaaatgattttatatgctaatgtgtatggattataccaggaatctaaacatatgtaaatctacatatgcatatggatacatatattaattacaagacaattttaagaattaatttttatgttctgaccatgtgtttctgtgtttactttgtgcgtggttcatgtgttataagagtgcttgcaacttacccaaccaaactcaggttgtcaggccattttgtgagcttccaatcatgtctttaatgacttgtagttatgaaaataactaaaccagttaactactctatgtttctaagtgagtagatatcatattctacagctttgtcttaatagttttgagaaggcttgttcctgataaagcacatctataggagacaatttcaggagcactagaaagaatgtgtcatcagcctggcaccaccaaacaagagggctttgaaggcactttgtatcagagagcaagtaccaaatatggcttcagtaagagatgtaaaaccacaggctttaaaacagcagtccaaaataccctagttcaatgacctattttcttttaaaaagttatccttgttcatggactggaggcagataatggactttttagttttgatccctgtagcgtttggtagattggaacattgcaagctatcatttaagatctagggcaactaaaacctgaaataatgcaggggcagtgacttaaaatgtcactattcattaggtatttactgtgtgtgagctgcttcacattacaatagcattaggtaggtcttatgatgtccaggttatagatgaggaaactgagcctcaatgattctacttgactgtcatatccacatttctacagctactaagtgcagtaaactggatttgaatccaggtctttctaattcagaaacatgtgatgagccattgtactgctaattttactaacttagagataatgatatctactgtgtgtgtgggggtgtgtgtcttaagaacccaacaagatttttataaaaaccctcaatgtgctttgctcaatgtaatagaactgataaggttctatgaaatggaagtctatatgagaagtggaagacaatatactactgtgtatatggctactcttcaaagaaactggagctatttgtacctagttcttagttttctgatgagttttagacataggttttgaaaagtggctcattcgttctatacacccagtggtgtcataaaaagcatggctaattctccctctaggtgagggcagaaagacgactatgcttgaggtgtctatacacacagatgtgttaagactatgcttgaggtgtctatacacacagatgtgttaagactatgcttgaggtgtctatacatacagatgtgttaagactatgcttgaggtgtctatacatacagatgtgtgaagggctctagaattcttttgggcagaatgaggatttcaggatggttctagctacacttttgacattgatgttgtttcttctcttgtttatcatagaaactgggctgctcctccagttaaaggacatcaatcatttcctaatgcaagacattgctttcctgtctggtaagtaacctttatcatgtacttaagggaagataaatgtataaactggtcagcagagttcatttgagatatgtataaatagtttgctatccatatccatatatacacatatataaacacacatatattagattataaaatgttttaataatcatttatatgttgtagatctagttactaaacaagcggacattaagaataattaaggattttaacatttttaatatgtaattaagagcaatcttaatactcttgtgcatttgtctttagacattcacagggtatgtggggaaatatgtgtcttagaagagtgtggggtagatttattaattttttttgtctattcattttttaagatttttaaaaaagatttatttatttattatatgtaagtacactgtagctgtcttcagacaccccagaagcgggcatcagatctcattacggatggttgtgagccaccacgtggttgctgggatttgaactcaggaccttcagaagagcagtcagtgctcttacccgctgagtcatttctccagcccttttgtctattcataagcagagcttcttttttttttttaaaaagatttatttatttatttaatgtaagtacactatagctgtctttagagacaccagaagagggtgtcagatctcattacagatggttgtgagccaccatgtggttgctgagatttgaactcaggacctctgaaagaacagtcagtgttcttcacctctgagccatctttccagccccataaacagagtttcattatgttgccacagcaggtctggaacttgctatgcaaacaaggttggcctcagtctcatagagaaccttctgcttctgcctcacaagtgctgggattaaagttttattccaccacacccacccttttctctttttatacttattacttttatgtgtatggttgttttagtttacaaatatgcatgaattgtctgctcaggtgggcatcagatcccctaaaactggacctgcagatggtttcgggctgccacggatactgagaagcagcccaggatcttctacaagaactgaccatgcttttttttgttttttgttttttttttttggtttttttgagacagggtttctctgtatagctctggctgtcctggaactcactctgtagaccaggctggcctcgaactcagaaatccgcctgcctctgcctcccgagtgctgggattaaaggtgtgtgccaccacgcctggctctgaccatgctttttaatgctaagccatctctccagatcctaatcctttttctttttcttttttattcattaaaaaaaaaaattctggcccagcttgcttgctccggccatatttatttcatctatgtgggtacactgccactgtcttcagacacagcagaagatggtaccagatgcccattagagatagttgtaagccaccatgtggttgctgggaattgaactcaggacctctggaagagcagttggtgcttttgaccactgagccacctctccagcccctccttttgtttaataatggtgttctgatgtaaagcataagaatagggtgatgttggagctgagcctgggttcagcccttacccatttctgaaataagaatgaaagaaagaaagaagaaaagaaagagagaaaaggggagagagagagagagagagagaggaggaggaggaggaggaagaggaggaggaggaggaggaggaggaggaggaggagaagaagaagaagaagaagaagaagaagaagaagaagaagaagaagaagaagaagacgacacacacactggatttagtagtttctgtctggactatattgccatcagatataagaagttactattctgtcatagtaaatttagctctttgatttgatttcatcactgttggtgtttcctagacggtagtcaatttctcatgtttaaagtacttttgctttacttaagtgttctaccactgagctacacttccagtcctctgtgttaccaaaactgtgttctgaatagaaccgtcttcagggctgtctgcctccatccacactcttctcacttttcttttgtctttagcatttttgtgtgtttttttaaatacttctgcttatactttcttttgaagaaaacgtttctaatggacaagcataattaatgcctctacttcccaatttagaatttaaagatcttctttgttcttttattacaggcatactagttatacagtatttgtaggtgctcaatggtaataagcttaatagattaaaatttaatagattagtcagtccgtgataattgacccttagtggaaccatgtatcatttccattaatagaagatgtttgcttaactagtactagcttgtttggaaaaagagaggagaagggaggttagggtagggaaggaagggctgtcctggtttgcttgcttgcttgctccctttctaatgtgtgttttttgtttgtttgtttgttttgttttgtttcgagataggatttctctgtgtagccctggctgtcctggaattcactctgtagaccaggctggcctcgaactcagaaatccgcctgcttctgcctcccaagtgctgagattaaaggcgtgcgtcatcactgcccggccctggtttgctttctattgctgggataagcaccatgaccaaaagcaactggggagatgtgatggttacttatggttcagttctgttcctacagggaaccctggctgatacaggtttatttggcttacaagtcttaagctcagttcatcacggggcagtcagtggagcaggagcagagccagtaaccatgcaggaaaaactgcttactagcttgctttgtaggacttgctcagcttgtgtggggcggcaccgcccacattgtgctggaacctcctacatcaatcattaatcaaagaaaataaaaagcccacaggcatgcccacagacctatggaggcagtttctaaattgagggtccctcttcccaggtgtctcttgtttgtgttgagttggcgaaaaaaaagtaagcagcagagagacagagacagagagacagagaaagacagacacagagagacagagaaagacagagatagagaaatacagaggcagagaaagagagagacagagacagagacagagacagagacagagagagactgttctgttgaggactgagtgggccaagttctctctgccatcacttttatttcatgttttgtagctctagtattaggtacgtaagcattcagggttatgcctccttgataggttgacaacctgaacattatctaatgatcttgaaaagtacttattttacttttaagaaattatgtttgagccgggcgtggtggcgcatgactttaatccgagcacttgggaggcagaggcaggaagatttctgagttcgaggccagcctggtctacagggtgagttccaggacagccagggctatacagagaaaccctgtctcgaaaaaacaaaacaaaacaaaacaacaacaacaacaacaacaacaaaaaccccccaaaacaaaaaaccaaccaaacaaaaaactaaataagaaattatgtttgtttgtgcacattatgtttgtaggtgcctaggaacccctggaacttgagttccaggtgcttgtgagctacgtgacaccagtgctgggaactgaactttgtcagtccctctgccagagcactgtcgacggtgaaaccatctccccagtctctcaaatgtactttgctcaaaaattctttggaggagaggcccttggtcttgtgaagattatatgctccagtctagggggatgccagggccaggaagcgggagtgggtgggttggggaacggagggtgggggtatagggggtttccagagaggaaactagaaaaggggatagcagttgaaatgtaaatgaagaaaatatctaataaaaattattttggacctccttttctatatgaatgttttgtgtgtgtgtatgtatgttcaccatgtgcatacttggtgtctatggagggaagaagaggatgtcaaatcccctgtaacaggagggatagatgattgtgagacaccatgtgggtgctgacatttgaatctctccagcccctgaattttttctttctcccctcccttttatgtttttttttttaagataaggtctctctcatctgtttcttcagccgtatttattatgtgtatcacatgaaaattcctatgttcttattcatctattcctctttgactttctttctttctctttccttccttccttccttcttttctctttctttctttctttctttctttctttctttctttctttctttctttctttctttccttgtgctaaattttacttgttcttttggtttatatggaaattgtgattctcataaaactctgttaccccaaatagccttctagtcatcctctttaaatatgaaaacactcattatgttttgtcacacaaattgataatttggttgatttggttgatttttaggtggccggggaaaggacaatgcttggatcattacatttccagaaaactgtaacttcagatgcataccagaggaagtaattgcaaaagtgctcaattacttgacatctattgcaaggtatgtagtattccactacattctaaaattttgttttatatcaaatttccatttggagattaaacatggagcttgctattgtgaataataacttcacctaaagtaaataaatataagaaaagaggaggctgatagctgcttgtattatgaatatatttagaaatatactgtaaaacatactaaagaaaaatatacaaatatactgaggatctatgtaaacagacatagcactttagaagagctggccctcacaaaatgttgcagacatgtataaaaggatacctttactattcaagagtgaagaaagccatttgtccttttgtccaaggtctacatgtaaagattttatcagcaccaatctttggagctaaagcaggataatttgataataaaatcagttggcaatactatgaaacacttagaagcctccattagaaaaggatttctcaacagtaaggatgcaagtacaaccagtcggaccatttataagatcccagcatctctacagtaagcaagggatttcgcatacaccagtaatcacagcaatgaggagtgggagccaggagagtcttttgctttttttgtttgttttacgaaacagggtttctctgtgtagccctggctgtcctggaactcactctgtagaccaggctggccttgaactcagaaatctgcttgcctctgcctcccgagtgctaggactaaaggtgtgtgccaccactgcctggcaatctttggctttttggtttctagattagccaagaaaatttgagctccaagtttaaggaaaagacctcatctcaaaagaataggtagaaaatgacaggggaggacacgtaatgccctcttacacacacacacacaaaaaatttagatatcatatttatgttgaatcttatctatctgttttttttttaaattttttattaggtattttcctcatttacatttccaatgctatcccaaaagtcccccatacccaccccccactcccctacccacccactcccctttttggccctggtgttcccctgtactggggcatataaagtttgcaagtccaatgggcctctcttttcagtgatagccgactaggccatcttttgatacatatgcagctagagtgaagagctccggggtactggttagttcataatgttgttccacctatagggttgcagatccctttagctccttgggtactttctctagttcctccattggggaccctgtgatccatccattagctgactgtgagcatccacttctgtgtttgctaggctccatatctatctgtttattaatttaagacagggtcacactttgtggccctagctggctggcttagactttcctatgcagaccagactggcttcatatagagttcttcttccagagtactgggattaaaggtctgtgcccccatgcctagccaagataaattttaaagaaagcagtttccatttattaaacctcaaatagaagagtcttatgaacaaaaatcaagttctagaagagtaaatttatattgtacctatggaagcttaaagtatttttagaacaaatcaaagttatattatcctttaaattgccttctcttaaacgcaaagagcagcctgcaatgcaaacaatatattaaactacatatttttcaagtgaaggaaaaaatcattgacagatttttctgtgaagctaagcttgatattaagaaagacactagctattggagtttcctcgtcaccatgatgtgaagaatccaaatccgttattctaacccaggtttatcatagttatttcattttacagacctttcttttgtttatttgtatatgtgtgttttggtgtgaattaatgctgtatttgtatgtgtacatgtgggagccatgaaagggcaatggattccttgaactggaattacaggtagttgtaagcaacttgatgaaggtgctgggaaccaaaccaaactcaggacctcagcaagaggagtaagccctctttctcactgagtcatcggtccagccacctcattttcctaataaaaaaattgaagctagtactgaaaaacaaagtttaaataataaataggagaatatatatatatatatatatatatatacatacatacacatattgttatagagtttttctgtgtagccctggctgtcccagaacccactctgtagatgaggctggcctcaaattcagagatctggctgcctctaccaagtgctgggatcaaaggcatgtgcagctatgcctagcactcctgaacttttttatatctattaacttcattctgaaatctagtttgaaaatcatttttaaacatagcaggttttttcttttggtttattatgagaagagtctcactatatagctctggttgttctggaactctgtagaccaggttgacctcaaactcacagagattagcctgcctcagccttaatgaatgctgggatgaaagtacaacagtactcctgcctaagatagcacttccatatctaaacttgtcttcagttaaagatcatctgtaaaatacataatcataaacaaagacacagaacagataagccttgttactaataaaaattatttttcttctcttataggcaaagtggatctgactcccgatttactattattctagatcgaagactggatacatgggcttccctcaaaatttccctccagaaaatctcagtaagtaccatgcactttgtagtagctactatatatacatacatatgtgtatatatatatatatatatatatatatatatatatatatatgcttatacttaacctttagaaagtatggattacttttatattgatggagacaataggtattgatattgatataatgtgaagggaaagtaggaagaatattttgtgatcttaagtaaagacctcctgccaatctaaatcctagtgggaacaaatgagtaactgatgattcagtttctaagtaagcaaagattgtgcactgttttgtatagctttaaaagaaaggcatacattttatgggaccttttagaaagtggagatagctgacttaggccattcccactagagcaaacgcttgaccaaaatactgaggttactgaagttctgagtcagtactcttttctgctatattatttgttgataaacataaaaaatatactaacacttggagccagatataataacaaagtgaataaggccatccatttcatattcatcatgaatttttccttatttgggaaccctttagtagtggttttctattatttgtttataatagctacttaattataaacaatgcatcttaattgttttttctggtgcggtgatcaaactttctagggaaagcagcagaatggggaaagctcatgattctaggctatatagtctgtcatagcagacaagtcacagtggcaggaacttgaagccactgatcatatatcctcagccagaagaacaaagacgtgaatgtgtacacggtagcgcatagctcactttctccattgtcacataatccaggattccttaccttgggaatgatgcttccccacagtggctcttcccacctcaatgaacacaattaaaataatctgccacagacacatccagaggcccatcactcagagattttagatttttgtcaagttgacacttatcactaaccatcacatagtgaaaagaagataccacagatgtcaaacaatttgctaaggaaaatgacagcactgactgtagctctggtggtagagtgcttgcctacaaagcccgagttccattcccagcactccataagtcatgaatgatggtgcacgcttataatctctgtactcaggagacagaggcaggagaacagacagatcacggtcatagttggctacatagtgaatttaaagccagtctggactatatgacatcctgtctcaaacaatagctatagccaagccttatgagtatggtttcctgctcaaaagcattcatatttattaagtagcactgatacctctatttctttctttctttttttctttctttctttcttttttttttgttgttgggtttttttttgttgttgttttttgtttttgttttttcttttcaagacagggtttctctgtgtagccctggctgtcctggaactcactctgtagaccaggttggtctcaaactcagaaatccgcctgcctctgcctcccaagtgctgggattaaaggcgtggtccaccactgcccggctatacctctatttcttgattaagaactgttatcaggcatcaaatttgtctcatgtatgcttatattaatagatataaaaaggatgtaaaatgcaagtaacttaaaaaaaactgagtaagaattgaaatgtcagccaggcgtagtggcacacacctttaattccagcaattaagatgctgaggcaggtgaatctctgtgagttcaaggctagcatggtctacaaatcaagtccaggatatccagggctacacagagaaaccctgtcttgaaacaaaacaaaaattgaaacttcatgaactctaagttggtgtccttcttacctgctccttttataagtgtttgcatggattatagatacataactaaattcagtggtttttaaaaagctacatttctttggagtgaatatatctgcccttcttgtactattgagttgtgtcaatatggtacaatgcaataaaagctagctcccttttcttatgaacttgaggccagcggagggcaaggacttccttcttgttgccttacggctgttgcccagaagtacattccattttcagcaaacagctataagctcatggtctttttattctcaaagtaccaaattaaacaagatttggggtataggagtttgtggcatgtaatgggctatattgagaccctgtctctaaaatacaaaatacgaggctgaggagatataagagcacgtgtcatgcaagcatgagtacctgagttcaaatccccagaaccaatgtaaaacgctgtggaaacaggagaatcaggggatcttgctggctggtagcctagctcttcgtctatgatagcggtcttaattgagcaaggcagagagagatagggcagtccaccgcaacgccttcttctggcttctgtgcatgcacataggtgtgtgaacagatatgtacttacactcactgaagtaattattttctgttgctgtgataaaaccctttgaccaaagcaagttatcgaagaaagtttatttggggttatggttccagaaggataagagcccactatgacagggaactctgagagatagaggcaagcatggtggcaggaaatggatactgagaactcccatcctgaactgcaagcaagaagagagaacatttggaaacaatgagaggcttgaaactctcaaagcttgccttctgtgacacacttcctccagcacggccattgtcactacgtctccccaaacaatgccaccagctgaagagcaagggtccaaatgcacacgtttatgggggacatactccttcaaaccactgcagtcatacaaaatgaaagaaaacgtttctggagatgtagttggtgaaatggctgttcctggctatcaaattgattgtaaaagtggaaagcactacagaccagaattagagggctcacctgtgacccagatcttgaggctggaagatacaagtttatcacctggaccttggcatggagatcttgaggcaaagtggtcaagaaaagcttaggcccaggcaaagtaatacacatctttaatcccaggagactgaggcaactctgaattcaaggtcagcctgggacaaagcaaatcccagatccaggggtggtggcgcacatctttaatctgggccacaccttctgctggagacgtacataaggacattggaagaaggaagattgaatcttcttcacctggttgcacttacttgccagcacatttacttaaaggtgtacaccaccagaacgtacttctatagaataccagctgaaacaactagcctcatgggactgagcaaccactaggctcttggactacccatgcacagctgaccattgttgggttagttatactacagactgtatgtcattccaaaaagttcccttaatatagagagactatccataagttctgtgactcaaaaaaaaccctgaataatagtcgattagatatttatttttaatatttttatcttatttcttttaaaagattcattttattttaaataatgtatgtatgtgtgtatgtatgtatgtatgtatgtatgtatgtatttctgtttatatatgggtatatgcatatgtgagtgttgttcaaaaagttcaaaagaaaatgttggatcccctgggactggagtaagtggttatgaaccacctggcatgggtgctggtatcatacacattaattatatctcaaccatccctggctggtttcttgacatgtttgaaataaagataactatcgatgagatgaagatgaaattgaactgtaatcagaacatattgtatgaagaaaaatataaatctattttttaaaaaaatgtgatattgaatctgatctcatgaggtaaatttcacattatctaagaactactggtaaaattaaccattgtgtaacatggtctgtttgtgatcaattacgttaacacttgccatttttcttctgctcctagagatggaacctagaatcatatatgtcctaccacttacttactaccccatgtagtctgttgctttcagtaagatcactacatagttcaattgaagaccttagctcacagtttcccaaataaatggatgtaggtaggttaggcatcataattaatgagagaagacatttgaaattattgctgactgacacataataactgtatgtatggggttgaagagatggttcagcagttaagagaactggttgctctttcagagaatccagtgggttcagttcccagcactcacatggcagctcacaaacatctctaactccagttccagtggatttgacctctctcctgacttctgtgggctcctgcatgtggtacacagatttatactcaggctcacatatatgcataaaataaaataaatattaaaaaataattgtggccaggtctggtggtgtatacctttaattctagcccatgggaggcagaggcaggcagatctctgagttcgtggccagccctgtatacagagagttccaagacagccaggggtatatagagaaacctactctcaaaaaaacaaaacaaaacaaaacaaaaccaagaaaaaaattaaaattttgtatgtaccaatgggacaaaatgtgctttcactttcacatacatatacattgggtaatgatgtgactatcacatttaaacatttattatatttctttgtggtaagaacattcaaaatgctctcttttttaactatttagggggaaagttaatttgagtgggaatcttctccatcttaaaaagtttgccttgtgttcttctagattattatcaggattcaactttacaaactgtaacctttctcaatgcttaaatccagaatagaaagtagtaagacaatacagaattgaagtttaagtctcagccagggcaggagaagaggacaagctatcagtaagtaagaactaccttcacaaagaatcttagcattccaccttaaaaaaatctaactacgcagaggcaagccagtcccatctagacagttcttaaggaggagagtaggttttttctctctccctccactcataggacgtgcctgatcttcttgaatagtccagcacaagctaatccacaaggttcaatcaggctaagtagttaggggactgtgttaactctgaattacaatgagcagcagggaaggatctgtcagctgactaatcagggatagtggattttttttttttttccagctctgccgcggtggtaatggaagcagccgccgtagctttgtttgatagagatttttggctgctggttttaaataccacccaagaagcagctcgtatttcatcaatgttgtgttgacaatcggaagagaagagtgtggttgtgtataggcgagatggcagaagcaaatcccccgagaggcaagatgaggttcagaaggaatgcggtaagggctctgcctgcagtcctggaaagcctattcccaagttcaagtgcagggatgctgcagcatagcctcgtgctactgcacaaactgctgagtggggcttttaaggacagaaggggagaatggagtcttggattttcgtgaatggcattgatgtgattactgtggtactggcttagggtgatttaaggaagtggaggaggtagtcatttaaaatctcaatgtcatcaagtttatcagagagtattgttgatcatattatttgttttaagagtacactagcaattaggaattgtttgcctgcatagctttaaagcaccacttaaaagaatatctaacaaaggaatttatgctttttttttggacaagggtcaagtagaatgtgatatcctggatgggtttagaggtgatttcatcagcacttaaaaaggcatccctgctgagctgtcacttcaaaagtggaaacatttaaacatctgtaatgatagggaatttcaaggggaaaactcaagcctacagacaactgttttaagggacagaaaagtgacttgttttccaacataagctaaaatttcaagtccctcctttagtaactttccagaaactttcctgtttacattttcttcattcgtttgttcgttcattcattcatatatatattcatattctaaattattcataaaatttctaacacgatcttccaatttgttttgagaaacattgaaataaccctagctaatctaataacaaactggtcatccacaagtcattaaatgtcaccacacacacacaaacacacacacacacaatgttattgttgtgatgccttaagatacaattattgaggaaacatacaagaatgaaaagcccaaattacttatagaaaaagctcaattaaactaaactcccactgaggacaaggaaaggaaagattacattgttgctgagtggtgtcgagggccaatagttgagtgaatgatttttctgataagggtttttaaaattacacttattttgataaggttatatattcatacctacacatgattttatgttatgaaaataatagctgtagacttttgacaatttatgatgcatgtaaaatgtctgtgtatatgtttttgcaatagtgtatggggctgacattagcagttttattatcaaaggtgccttgacttcaccttttggaaagtttgtaattcttttctgtacatacatctttaaaatgctgagcttactcttatatataaatgcttccacatacacataaatgcagtacacaggtatcgattgaataggtatatcttcattatgctacctaggacagcagtttcaatgggaaatatgtaacaattactgggcaaaggcactctcagtatagcagagaggtaaagtatatttgtaaatatatagttcaaaagaacttgaagctggaagtgggtcaggtgttccatggaagatgtgtttgtttgcacacatgtcactacatgtgtttctgttaggcttccctgatttttcccatgaattttatttctgtcaaatgaattcctttaagaggccccctaggaacagatatcttaaatgcaattgattgaattgatttttgaagcctagagctacagttgtaggaaagtttgctttgcttactagagtgaacatttgggccctccagttagtgacaaaatggcttaattgggaagaatttttggatttggcctgcttctggaggttatgatagagtgaacaagatggtctagtagaatgtgaaatctcaagagaggattaaactgattatctggtagaaatcgaatgattagctgagtgacaaggaggagattagaagtgatacgtgtgataaaatgagcaaaccacaaggaaggggtattgctcaggaccgcctgctccccagggctcttggcaagttccttggcaacacttggagtaactcatatgttctgtactcttgaagagtggggatgagaagggatggggaagtaagcatagaaaactcttctctgtagctctgggtaatggagttttcccatgacattattttcagtcatgatattagagtatatcagcttccattccatgggctacatgatgctaaactgttttttataacttcagaaattgctgctgatcccatttttgtagagtcaaatgatttcatttctcaatttcaaagagtaaatctgtgtttttgtgtgtgtgtatacatatatatgtatatacacacacacatatatatgtatatatacaaatgaaaggttaagtgtccatcagaagctatatatgatgtatataggccttagcaccactgtttacctgctgggcttcaatttgtccatcagaaagaagggataatatctactgtgatccagtagtaggaagaccaaattgaacagtataacaagcctatgatgtaggtaaagcttttcaggatcctgaatattactgtctttttttgcctgaaaggttaaaaaagaaatgttatagggatagaaactgctttttaagaaaatagtaattaagcaaaagtttagttatgtaacatattttgaacatttccaaagaaataactagagaggctggagagatgtcttaatggttaagactactggctgctcttctagaacacaccagtttggtttctagcacttacagggtgcctcacaaccatttgtaattccagttctggagaatcctatgccctcatctatcctttgcagacattcatgcaggtaaaatgtccatattatttaaaaaaaaaagaaaaagaaatacttaacaatttcataggatgagcgaattgcctcccttatcacacagaagaatatttaataactttacttttagggcgttaatagttaaatgtagtatcaagcttatgcctcactgaaagaccatgaacagttctgaggttggtatgagtcaaggcaagaaaatctgttctctaggaggggaagatagtagagaatatgttttctgtctgttttcttgaagaaccaggaaatgtggcagacagctgtgttggggctgttagcagtgattggacacatgacagtggcagtgggcaacatgttcctgttacagatacgtgcatttaattaataacgtcacatgttagaatctcaaaagataaaaatgtctaaaagaaactcaaaccaggtgctgagtcttctcagttttatcgttcttttgtttgattttcaaagaagaaacaaattaagactgacctaggactattttttgttgtttgggcaagttcttaaaaagaatgtatggatttagaatgtagtttaattttagagaaaatagaaattgtgcctttgcatgtttatataaccatacagattagatactcttaaagcatttggaaaggctgtattactaaaacttggcggtcatagcctgtgattgctgtcctctctatatctgttataatatgctgttcaatttttttccttcatttgagaagcattctttctacttaactattctaagtactggttgcaaatgcctttctagtacaaaatcattcctggggattatgaaagggaagttcttcttagaaatttttcaatctagtgtagaaggagagaaatttcaaagacataattttaaaagaaactgcaccatgacaacacgagtagttctttttttgcctatagatttatacttgctctttgtttcactgtagaatgattctgaaattatctttgaagatattatattaaattaatagtctcaaacttagtagatgcttgagggcaatatctatacagctactcaacaagtgagttctgtcaaacagttcatctgatttatcagttatttgtttcataaaattgaagcatgcagttcagagcaggcatatcagttatattttctgggctcacacaaatcaagtacactgagttttcagtcttagtcccagagtcttaatcagtcctgagcatctgcttggcaaattttcctgtaaaaagtgaatgtacaactttacacaaatactgttcacaaaccctcttttttcagattatgtttttgttgttttatgatcatggggaatgaactcaagacctcatgcatactaggaaagcattgtaaattcttagcatatatactctaacaaatgaacaactaaacaaaaatacatataaagcagatatattttaagagattcttttcaggactcaaagccttaagtgtgtaagggtaggagtatttatatttatttaatgcttattctgaaactcgcattcacagtgaacattatctttcaaaagatttatttatttttatttaaatgagtacactatagctgccttcagacactccagaagagggcattggattccagtacaaatggttgtgagctaccatgtggttgctggaaattgaactcaggacctctggaagaacagtcagtgatcttaaccgctgagccatctctccagccccaacaatgaacattttgtaagtacattgtagctgttttcagacacaccagaagagggcatcagatttcattacagatggttgtgagccactatgtggttgctgggatttgaacttgggacctttagaagagcagtcagtcctcttaatcactgaaccattattaaaacactgtgctaacttcttaacatgaggttctatttccatctccatttaacaactggagaatctgagtgtagtgagcaggataatcaacctctgtgtgtctatgccttgatcccctgaacctatgaataggctacctgacatggtaaacggaattttatagtgtgacaaagaatcttgaggaggccaggattgcatctcaggtggtagactgcctgtgtagcaatgacctggttatacccagcagtaacatgaactcaatgtggtagcacatacctgtattagggagttagaggcagaaaggtcagaagttcaaggtacaaaattcaaagggaacgtgggatatatgggaccctaagcttgagaataaaggattcttgagattgggagatgatgcaaaatttccaaggcatgatttgtatcaagacaaggatgttcattatcaaagagatacgagttggagtgttactctgtagtaaagatcttatctggcatgtgggaggccttgagtttcatcctgagttatcttttaaaaggaaaggaagtagagaaagcatcggaaaagatgcatgacagaagtggaggtcaaaccattgaaaggccataaaccacagaggtgatggactgtccctagaaactaaaaatggtcaggcaatagattcttagctagagctcctagaaggaacacatcctagagatgccttccttgattttaattcagtggcgctaaccttgaattcctgaccttcagaagcacagtaaaaatttgtgttgttttaaatcactaaactttagtaattgcttatagtatcaatatggaggctgtacacagagttttatcaagtacaaacaagaaatataatcaaaaccctagttcacctgactgcaaaaccagactctagcaacagggaaacattggagaagcataatagggatggtatcactttatagttcactccctaaacttgagatgcgaagtaaaggtgacaaatctaaatgtgtacactgcatgtgaggaagacaatggagctgggaagtagtgggggtttagttaaaatacaacctaaagagtagcaaatgttcaccagcacacatcccttatgttgaggagcagcaggaattggaaatggtgagcactgtggtgaactagagagcatccaaaaatggggcactgaccagcccgctcagtcaagtgtcatcatgttgggaaaatgggcccaagcactatctaatctttgatttctcacaagtaacaagaaatccaactcctacatgatacccgtggttttagtttactccatttttaatattttatatattcttaatttgtgtatgtttgtgtggggtgtgtgtgtgtgtgtgtgtgtgtgtgtgtgtgtgtgtgtgtgtacatacgtacgtgcatgtacaagtgtactcagaggccataagagggcattgaatttattggaagttggagctacagatagttgtaagctgtctgatacagattgtgagaactgaatttgggtcctctgggagaacagccagtgctcttaatcactgaactatttcggatgcagcactccctccctccctccctccctccctccctccctccctccctccctccctcccttccttccttccttccttcctttctcactatatagccctggctggcctggagcttgctatatagacaaacctgtcctttatcttacagacatctaggtttttaaaatttttgagattttgtttgtattttatgtgtatgaatgtttatcagaatgtacttttatgcaccatatgcatgcagtacatgcaatacctaaggtgaccagaagaagttaacagatcctctgggagtagactttcagaaggttgtgatctgtttgatttgagtgctgggaatcagacttggatcctctggaagatcagtcagtgctcttcactgctgtctcatttctccagccctgagatctaggttttataccccagtaatgttattcttttttttaaaatagactttttatagagtatttttaactgctgaattaaactgaacagggggctctcaggaactcacggttaattttgttttatagctttgttcaattgccagtggtgtattatacttacaatgaatatacttgaagtgtttttctatagttcgctttgctatgctttaatctctcttgaggctgatgactggactcccagactagacctttcctgcccctccttccctgaagatagctaatgtatagatgtcatgagaaggccttgtgggctcttccaacatgcaatatctacagaaaggaaccagaatcttgccttccatcctataacatgcttcgtttttgttcccatctgggttactcaaatctcaaatcttgggatggattgcactgattaaatgtatattaaatcatgttttaatgatgctacttcttgggagtttttcctgcctcctgccactttcctgcctcctgccacattttgctctggttcaggatcagacttgattttaaagtatgtactgttttccacagttatagcaagtctccttctacttatgtctgaattcagttctttctcaaggctcatgatacctttctaagcatggctaggaatgtagtaccatagtagaacacttctatagatctctaggttcaattcttagcacaagaaaaatttaaaataaaataaaatgcatatctgaccatggtgctctggtattcaaaatgtcctagaaatttctttcacttctaaggggaaaaacaaacatcaaactcactcctgttgtggttcttgcctacttctccaccaccttttccctccaacatctgtttccttcacatttcttgattgagaatcttcaaaaggtgaggtagtttaatgactacggctccagagttagcacaagccagggctatataagttatgcttaaacactatgagcttcactttatttgtaaaaggggcaagttaactccttcactgaactatgctgaagtagaattaaaagtgttggcaaaatatttggcatagcgtaggcatttaatatgtggtggtatattaatattgggccattatttttcctttcattgctaatcttgcatagtatcctctattcctttactttgaaattcctttatgtagtaattattttttcactgctatgaatgattgcctttaactgtcaatttgatacaatctaccatcctttgggaagagagtctcaatgagacctagggaagactgctaatatgggaagatcatcctcactgtagatgccatcattccctcgacagctgatccttagaggagaaaaatgagctgagaaaacatccaagggtgatatgttctgctcttgatatggatgggacaagttccctcatgttcttttggctatgagtctttccccgactccatgatagattgcgaactaaaatgaaccctaaaccctaagtcagttttggacagaatattttattacagaagtaaaagctagaacaactgcctatgtatgccagcctttttttcccctagaagctgagcaaatactgaaattaggatggcattttgattcaattaattcctcttttcttcctcaaaccccttttggccatcctgtttctcacaggctttgtgatattgcttcctcatgtactttactctaattattttgtttctttttttttttaacttactctgctgtactattactgattactaataaacttggttattgaaagtgcttgatattatttcattttaatgtatggagtgaacacatagtgacaaaaatgggacttaattggatgaaagcaaaattgtggttctgtgatgtagttttcactcattgtttagggtagatagacaacatttcagttctggttggctttttgggctaggacttgtctcctaattctgtttttagaaattattttaaagtttattgttattatgatgtgtatgtggattttatgcatgtgagcagctgacaactctgtggagtcagcttttgtaggtcttggggattgacctcaggtcaccagtcttgcacagcaagttcctttacttgctgagccatttggctggcccactatctgttttcatttatacgggaaatagaagtaatttgacttcaaattcagcaaatccacgctataaaagcaaacacataaactaatgaaattaaacagaacccagaatttattgtcaactgatcttcaacaaaaagatccaagagaacatgtaataaatgggattggggatatacatataacaatgaagctaatttcctatcactgtcaaaaattaactcaaattggatcatggacacaaaaacaataacccaaaactataaactattaacaatagcagaaattataggaggagttcttaaatgaattggtatcagttttaggtatacctaaaactgcagaccccaaagcataagtaggcaaccaagattaaatcaatgaaaagaacttttgtacatccaaggaaacaatgaacataatgaatggatagcctacagggtagaggagttgtaatctagcaacatggctgctctgatcacattcaaagaccttctaggtctctatgatacagctggaatgctgacatgcccttagtacacacctttaatttttctggctggaatcctttagtacatacctttaatctgaatcaatggcctctaattgagtggcagacaaagtgatgaatcagagatagatttgacagaatgagtcagagaaatcacacatccaactctcaggagaaaagctatttaagagcagctcagggagaatgaagatgggttggtcagtccatagggagtcagcacagtgaatgcagtgcagtggaattgagatcacttgtgagtccatgaagttcaagtcatacagcagaggcagttgaagccagagaataagaaggagccagaagattaggcacattgccagagtttgaggtcacacagagcaattcagtgaaagacagatagaagccaaattcaatcaatcagcttggtgagaagtttgagccagaagagccgagttgaaccagccatctagagttcagaaagaactagaaagtgggagcttatttggaagtagccctctgagataacaattacatctggctaataaaagttactacaaatgagaataatatttgtaaactgttcactgaggggctaatacctagattattaaaaaaaaaaccctcaataggaaaacaaaacaaaacagttctcaaaagccaaatctaattaataatgggcaaatgatctcaatgacatttcttaaaagaagttatacaaatatccaataggtatataaacatgctcagcataactaatgagggactttcacagcaaaatcacaaggttagaatggctaatatgcttaagaccgaaaccagcatgctaggaaagaaaaagagagaagagaccccttgtacatggtaagaatgcgaatcaatacagtcattattgaaaacagtttcttcacagaaaattgaatatataattaatgtttaatccgacaaccccacttatggtatatccaagaaactgaaatgaatatatcaaaggaatacctgcatatccatgttgattgcaatacaatctacgacaggcaacgtgtggaaccatgcaagatgatgatccattgatgaaaagataaaatgttgtttacacacattaaaactgcaaaataccatccattgttttttggtagcatggatagaactggagatggaaattgtattgagtaaaatgagacaggcatagaaagagagccaattccatatttcactcattggtagaggctacaaaggttgatcctattgaagtcgaatgtattgtataggaaggggaagggagagggggaagagacacacagtgaggttggataataggtactaaccagtgtacagttaaagaggaggaaggagtttggggtcctaaaaggcagtgttaattatactctgtaattacaagataactacaagagtttgaaaattcctaacacagaaatgctgatgtttgaggtaaaggaaatgctaattaacttgatttgattagtatgcattatatgtatatatcaaattataatggcataacacgcaaataggtacaaatatttaattactcaaatattgtaattattaataataaagaaaactttaaaagcaaaactaacttcaagataaaactttagagtctaattatttgcagcttaagacctgcttatgtcctgtgagaaaaattccatactggggacattataaggatctggcctatgttatttttatttctgtttccatgtttttagatattatcagcatccatttaaacatgttgacctcttactgacttctctaacttaaaagtttgcttcctccaatgacatattttctgatttgtgctcagttgggagttggtgtgcccgcttactcttctatttcttgctccaggcctccttccctgggagcttacacttagtcctggttttgcgtcctaccagttttcttcaacggactttcacggacattggatttcgatttagccaggaggattttatgctgaaattaccagtaagattattgcttgaatcttttatccttctactgcttatatagtctgtatcttatattgtttgttttatatgtgtctatgtaacacttaaaatttgtctctcaaaaatttaactctgcaatgtcctacaacaatctgtttttaatctgttgttaaacagggcaacttataacaatgaattcctttaaaaatctttgctatgtgttatagatgtgtgcatatgtgtgagtatgattacgaatttttattttcagttaacattgtgtggtttgtgtatctgaaatgccatgatcctaagctagctcagagcactgtggtctttattttgaaaatatatctttatatgtttttattatttgacatagagtgctcataaaatttaatacctgaattgtaacttactacacaaagttcctttgctttgttctgagcactgaaattgttgtgtgtatgtgtgcatgtgtatatgtgaatgccaaatttctcataagtaatgaaagcttttagacaaagaagaattaggtgttttggtttctgttgaagttaattttggttgatagagatgttttgtaaataaaactttggtttctgaagaaagttaatgcatccaggtgtgggggcatgcacaggacagaactgtttgaagcatttataccagataacagtctgctaagtatttattgaaattcattttgcagtttgatagagggctgtcatgaaggacagttaacagtgtctttcttgcttattcacataggttgttatgctgagctcagttagtgatttgctgacatacattgatgacaagcagttaacccctgagttaggcggcaccttgcagtactgccacagtgaatggatcatcttcagaaatgtatgtgcttctgcccttactgtagagcctatccttcattttctctagacatttttcctacttgggaaaagcagatttttgggtctccaagtgttcaaatgcatatatcattcaacattttggttttcttctctaagagatatctagaaatgatagagtcattaaggatagcaattgaaggagaggcttagtgaaaaagaaaggattctctctctgcccagttcttcctgtgatcatgcagtaacacagagacaaagggcttgggttcaaatcctggcactgctgagttatgtcttagatcttagacaatatataccacctcaccaagtctttttataactataaaatgatactgatagtatatcataaggatcttgggaaggatcaatgagaaaatgaataaaaaagttttgcttattgcttggtatatgggagatgctcagaaaatacaagtatatttatttcagcctagatgtgtggcactcccacagctattagactagatagaatcctgtttttggagattttagaagaggtaagggctgtggcctcttaggtattataaagcctatgatgtaagtgtcttaactttcaatcacatgatctgaaaactcttctgaagaaaataatgatggtcactaaattagggtcacatttcctagtccttattcaaactgagtgtttggcaggttcattcagcaattcaggtgttcgcatgaaggttaactgttagagcaagcaatggcttgacctaaataatcttcaaagcctaaacgaatgagcaaatattttgagattcatgcctaacagatggtttatattgtgtctgtgttttcccctgtcttcctgtggtggatttattttggaaacaaaatagtgcagccatccttgccattttagggcaatagcacttttgggatcgcagtttcagatctttggcagtacctgcaatgaattgttgtgacaacttgttctccagttccttagatcatatgcttttgtggagtgctgatcacaaatgctaataaatatcaacttacagcactgttctcatgtctctttagaagtgaacttttttttttttttttggttttcccgagacagggtttctctgtatagccctggctgtcctggaactcacttcgtagaccaggcttacctcgaattcagacttacctcgaattcagaaatccgcctgcctctgcctcccgagtgctgggattaaaggcgtgagccacaacgcccggctgagaagtgaacctataaagcagtttggctgagtgctgagtttgataaagtaagaaagacactgatggtcaaggccatatagaaaattactcagcacatggtgccatttagaaatagtttccacgagtgttcaaggaacaagtccagaaatgtagaagtgtacactcaaggatttttgacactaatttttagaatcttaggggttttgatgcagagttagtcctaactgtcaggggtagtgccaacttttcttagaggagttcgtagagtacatgtttgttgtttatacatatgtaaagaacaatccaaattactgatccaaagtttgatatgttgtcagagtttccatcaaagatcccctggatttttacaggccatagagaagtttgctgtcacagtgaaagaaatggctcagatgttgcaatcctttggaacagaattggctgaaacagagctaccacaggatatcctttcaatagaagagattctggcaggtcgagccgaaaggtatcacctgttgaaggtatgtatcctctcttctcttctcttctcttctcttctcttctcccctctcccctctcccctctcccctcacccctgtctcccgtctcccctcacccctgtctcccgtctcccctcccctcccctccccgctccctctcccctctcctctcctctcctctccccttcccttcccttcccttcccttcccttcccttctccttctccttctccttctccttctccttctccttctccttctccttctccttctccttctccttctccttctccttctccttctccttctccttctccttctccttctccttctccttctccttctccttctcctttcctttcctttcctttcctttccttcccttcccttccctttcttttcttttcttttcttttcttttcttttcttttcttttctgtatcaggaagggaacccagggcctcctgaatgttagacaaatactctgtcactaagctgtgattctttgtgaactaggctctcatcatgttctccagaataacctgaaagtcactaggtagcccaggatgacttcaaactttgaatccttttccctgcatctcccgagttctgtgatttcaggtatacaccatcacaccgtgctgcttggccttggttgttcatgctgatttttacctagggaaatggaaaatacattgaaaatattttttttcttttatttttatatgggtgttttgcctgtatgtatgtctgtaccccacatgtgtgcttggtgcccgaagaggccagagcgggtatcagattccctgggattgaagttataggtgattatcagctggcatgtgtgtgctaggaagtaaacttggatcctctgcaagagaggcaagtgctcctaactgttgaggcatctctccagtcccttgtggaattgattttgttctgtctgtggtaggtaggaaagaaatggttctgacaatttagaggtccttttctcaaaatattggggaacaatttgaacaaggaaaatcagacatctgagtattatttttctccctcacccataatatgtaagttgggtgccaaggcagttttgcattttatatagggtgatatgttttaattaaaatgtgaggaaccaaatgtttgcatcataatttttgatgatgattctcatgatggttcctgactattgtggtggtggttgtttagggtttcttgtagcttaggcggctgtttgtttttttttttttttttttttccgagacagggtttctctgtgtagccttggctgtcctggaactcactttgtagactaggctggcctcgaactcagaaatccacctgcttctgcctcctgagtactgggattaaaggcatgcgccaccatgcccggctaggctgactgttaactcacaactgtagctgtccttgaactcttgattttcatgaccagttataagcatgttccaccagcaatggcttggcttgcatggccaatttatatgcagccgtagggatgatgtagtgagatatggatatagtgtatatgtaatatgttttttttttaatttttttttattaggtattttcctcgtttacattttcaatgctatcccaaaggtcccccatacccacctccccaatcccctacccacccactccccctttttggccctggcgttcccctgtactggggcatataaagtttgcaagtccaatgggcctctctttgcagtgatggccgactaggccatcttttgatacatatgcagctagagtcaagagttctggggtactggttagttcatattgttgttccacctatagggttgcagttccctttagctccttgggtaatttctctagctcctccattgggggccgtgtgacccatccaatagctgactgtgatcatccacttctgtgtttgctaggccccggcatagtctcacaagagagagctatatctgggtcctttcagcaaaatcttgctagtgtatgcaatggaaggagttacggagacaaaatttggagctgtgacgaaaggatggaccatctagtgattgccatatgcagggatccatcacataatcagcttccaaatgctgacaccattgcaatgtttttaacacacagtttatgcttcattaatgttagttttatttttaaaatattttaattttcttggtgctgggaattaaacttagagcctcccccttgctaattacataccattgccacactatctttttttttgttgttgttgacaaatgtctactcataaccttttaagtcccttggaccttctgaagaaaatcttggatcatgtagataaaggaaaaaagaaaaagaaaggtatatggttctttctcagtatgtattaaatctaccttgtagcttcatgctttctgatattgtagtcgttactgtgttagtatggtttcatctgagcacataaaatattatcaaaatagaacaagattggttagaataacatctttggcctccgtttctaacacgtatttcactgtcatgagctataggaaactaagttgtaggatctttttgaaggccatctgtaggaatgagacatcattttggagatgttagaaaaatgtctatcaagaatgatatataatgggggctcagatacatattgagttttaggcgagcctattctacatcagtccctgttgaaaaggcaggatcttctttgagtctcctgtttctgtcagtggccacagcctgtatgtgcaggtgagtgtagggaaagcagaagatggttttgttcctcattcatccaccctgtttttaatttgtttattttattattattattttttaacacatatggagttttccttgcctatttagacactatattcattcactggccatagagactagaagagtgtgtcagttcccttgcaactaactgaaaatagacagctgtgagccaccatttgagtgttgggaatcaaactcaggtcatctagaagagtagccagtactgttaaccactgaaccatctttccagcttcccaccttattttttttctgagacagactttctcagtggcctagaaccaagtaggctctgctggctgactagtgagccccaaggatctgcgtagacctactcccccggcacagatattatgagtgtacaccattatacctggcttttaaaaaaggatgcattttggatatggaacacaggttttcatgcttcaaggggaagtacttttatcaactcagccatctccctggctacagagtgtcacattcgcagattctttgaccttgaaatcctgtaaaagccaaggaaggctgtgctagaagcgcttctgtctcctgggccatgcatcttccatagctgtatatctcttcaagccattcgtgttccattatgaactaactggctaacataccctgccgtgccttcctatagaatgacttaactgctgtaaccaaagaaggaaaagttctgctcatgaacctgcaagtgcctgccactgaagaaactgtcagttcaagccttgaatgtactcagcacataaatggcgactggcaaactattaaaaagtaagcactcccttcttttaaaagtcacttatattttcaaactaggaattttacattgtttgttgctgttaggtatgaaagtatttctggacctctggaagtctgggaacttcttgtctgggttagtctgcagacagtagttcgcttgcagaattaagttccccagacattgatttttctttgcctgagccaagtgtcatagtgtcatagactatttttgcttataattctttttttcctgtttttgagaaaggatcttaccatgtaactctagctggcctagaacttcatacaaattggactagacttaagcctacagacatctgtgttcctttacatcattactactggattagaggcgtagcaccatgactggtctttgcctataattcattcttttttttttctttctttctttctctcttgttcctatagaggacatttattttgacttgcagtctccgagatttcagtccttgctcacgtgaccctgtcactttgggcccttggcaggacagtagatcctcttggttgggaatgttttaactcttaattagcagcttagggttagctctatacctgcatccacaagcggttatttctaaggaattctttgccttctgtttatcaaggttgctggctcaggtgcatgatatggaaactgcttttgatggattttgggaaaaacatcagctgaaaatggagcagtatctgcaactgtggaagtttgaacaagactttcaagaggttagttaacacagttccttccttgtggtggaggccctcattcatgagcttagaaggggcaggcttcttacaagatgccagttttcagctccttgacttggaacaaagaaaatcttggctaactcccaaagccttcacttcgtccactgagacaaagcactgacatgccatttagtatgacaaggacattctttctctaccttcatgatcattctttaaactttttttttttttttttttggttttgcgagacagggtttctctgtatagccctggctgtcctggaagtcactctgtagaccaggctatataaagtgcttttaggctataacatcgttttctaagaaagtgatacctattgattgtcacataccatgtaccataggtattgccattttcacctaaacattttatttttttcttacagtaagaacattgtcttacagaatcgttgttcagttatcaaaatcactgcgttcaatggcagtataagacctttatgttacctgacatcatgattctaattctatcagttaacctaataatgcccttaaaaccaccaccaactcacacatgcacacacacacacacacacacacacacacacacacacacacatcataaaaaatggcccatcttggtttttgagactaggtttctcattggctgtctggtcagagccttatgtatccttctatctccacctcttcttcactgggattataaacacacagcgccatgccagacttttacaaatatgggttctgagtattgaatttaggtcatatctgtgtgataagcacttttactggctgagctattgccccatatctcattgctattctttttttttaagtgattttgttttaaaagatgattttatttgtttatttatttattaattcattcgtgtgtgtgtgtgtgtgtgtgtacctgcataatcttatctacagcacatttgtggatatgcctgtggagatcagagagtgttgtatctcctggagcaggaattacgggtggtaatgagtagtagcctggtatggatgctatggatcaaacccaggccctctgcatgagcagttagcattcttactgctcagccatctctgtagtctataaaggattgacaaagaggtttatttatttgttgtttgttttgagacaaactctcattcatagccttggctggcctagaacttactatatacaccaggctagactggaactcacagagatcatcctacttctgtctcttgagttactgagattaaaggtatgagttactgggctggagagatggctcagaggttaagagcactgactgctcttcccagcaaccacatggtggctcacaaccatctgtaacagaatctgatgctctcttctggtgtgtctgaagacagctacagtgtactaatcatatatatcaaataaataaataaatctttaaaaaaagacttgcaaaaaaaaggtatgtgttactataccagactaaaaacatttgtttttattattctaaaattgtgtgtatttggatatgtgggtatgtgtaaatcagtgcaggtgcctgtgaggtctttgttaacctctgagccatctcaccagcctttgtcttccaatgctattctgaacttctttgatatttcaaactggctactctagtctcatgatatttgtcaggattagaaaaaaatttatctccttcctttcttgagtgattcaagctcatcttgtgtgtgttctgtcttagtctcttagtctgtcttggttactttttatgggaaatggtatcaaagatgaagctatgggtggaaggtgtgctccttgctactggagtttcttgtttctagggccagttactacatagctggggaaagcatatgcacatatatacaagtatgtatatgtgtgtgtatatgcatttatgcaagtatgttcatatatatgactgcacatttatttacacagtgatcttatataaatcctgtgtgcatggatatctatgaggctatgaataaaatagctgaacatattctctatgtgtgtaattttcttatattggcattctcatttaatagcatttcttatttaatgtgatcattactaaaagtgaatgcttaataattcacatcctcttaaaacctttatttcttgcttctaggctgtgactcaagttgaatttttattaagtcaacaaagagaactgggtgatataacagggaacttagctcaagtaaaacaaagacttaaaaaactagagatcttagatgataaatctcaggtaagataacattttaatgtttgtttatgtttcactagggcttagtaaaaatgtttattatacttagcctctcataactatataattaacacaatcatattaacctaaaatccattgtaagtgtggccctatggagatagtgcagatgcatcatgaagctatagggaactattaagttgtaggatctgtttaaaagctgtctgtaggaaggagatgttaggaaaaaaaccctctatcaagaatgatatataatagggtctcagatacatagtgagttttaggctagcctactctacatgggattctgtctcaaaaaaaaagtttttggtatctggaaattatgaaataagactatgcattgtttaatatctatcatgatacatacagttgaatccattatagacccacacagacagctctacttaggctgactagcaggtaaaatggcctaggaagagcttagcatagctcctggatatatatgtactcaaaggaaaagtagttgtcagctttcttgttcattctaaagtgtagattcatgactttagtacttagtaaactgcctttgctctcctgtcttgtataccacagcaaagcaatgcttttatagatatgttcttagaaaacagactcatgagtgaaccatgaacatgtgcaaatgaaacttacaggctaggggttgcagtaacaagtaaaattattagactttcagactctgatcacaatccacacctccctttgacagcatggaaagagaaggtgaactgatttggaagccagggcctttgttttttttaataacttttcccaatgtgatttaagacgtatggcacagaacttgtcatttgaagcattcagttcagtagttgtcctagtttctgtcccattattgtgacaaaacactctgagcaaaggccgctttggggaagaaaggtctatttggcttaaagtttgagatcacagtccatctttaagggaggacaaggcaggaacctgaagaaaatatcatgagagactgttgctttctagcttccttactggcttgtgctcagctagatttttatacagctcaggaccagctgcctagggatggtgctgaccagggtagtctgggtcttcctacatcaatcactaatcaagacatccttcacaaccatgcccagaggccaatctgatctaagaaagtcctaagttgaagctttcagtccactctaggctgtgtcaagttggcaagtcaaactaactaaacagtagtggtcctcactctgtagtggttcatgaccattctaagggtcatatgaccgtttttacaggggttatatatcagaagttctgtatgtcaaatatttacattatgagctgtaacagtagcaaaatgacagttataaagtagcaatgaaattaattttatggttgggggtcaccactacatgaggaactgcattaaagggtgacagcattaggaaggttgagaaccgccactctagtctatttaaaaatcaattctctactgtaattgtgtgtttcccaatagctaggaaggccagtcccacgctcagctgggcttcaatttgctttattttgctttgggaaacatgtatgttcctactagttttcagtcactgttctattctatcagtagttgatagaatggatgtagggccatgagagtcccttctgatattcactttaggtatgtcagaggcactcaggtaagagggggcactggaattgacatagaaatgtattagtttttattttccaggcgtttactttacattgggttctctgtgtgtttttgttttacatctgtgcacattagaaggcactctttatatcctgagtggaatcaagtgattgactttcattttatactcagaaatttgtgtgcttctgatagtcactgctataactcatcaatatcactgtaagatttttgtgtgtgttttcttttgttgaatgcagaaaaacggcaaggaaatcaatcatgttttgtgaccatatcccctgccaaatgtgttctttaatgattctttccccttgctctcccccctcccacctgttgtatgagcagagatcttacaattatgatttttctctcctctttcaaatcaggaactgttaaccaaggcccggattgtgatactacgtggccacaagctggcatcgaatcaccactatgcacttgatttaatttgccagcgatgcaatgaactacgctacctttctgatattttagttaatgagatcagaacaaagcgggtccaactgagcaggactttcaaagtgcatagactcttacagcaggtaatatgattgggaatgatccatatctgaaagaggccataattgtttttttcttgagttctcccatcttcatagtcttgcccatatttgctcttgtgccttatggtacacatttcatcttctctcaggcttgtccatatacctcttcttagaggtttagtgtctacagtgttttgtaagtgatcttaaaccttgggcctaattgtggataatcaatctatctctctatgcactattcatggtagacccagtgtagtaccagttttgctccattttcaatgtggagacagtggcggtgatggcctccttctagtttacatctatttctgaaacctggtggtattctgcagtcagaacatgtacaagcccaggggcagaagcctgaaattccttctgcatttcatagtacagtactaaaaattaactggtaaatgaaaaatattctgtcatgcctacgggtcagtgaatggaaatgccaccctacagatctagtcatggcacaggattgtaaacaggagtgccccttgtaaacattacattggaacatatggattctaatctgcacatctctttttttggttcaaaaaaaaaaaaaccgtattcttgtccttggcaatcattaagcattgatattaaactttatattttgttagaagtttcatatttcagtcattgatttgtagaaaataacatgcaactaaactgttagtgttgagaaaatggccagactcctgctgcaggagaaattacttgttatgaaataaatgcagtgcttcccaaccttggctctgcatcagcaatacctgtggagcgctttaacagtataaatgtctggctggcagcccagagctactgaatcagaatttctgggggcaaaaccagatatcatttattaacagctctgaaagcatttttctttttcttttcttttttaaaaatggagacagaatctcactatgaagctctagctgactaggaaattgccatgtagaccaggttggcttcaaactcacagagattcccctgcacctgcctcctgggtactgggattaaaattgtatgccaccctagctgggctctgaaaataattctgattgacagaagcggcacagctccagcccacaagatggttcagtggataagcctgggatgagcttcattaagagtcttattcaaagggcccatgtgctgggaggaaaaagtgactcctgccaagttgtcttctgacgtccacatgcacgctatggcatgagtatgctttgtacacctacccacaaccccctcccctccactaatatgtaataatacaaaaccaggatatagttcttttaatagcaagcctatgttcccttgattcattcttatgtttgcctctttgatttttgtgattttcctcctcaggcacgtcagtgctgtgatcaaggggaatgcctcctggctagccaaggaatggataagtttcagactaaagaagatgctcagaaagcccttcaggatgtggacaatttccttcaaatggccatgcctttcatcaattatgatatcgaaagcctgcaatatgaatttgatgtactcctatctcctgaactcaaggtgagagagaatttattcaaagacacacaaactaatcaccaaggtataaaaatttactacctcacagccaactttatattagtgtgtgtatccacagtcctctttgggatagcgtcactgtcatgtatcagagaatccacaggcatatgtttgctgtataataagactttcactgttagctttgagtctattaatatttattattattattattattaattatgatgatgtttgagacaggtttcactgtatagcttggctggcttagaacttcttgtgtagatcaggctgacctcctgttaataagtccagtctgactcttattattttttaagtgatttaactgtgctgtaagctttgacatacattttattctgcatcctcagagaagggccactaagtagagtggagtgttaggatcagttttatggctgatacgttccaccccctcaggttgtttacactagaactttagttttatatttacatgaagagaatacactaatattttctgtttctttactaaatttactctagtaatgttttatgtttaaaataagttgtttctgtgtttgtgttacatgtttgtatgtgtatttgtacttgtgtatataaacacgtgatatacagaggccataggttcatctctggtatcttcctctatttctctctactttattttgagacaagatctctcattggacctggtacttgctgattcagctatactggcaagccagcaagccctggggattatgcatgtacactagcaccatgtcccactttgtatatgggttcttgggattcaaagtcctgtcctcatgcttgtgtagaaaacactacccaataaatcatctccctagtcaacaaatattctaccacaatataatctaaagatatttaactctgatatgtatatgttcatttattttatatataatatctctaccatatatattatatctataccatagttaggtggatgtgtatatgtgtgcatgcaggtgggagccaaaggttaattttcagtatattttttttctttttatttttcttcatttatatttcaaatgctatcctgtttcctagtttcctctcgaaaaaccccctatagcctctccccgccctgctccccaacccacctactcccacttcctggccctggcattacactgtactggggcatatgatcttcgcaataccaagggcctctcctcccattgatggccgactaggccatcatctgctacatatgcaactagagacacagttctgttgagtatctttcttaattactttccttatgttgagacagagtctccagtgaacttgaaacgctctctgattcagttagactggctggccaatgagctccagggatcctcttgtctttgctaccccagcactgaggttagaggtattcctgccatgcctggattttatctggctgctggggtctggaactaaggttttcataattatgcagcaggcactttagtgactgacccatctcccagtccaaaaaattaattctaaattatgtctgatgaatataatagtagttgttatgacttatttcagaaagtaactcatacattttttgagacaaatctggctctgtagcactggctgacttggaactagctatgtagaccaggctggccttgaactccagagatctgcttgcctgtgcctcctcagttctgggattgaagatgtactccagtctacacagcagctcatgattttctattttgtcttatgtctataagtgttttaactcgtgcgtgtatatatgtgtgctgtgtgcagtgtctggtgcctatggagaccagaagaaggtgttgaataaccccaaacctagaattaaccatgtttctaagtgttcatgtggatgctgagaattgaacctctgtcctctgcaagagtagccagtgttctgctactccatctgctgatccttctctccagccctagctcatagaattcttatgcatttcataggctcaaatgcagaatatacaactaaagcttgaaaatattcgaagtgcatttcagaaccaacaggctggttgtaagagcctaaaagaagtacccgagggggcgttccagaacttggttcctgcatctgaaaatgtgatgcggtccagaatgatattcttttcaccgaaacatggtaaagcagcttgtttttacatttgctatgtcttttttgtcttgctagtgtttcctttgatgaacatgatatatctactacattccttttaaatcctgatacattctaaagccagttagcctctttgtttatacttaaccactgttgtacaaggcagaggtcagaatgatatccctttatgttcataaggcatagtagtagcactgcattgtgtcagatgggggacacctcgaggtggagcattctagcttgagaaatgagtttagaccttcagattttctgcaaaaggatgtgaatcttacctgtacatgtacatgcattataaacctgcatacttactgttatttcagtaagcaattatttgattcttatatgatgcttctttttgaatgtcttacatgataagggtggattaccttgtctaaatagatgctgataaatgctaattgagttagtaatttttgttacagattccacttctttgcttgaatttttcaagtctatataattgtgtacgatcctattcctttctaagttctataggaaaataattattcttggaatggtgttgtatctcaaagtctgaaaacattattcccacaagggtttcctagagcctcctcttcagcttttggagatagagcagtttcatctttttgtacaaattaaattagttgaagagttgaacatatgactaatacttcagtctctgagttaaactgcatcagtcactttactagtgcaggaaactactttgaaatgcagagaaggcttgagcccgaggtaatgaataaacacaactcatctccatcatctccagcatggatcaagttacaaatgcattggaaattatatggttagtaattccaagatgtatacatgtacataaaataagattgtatgagcaatggcttaaaagaataatgttgactgtattaaaaatatgccagacatactggaaatatcaaagatactgaaaaagtaaaaagaatagagtaacaaaatggaactgattaaacccaacaattgatatatttctgagcacaaaatagacatcagttacatatcaggatactttagctgtgtgtccttaggcatattgatggtcttactttcctagtctgtaaaaaatggacaaataccttctcatttaaaaggtgatcataaagggaaagtaagataaaattgccaacaagaactactcaataatttggactatcccttccctctgattaaatctcttttcttttcttttctttttttttttttttacccatggttattttgtcgatgttgaaagtataaagttatcgttgttattaggttgaattgttaaattcttttttttttccattttttattaggtatttagctcatttacatatccaatgctataccaaaagtcccccatatcctcccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagtaaatctcttctcttagtagaccctcaaagctcacatctccctgaagcagagcactctgcattgtgaccaggctgacaaagacccattcatgtcattagtcattcaaaaatttttgttttgtattatttcattttctttctttctccgattcttatttaatggcattacactttcttcctgcagtgggaattggatattctttctttcaagcatgtagaatttttttaaaaggtacccatctttattatattacttgtcatcaatacattttatgagtttgtacgcatgaaaaaccagtttggcatctaaaaatagcagcagttctttaattctatctgtaaataattatctaattttttgtaccatccgtccattattctctatcaacattgaacttatctttaaaaatgactaaagaatagagtgtgcttctaaagtcagtttctttcataaaatgaccacaaaaagaaagaagaggaggcaggagaggtggctaagtgggtaagagcgcttcttactcttcctgagaacccagttcacttcccatcatccatatggcagctcaacatcacctgtaactccagcaccaggggatctaatgccatcttctgacctctatgggcacttaaatacccatctgcttacccacacccacatagacattcaaaataaaatcaaattcaaaatacatattaaagtacatatttaaaaagttagtgaaattaatgtgaatcagggctttcttcatttgtaaagattcttgcttcattcgtaatcggaatatctgtctggagtagcttgaatttgcttcagtttaagatcaacttgtgtatttatgcagatgaaggcaccttaatggataaatagctggaatggatacatgattttctccatcatccattatggtttgtaaataaaacctgatcactatttaaaccctctgaatgttaccctattggtctatgggtaacgcgagtaataacatatttcagactagatttcaaaacttggatttgataaatcaaatatttgaccaaatcaaggtgtgtgctaatttttcatcaaaatgagtcaaactggttttttattccgcttttgcttgtttagtcttttttttttccttctccttcattgagttttctatctagcgtagttcctggcagcaagccggatgtgataagatgtttaatgagttcacattgaagggaagctatggaagaacgatgccagtgaaaagtagtgttagatatgtttgggtcctgaaagctctatttctagtctaggtctgtcacttaagcttcagactgctatttccaacatcaaatttcccaggggaaacagtttcatcatagcctacatgaaagtatctcttctgcaaagcatatagaacttttcttactcatcttgttcaccggtactgtaatgtccccatttgcccaagcttagatgttcttgctcattcccataccattcattatttttgatgataaatatgccttctgtgcatctagttattcctatcattactttctttactgccattttcacagtccaagataatatcactggtgtccttgaccatgatcatagtctctttggctctcattgccacagtcttcttgcctccctttctcttctgtgttaccttgtagagtttgcatagattgctgtttctctagactacacttccagtgttgctccattgccttcttgttagctcctattctgagtctacttccaccgcacagcctacttacctgttggctgttacacttgctaaacaggatgctttgcagggacaggatctgtgtgcaagccacctttgcatatccacaaacacagagctaccttgctcagctattttgtatgtaagcctttacattgtcgaaagaatgaatatatttaccttgctgttcagaaaatgatgtgtcacaaagatacacacatataaatctctcaatgtatttccaactaatccataatttactttaagaaataagtttggattttttttctcattttagatatttattttttattttatttttttaattttttattaggtattttcctcatttacatttctaatgctatcacaaaagtcccccataccgtccccccccactcccttaccccccccccccactcccacttcttggtcctggtgttcccctgtactgaggcatataaagtttgcaagaccaaggagcctctctttccactgatggccaactaggccatcttctgatacatatgcagctagagacatgagctccggggggtgggtggtgtactggttagttcatcttgttgttccacctatagggttgcagatccctttagctccttgggtactttctctagctcctccattgggggccctgtgatccatccaatagctgactgtgagcatccacttctgtgtttgctaggccctggcacagccttacaagagacagctatatcaggatcctttcagcaaaatcttgctagtgtatgcaatggtgtcagtgtttggaggctgactatgggatggatccctggacgtgacagtctctagatggtccatccttttgtctcagctccaaactttgtctctgtaattccttccatgggtgttttgttcccaattctaagaaggggcaaagtgtccacactttggtcttcattcttcttgagtttcatgtgtttcgcaaattgtatcttgtatcttgggtatttgtcagttgtctttacgatgaggcatgctgatacttattaagaagctgattttatatgtaagtctaacatatagttatatataacttttatgtgtcaaaacttggtaattaaagatggtaaaatatctatattttataatatgaaagaccatccactcccttagagtcctgacactagcttttgccaaggaaaggaagatagaaggtgtgtttcttctatgctgagagcagtgtttgtgtaccccagaaggatagcagccttcattattcagaacttaatctattctttggtttgtctgtgagttttacttttaaaggacctctgactctgcttgcgtctgtgaaatccatttcttccccagtgctgggaactgaacacatgctaaacaagtgttctgccattgacctttatttgcagttcactgtccaccctgttttcttttcttctagtgctggacatgtgttgtttaaaaataaagattaaggctttgaatttttgatgaggatgttttaaatgagcattttacgttgctttggaaatgtttcctgtagtgattggaaacatgtatgggtttaaatccacttccacttcctaaacacgtgttaatcttatctgtaaaatgagatagatgttgttttccatctcttagtgtagatttgagaattaaaaaggaaaacaaatcattgggcttagatcaggacctggttggggtaaatgccaaataaaaagtggattctatacttactcggatgaacttggattttttttttgtcattaattttcaagttaataaataaagtaatgactttcattataacatttccatatatattttgttctaatttgcacttgtgtgtgtatacacgtgtgcacactggtgtcgaaccatatatacatatagatcagagaacagtttgttggggttgcctttctccttccaccatatggttgggtcatggcgaacaagataagctcatcatggttagcagtaaacaattttacttgatgaaacatcttgccagccccatactttgttcttttctcaccccaccccctgctaccctcccctgtctttcctggtttcatacatgtaggctagattcagagaaatctttgctctagtgagtaagtgaactacaatctgattaaatgtttatgtgccataatgcatactgaatttgaacataattgtgaccacttaacactcttttcttttggcaagtaagtgcatgtgtactgaaggcgaggatgggtagtacacagtaaactcatgctccataagaagttttgttgaatttatatagctatctaaccaattactgtcttctgtagagtgctttgaaacactaacaaatatattgaaacattttctttctaataaacatgtttgtgttttccttaaaagtgttgactttcattccagtttaacactatttcatgtttctctaccagtgaaaaagtcttggagacagattcacgctcagagcaatgtgaaagtaagtataattaattaattaattaattaattcactgttggctgtgctgctacaatgatagcattaacatgggttttcaggcattttttcatttattacactgaacttttgaatttgaaaaccttacatatataagaaaactctgctgcctgtgtctacttacagtactggcagtgtgtgagcagtttgttgttgttgttgttttgttaggttttgtttgttttttaagtcctggcttatattaagaataatttctgtagagcactgcatataagttatagtccctcttcatgctgtctgcctccatacacctaagcaatgctgtgccttttacagatggtgctttctttcatgaatgagtgtagtagtgccaaagcaaagcttaaaggccagtttatcatggaccatgaacacactgactcaggatgcaggaaatacatctgtttctttttaattttcctccctccttccctccttcctttcctacctcctccttcttcttctccttcttcttttctccttcctccttcttccttctcctcctcctcctcctccttcttcttcctctctctctctctctctctctctctctctctctctctcgtttttctccagttcactatatagactaggctcgattcaaactcttagatagctacctgcttctatttctggagtgctgagattaaaggcatgtaccggcacacccagcttttatttggtttttgatgtgtaaagcaccacctacccaccttgcagtcttagttacctgtggacaatggtggttaaattagcaaggaaacattctagagaaaaggaaagaggatatatatatctccaatgttttattatgagacattttattatgagttattattgttaatcacttactgtgcctaatttttagatgactttttaaaaaagtcttgaatacacatatatgggacaaagcatagttcatggaaaattcagtactgtccacagtttcaggtacccagtgagggttttgaggtgtatccttggggaggaagtaggtagtgcatgtgttcttctcagttatctgtgatagtctgatatcaccagggtaacctcctcacacctgcagaaccttacgtattacttgtgtgtccttggtagtaagtagtccccaaaacataactctaagaggcactgcagtatagtacagtagtacaaactgtaattttaatgccagactctgactaattgatggtatagtctttggtatattctctgaacttcagacattaaataactggggataataggacatatgaagttagtataaaaaagaaataacatttataatgctcctgagtttcctatgtctggcatatagtgatgctctaagttgtttctactatcattgctgtagactagaaagtggcttttgttgatgtaaacagaagtatacaaaataaatcccagttagtactttatatctgcacccttagggaactcaaaacatttattttactagtatacatccaagtaatttttagaaaatgtagcactgtatattaatttatcttcaaagataggattgacattaatttaatatccatgtatttgagaaagtactgtacctacatagacatgattgaacttttattttcattatttcaggttgaagccgttgaggatagccaagagaagaattctgatcagtctcccaaattggacaatagcttggatattttaaagaagtattctttcctttttaatctacattcatatatgtatctcaccacaggaggctctggttcagtgtacaaggctcatgtgattagagttttcagtttgcaaaatacggtcctagtgagtgcattaaaagagtactagtgagtgtcacaagtcctgtatttagacgtgagcagctgtgatctttcttatgcgtcttgagaatttttctttggtaatattgtgtattgtaaggcaactgctctgctactcagctacatacagtccctcttatgatttctgtacctttcattttcagattgttttatttttgtgtttcccagtttaaatcatatatgtttgtgtgtgtgtgtgtgtgtgtgtgtatacacacacacatatatatgcacatatattaatcacatagatatataggtataggtctatgtgtaggaattgattttatacacacacacatacacacactctatatgagtgttttgccttcatgtctgtgcatcatgtccatgcttagtgcccagggaggcagaagtggcggtcaaagttcctgaacctgcagtcccaatgattataaacctccatcaggatcctggtaaccacacccgagtcctctataagagcagcatgtgctcttaactcttgagccatctttccaactcctgtgtttcccagctttactggaaaataataggcaaacaaaaatggacacatttagtatacacagtgtgagatatgataaggtgattgccatagcaagttagttaacacgaacagttgccttttttgtggtaagaacacaggtgtgtaagttctactttgcaagtgtatgtcctacatataagacatttcattaatgatagtaatgatagtaaccatgttgtacattggagtcccagaatgattcgactaataaatgaaactttgtacccttgggctctaccatctgttctactttgtttttttttttttttttttttattgctgtgataaagataatgactaaaagcaatttggagaaggaactggtttatttggctaatagttctagatcactatccatcatgagaggaagtcagggcaggaacctggaggtaggaactaaagcagaggccatggaagagtgttgcttactggcttgctccccattgattactcagactgctttcttatagaacccaggacctacagtggctgagccctctcctatcaatcgagagaattccccacagacttgtctacacaccaaatagattggacagttattcagttgacattcttttttcccaggctattatagttttatgtcaaattgacatctaaagctaactgtgacaccatttctttcactttaaaagaaaggaaaatcaatgaagaggcttgtcaagctatacaagattatagatactatttcataggtatcaacaatgagccttttatatgactatattattatgttaatatttgaaacttgaaactactgacctatatataagtttcatatcatgcactggtcctggagacacattcctttaattccaggacttggggaagcagaggcaaatgaatctctgagtttgaaggcagcctgatttacatagatacagagcacgaggactatgtagtgaggtctacctcctgttgttagaaatggccagtagtttgtatcacattgcctggagatatgtatgtgtcccaagttatataagataatttaatgaaattcattttggaaaaagctaggatctaaattctttaaagtatgaaaaaagaagaaatgtacaaaagtagaggagaaataggttgcttatattaaagaagggaataaagtttaaatatggtggctggaaatcaaatggtcaggacctacattttattttcgtggcacagatggcacacagtgttgctacagagtcttaagttttccttctattccatgtggaggtgtgtgtgcttgcaacatgtctgagaaaaaaagccagaaagttcctggcaactgtggaaaatggtgtttatagggttagtttttgtttgtttgtttgttttttgtttttaatgacatgattctagagctcaggaaatgtaaaaacttggcattaattcaggcataggctttgcagtattttagtaaatttgttcttaatttgagtgaattagaaatcatttttatgttcacacgcagccctttaccatttgctacccctcacgcccctccaagacagactcttgctttgtattcctgactgactcagaatgcaggttagttttggactcataaatcctcctgcctctgcctcttgagtgctggagtaaaggtgtgtgccaccacacctggccttttcaaaaaaaaaaatctatttaagagccttctgggtggtactttttccaacaactacaaaataaacttcatattttgatgctggaacaaaactcctaggtagttctaatatcctagcttattttactttacatcagtggttctcaaacgttcctaattatgctgtgaccctttaatacagttccttatgttgtggtgaccaccagtcatacaactattttgttgctactttgtaactgtaatttttctactgttatgaatcataatgtaaatatctgataggcaggctatctgatatgcgacctactggttgagaaccactgctttagattatttttagtgataataactgatccattgcaatgcgatactagagagggacattaactgataactatggtctgttcattgtagccatgtcctaaatgagctgatacagacagagagagcatatgttcgagagctgtttactgttttgttggtaagtgtagcaaattgttttttctccccatcttcctgaacagcccctggctactttcattagaaactgttctgagcagttttatgtttctgtctttgtccttggttgtcagtgggtctttgctgttatttgagattacatgttgtttaagtgattatatttacattccctctcaggagtgtggatatgtgattcagaatttcttatagaaaaagagaagctgttctcttagggacatggcacattgttgtaattattcccaggctgctacttagaggttgaaatggaaagaaccgggggttggataaaaatactcatttgacacaaatgccatggtactaatttggtctgaaaagaaatctaagcacttacttttaatttaaggagaactttatattcagtactataatctttcatagttgggtttggtttgatttccaacactacaataaaagccttgacggccacagtactactttttatttggaccatggagtagaagccttgacttccttatcctacattctaaaagaatgctataggtaactctgataactaagtgatatatatgttatattatgtcaatcagctatactcacaagtcttctctatgttttgctggacttatactgtcaatggtccaaccaaacattaatataaacatttcaaatgcaaaaattcatttctttctaatagggctacagatctgagatggacaatccacagatgtttgatcttatgccacctctcctgagaaataaaaaggatgttctctttggaaatatggcagaaatatacgaattccataacaagtatgtaattgccaaattcaactttttggtgattttaatttttcaaaaagttattgctgggtggtggtggtgcacacctttaatcccagcacttgggaggcagaaagagatggatttctctgtgtttcaggtcaacctggttcatctagtgagttttaggacagccagggctatatagaaagaccctgtttcaaaaagtgcggaaagaagagctcctcacttgtttattattatatgtcataaataacttttgtctaaaaattctacagcattttcatgagcagactggaagattgctctgatgctccagaaagagtgggaccttgcttcctggaaagggttagtctgattatttgcttttaacttaaaatattggcaactaaaaaagtatcttttgtataaagtaaccttggggacaagataacccccttccttttcctttaatttctatgcttttggagaagactcatcaattccagcaagtgcttaatgtaaaatagttttgttggaaaaaaaataataaaagggatattcagggcatatttgtattctgtggtattaagtgtttcaattactcaggtcgtagcaatagaatctagggaccaccctacctatgaagatgtgagagatgggaacattgataaaatcactgagcttggttaaagttagaatagaagatgcctttttaaaaaacaaaacttaaaagacagagagagtctcatcatgtagtcatagattctttttcattattaaattacaacaagttatctagtttctcctccttttgaaagatcaaacttcttctgatgggaaatcagttgaatcatccagagcttgagggtataaacagtggctatatagaagacactcatgaaatgaaagttaatgtgtaagtaggagatagaccaaaagaagaagatcagggaaagatgattcaagggagagcaaactgtgtaaccacgtgcttagatgtgatgatgtctcagtgatgaaccaaggactacttctaacttggaagttagctgcaagctcttttatttagatagccagcagactaatatcaaaaaaaatgcacattgatagctattagatcatgataataactatcttaaaaagataagggttttccaatgaattcatgaaattcttagacaaatggatggatctggagtataccatcctaagtgaggtaacccaatcacaaaagaacacacatgatatgcactcactgataagtggatattaacccagaaactcagatacaatttgcaaaacacatgaaactaaagaaggaagaccaaagtgtggatactttgatccttcttagaaggggttacaaaatacccatggtaggagttacaaagacaaagttcagagcagagactgaaggaatgaccatccagaaagtgctccacctggggattcatcctataaacaaccaccaaacgcagacactattgtggatgcaaacaagagcttattgacaggagcctgatatagctgtctcttgagaggctctgccagtgcctggcaaatacagaaggatgtgttcacagtcatccattggactgagcacagggtctccaatgaaggagctagagaaagtactcaatgcgctgaagggatttgcagccccataggaggaacaacaatatgaactaaccagtacccccagagctcccgggcactaaatcaccaaccaaagagtacacatggtgggactcatggctccagctgcatatgtagcagaggatggtctagtctgtcatcaatgggaggagaggccctaggtcctgtgaaggttctatatcccagtataggggaatgccagggccagaacacgggagtgggtgggttggggagcagggggaggggagagaggacaggggattttcttcggagaggaaactaggaaaggggataacatttgaaatgtaaatatagaaaatatctaataaaaaagataagttttttttttatttgttcaactgtcaagtttggtaagcaggggttctaaaattgcttgtagaattatgtatcctgttgtctggctcaatgggcacgctgtccttggaacacaaagcagggtttttttatgtcactttctcactatcatggttgatcacacactgtcttcttcaacctttttaaaaacaaaaattcatatttataaattggtaatatatttgcattttgctttattacagaaggatgattttcagatgtatgccaaatattgtcagaataaacccaggtcagagttaatttggaggaagtattctgaatgtgcctttttccaggtattaattatttaagtattaaacatattccttttggaagatattggaatatttctcattaacaaattcattttctgtcatgaatatttatttatttatttatttatttatttatttatttatttatttgtgtgtgtgaaacagccattctcaaccaaagtaaacacatacgcacatttcgtataggaatacatatttgttgttccccagaggcaaacacttttagctacttctggtatttgccttcctatctccaaataacatgcttgtcttgctccttcctgctttagaaaaatgaagatttaggtctctttcatggttccctctcccatgaccataactacatgaaattcttttctccaaagcttccagtaaatttttgttacatcaattggttttatttaactcaagactggaatttctctgggcaaatgacacatatagtaaaatatggttgctttcctttctcttgtgtatttattacaattttctttttactcaattttctatatgctttgcttttttcctcccttaacttcttctgattttagggatcataaaaatattggttttttcatatgtttacatacatcgagtgtctttaaatttcatcctaaagaaataatttctcaagtttctgacctgcttacagctttcatctcagtatctaggtacatctcatttggggacacttcttacagtagcctgtcttcctatctacatgccaatcttttaaaaatatttatttaattgtatgtgtatgtgtgtcttgcctatatgtatgtatgcacgcacaatatctgcatacctggtgcttgtggggtgattgttctcatggaactggagattgaatggttgtgtgtcactatgggattctgagaatggagcctgcgtactttgcaaaagctgtaaccagctgagcaatctttctaacttcatggccttcttcttttaccctttattgggtagaaggaatttagaaaatacacatgttaggtcatatatttgcctatgtttttgagaacttgcatgagtaagagtctttattgtaccttaatgctttgattgtaaagatggccaagtatcatgctgagggaggtaacccaatcacaaaaataactcacatgatatgtactcactgataagtggatattagcccagaaacttagaatacccaagatgcaaggtacaatttgcaaagcacatgaaactcaagaagaatgaagaccaaagtgtggacactttgccccttcttagaattgggaacaaaacacttctggaaggagttacagagacaaagtttggagctgagatgaatggatggaccatctagaggctgccacacccggggatccatcccataatcagcctccaaatgctgacaccattgcatacaccagcatgattttgctgaaaggaccctgatatagctgactcttgtgagactaggccggggcctggcaaacacagtagtggatgctcacagtcagctattggatggatcacagggaccccaatggaggagctagagaaagtacccaaggagctaaaggggtctgcaaccctataggtggaacaacattatgaactacccctggagctcatgtctctagctgcatatgtatcagaacatggcctagtcagccatcactgaaaagagagtccccttcgtcttgcaaactttacatgcctcagtacaggggaacgccagggccaagaagtgggagtgggtgggtagtggagtgggggaggagggtatgggggacttttgggatagcactggaaatgtaaatgaagaaaatacctaataaaaatataaatatataaaaaagaaataattattctcggaaagttgaagataccactttactgttttctgatttctagaacaaatatgattccagtttgactctcttcttcagaaagacatggggactaatacttgaaggattttgtttactagcattattgtcactcaatatcttggtattttgagtaatacttctttagacttttgtgataaaggtaggtgtagaacctaagggctttttaacgtactaggcaagtattctaattctgagctgtaacctgacacttgttgatcattctgaaattgagacctccagtccaacttttttttcctccaccttattctcttcattttcttcttctggaatttctgttgtatggatgttggaactctgtaactatcgtttctctggctgccaagttttccttttctattctactctcagcaattatcggctactcttcctgagagttttattgctggcaccagtttttttttttctaagcataaaattttattggaatatacttattatataaggtgatggatttttttaacagatttaagcatatacggtgtattgaacagttatcttcttttaccctttcttattccaacaccgatctccctagtcccctttctcttctcacatagtcactctttatttatatataaatgatatctctacatatgtcactctatatttctgtattcttggttttatatttttaagtctgacatattttacttttaatatgatgattctagcagtactcttttttcctaaaaaatgacacagtttcatgcttcttttccatattgtgcactcatctgttgaagagaatcacatactgtgaatgtctgtgcttcagacatagatgtgaaagtatctctctagaatgctgatttggagtcctaatggtggtatatctgtgtcatatggcagttctatttaatttaaaaaacatatgtgtatgtgtttatgtttgtgtgtctacagatacatgtgtgtacatgtgtggacatgcacgcatgagtataaatgcacatgtgtggctggcgtgttgaggccagaaatcaacctttagtgttattccttgggtggaattcaccttggttttttgagacagggtctctccttagcttggaacaagataagttgggtaggctaactggccactaggtatcagagatctgcccagtgttgggattataagtgtataagtgctgtaagccaccatgcgtatctttgttgttttgtttgtttgctttggccttttcaagacagggtgtcttagttagggttttactgctgtgaacagacaccatgaccaaggcttctcgtataatgtcaacatttcattgaggctggctacaggttcagaggtttagtccattatcatcaaggtaggagcatggcagtgtcgaggcaggcatggctcaggaggagctgagagttacacatcttcatctgactgcagccaggagaaaaatgactcttctgcactgggcagagcttcaaagctcactcccataatgagacacttcctccaaaaggccaaacctctcaacagtaccactccctatgggacaaacatgttcaaaccaccacacaaggtatcaatatgtagtcctggctgtctggactcgacttgtagatcaaacatgctttgaactaacaagagatccaccttcctctacctccagagtgctgagattaaaggcatgtaccaccaccaccctatgtatctttgtttttaaatatttttttgtctttttaaaaaatattttttatgggctggagagatggctcagcggttaagagcactgactgctcttctggaggtcctgagttcaaatcccagcaaccacatggtggctcacaaccatctgtaatgagatctcatgtccttttctggtgtgtctgaagacagctacagtgttcttagattataataataaataaatctttaaaaatatttttataactttatttattaattggatattttatttatttacatttaaaatgttatcccctttcccagcttctcttctgtaaaccccctataccatcccctcttaccctgtttctgtgagggtgctcccctatgcaccaacttactcctgcctccccgccctagcatccctctacactggggcatcaagccttcacaggaccaagcgcctcccttcccattgataccagataaggccccttcagctcttttagtccttcccctaactcctccattggggtccctgtgctcagtctgatagttggctgtgagcatcctcatcagtattgctcaggatctggcaaagcctctcaggagagagctgtattaggctcttgtcagcatgcactacttggcatcagcaatagtgtctgagtatagtgtctgtatgtgggatggatatccaggtggggcagtctctggatgccctttcctttagtctctgttccactctttgtccccatatttcctttagacaggagcaattctgggttaaaattttggagatgggtgggtggccctatccctctaccagggggcatgcctaacctctggatatggtctgtacagattctccctcccctttattgggtatttcaggtaatgtcatccctgtggggtcctgggacattcttgctttcctggcatctgggacattatggttgctatccccagttccctaataccccattgctacacacctctgttcaaattcttgaccctctgtacatcttgtccatctcttcctatacctaagtctactcctctttttcccttccctctcttctcttccttccaaatccctcccaccctctacttcccttgattattttgtttccccttctaagtaggactgaagcatccactctttggtcttccttcctcttgagctttatgtgctccatgagttgtatcttgggtattccatgctctttgcctaatatatacttatcagtgagtatataccatgtgcgctcttttgtgactgagttccatcagtcagcatgatgttttctagattcatccatatgcctgtgaatttcatgaagtcatttttttttaaagatttatttatttattatatgtaagtacattgtagctgtcttcagacacaccagaagagggagtcagatctcgttacggatggttgtgagccaccatgtggttgctgggatttgaactctggaccttcggaagagcagtcgggtgctctaacccactgagccatctcaccagcccatgaagtcattttttaatagctgaatagtattccattttgtaagtgtacaacattttctgtatccattcctctgtatagctatgtccaattttctgaggaactgccagattgatttgcagagtggtatcatttcaataacttttggtttaatgtcggttttattcgatatcagaatggctactccagcttgtttctaggaaccatttgcttggaaaattgttttccagtctattattctgagggagtgtctgtctttattactgaggcgtgtttcctgtatgcagcaaaatgttgaatcctgtctattagtctacttctttttatcggggaattgagtccattgatattaaaagatattaaggaatagtgattgttgattcctgttattttggttcttagaggtagaattatgtttgtgtggttatcttcttttgggtttgttgaaagaagattacttgcttgcattttctagggtgtaaattccttccttgtgttgttgttttccatctattatcctttgtagtgctggatttgtggaaagatattgtttatatttggttttgtcatggaatatcttgggttttccatctacggtaattgcgagttttgctggatatagtagcctaggctggcagttgtgttctcttagggtctgtgtgacatctgcccaggatcttctatttttcatactctctggtcagaagtctggtgtaattctgacaggtctgcttttatatgttacttgaccttttgccttcactactttttaaaaattatgtttttaattaggtattttcttaatttacatttccaatgctaccccaaaagtccccaaaccccccatttccctcatcccccactcccacttcttggctctggtgttcccctgtactgaggaatataaagtttgcaagaccaatgggcctctctttccactgatggccaactaggtcatcttctgatacatatgcagctagagacacaagctcgggggggggggggtactggtgagttcatattgttgttccaccaatagggttgcaggcccctttagctccttgggtactttctctagctcctccattgggggccctgtgatccaaccaatagcttactgtgatcacccacttctgtgtttgcaaggccccggcatagcctcgcaagagatagctatatcagggtccttccatgggtgttttgttcccaattctaagaaggggcaaagtgtctaaacttttgtcttcgttcttcttgagtttcatgtgctttgcaaattataccatgggtattctaagtttctgggctaatatccacttatcagtgagtacatatcatgtgagttattttgtgattgagttacatcactcaggatgatgccctccaggtccatccatttgcctaggaatttcataaattcattcttcttaatagctgagtagtactccattgtgtaaatgtaccacattttctgtatccatttctctgttgaggggcatctgggttcattgcagcttctggctattacaaataaggctgctatgaacatagttgagcatgtgtcctccttaccagttggaacatcttctggaaatatgcccaggagagatattgcgggatcctccggtagtactatgtccaaatttctgaggaactgccagactgatttccagagtggttgtccaagcttgcaatcccaccaagaatggaggagtgttcctctttctccacatctttgccagcatctgctgtcacctgaattttttatcttcaccattcgggctggtgtgaggtggaatctcagggttgttttgatttgcatttccctgatgattaaggatgctgaatattttttcagatgcttctctgccattcggtattccccaggtgagaattctttgtttagctctgagccccatttttaaatggggttatttgattttctggtgtccaccttcttgagttctttatatatattggatattagtcccctatctgatttgggataggtaaagatcctttcccaatctgttggtggcctttttgtcttattgacagtgtcttttgacttgcagaagctttgcatttttatgaggttccatttatagattctcgatcttacagcacaaaccattgctgttctattcaggaatgtttcccctgtgcccatatcttcaaggcttttccctactttctcttctataaatttcagtatctctggttttaagtggagttccttaatccacttagatttgaccttagtacaaggaaataggaatggatcaattcacatttttctacatgataaccaccagttgtgccagcaccatttgttgaaaatgctgtcttttttccactggatggttttagctcccttgtcaaagatcaagtgaccataggtgtgtgggttcatttctgggtcttcaattctattccattggtctacttgtctgtcgctataccagtaccatgcagtttttaatcacaattgctctgtagtacagctttagatcaggcatggtgattccaccagagattattttatccttgataagagtttttgctatcatatgtatcaaaagatggcctagtcggccatcacagcaaagagaggcccattggacttgcaaactttatatgccccagtacaggggaacccccgggccaaaaagggggagtgggtgggtaggggattggggggtgggtatgggggacttttgggatagcattgaaaatgtaaacgaggaaaatacctaataataataaaaaaagagtttttgctatcctaggttttttgttattccagatgaattttcagtttgccctttctaattcattgaagaattgagttggaatgggattgcattgaatctgtagattgcttttggcaagatagccatttttacaatgttgatcctgccaatccatgagcatgggagatctttccatcttctgagatcttctttaatttctttcttcagagacttgaagtttttatcatacagatcttttacttccttcgttagagtcacgccgagatattttatattatttgtgactattgagaagggtgttgtttccctaatttctttctcagcctgtttattctttgtgtagagaaaggccattgacttgtttgagttaattttatatccagctacttcaccaaagctgtttatcaggtttaggagttctctggtggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcaaccttgtctagtccctgattttagtgggattgcttccagcttctctccatttactttgatgttggctactggtttgctgtagattgcttttattatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgatttctttaatgtgttcttggattcggttagcgagaattttattaaggatttttgcatcgatattcataagagaaattggtctgaagttctctatctttgttggatctttctgtggtttaggtatcagagtaatagtggcttcataaaatgagttgggtagagtaccttctacttctatcttgtgaaatagtttgtgcagaactggaattagatcttctttgaaggtctgatagaactctgcactaaacccatctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtataagcttttgtagaaggatctgatggtgttttggatttcttcaggatctgttgttatgtctcccttttcatttctgattttgttgattaggattttgtccctttgccctctagtgagtctagctaagggcttatctatcttgttgattttctcaaagaaccaactcctcgtttggttaattctttgaatagttcttcttgtttccacttggttaatttcacccctgagtttgattatttcctgccgtctactccttttgggtgaatttgcttcctttttttctagagcttttagatgtgttgtcaagctgctagtatgtgctctctcccgtttcttcttggaggtactcagagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcggtttccacgtgaatgttggctttccattcttaatgttgttattgaagatcagtcttaggccatggtggtctgataggatacatgggacaatttcaatatttttgtatctgttgaggcctattttgtgaccaattatatggtcaattttggagaaggtcccgtgaggtgctgagaagaaggtatatccttttgttttaggattaaatattctgtagatatctgtcaggtccatttgtttcataacttctgttagtttcactgtgtccctgtttagtttctgtttccacgatctgtccattgatgaaagtggtgtgttgaggtctcccactattattgtgtgaggtgcaatgtgtgctttgagctttactaaagtgtctttaatgaatgtggctgcccttgcatttggagcgtagatattcagaattgagagttcctcttggaggattttacctttgatgagtatgaagtgtccctccttgtcttttttgataactttgggttggaagtcgattttatccgatattagaatggctactccagcctgtttcttcagaccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaggtaattgttgcttcctgttatttttgttgttaaagttggcattctgttcttgtggctgtcttcttttaggtttgttgagggattatcttcttgttttttctagggcgtggttcccgtccttgtattggtttttttctgttattatcctttgaagggctggattcgtggagagataatgggtgaatttagttttgtcgtggaatactttggtttctccatctatggtaattgagagtttggctgggtatagtagcctgggctggcatttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttggtgttctgattattatgtgtcgggaggaatttcttttctggtccagtctatttggagttctgtaggcttcttgtatgttcatgggcatgtcattctttagatttgggaagttttcttcaataattttgttgaagatgtttgctggtcctttgagttgaaaatcttcattctcatccactcctattatgcgtaggtttggtcttctcattgtgtcctggatttcctggatgttttgagttaggatctttttgcattttccattttctttgattgttgtgccgatgttctctatggagtcttctgcacctgagattctctcttccatctcttgtattctgttgctgatgctggcatctatggttccagatttctttcctagggtttctatctccagcgtcgcctcactttgggttttctttattgtgtctacttccctttttaggtctagtatggttttgttcatttccatcacctgtttggatgtgttttcctgtttttctataaggacttctacctgtttggttgtgttttcctgtttttctttaaggacttgtaactttagcagtgttttcctgtttttctttaaggacttgtaactctttagcagtgttctcctgtatttctttaagtgagttattgaattccttctttatgtcctctaccatcatcatgagatatgcttttaaatccaggtctaccttttcaggtgtgttagggtgtcctggattgggcgaagtgggcgttctgggttctgatgatggtgagtggtcctggcttctgttagtaggattcttacgtttacctttcgccatctggcaatctctggagttagttgttatagttgtctttgttaagagattgttcctctgttgattttgttaccctctatcagcaggcgtgggagacaagctctcttctctgagtttcagtggtcagagcagtctctgtaggcaagctctcctctttcagggaaggtgtacagttatctggtgtttggacctcctcctggctgaaggtgaaggcccaaaacaggatctttcccagaagctgtgttgctttggccaggaaggtggccagttgtctggagtcgaagatgtcgccgcctgagaagctctgtggctcttgtccggaaggaggccggccgtctggagctgaggatggcgccgcccagaagctctgagactctcgcccgtcccagaaacggctggcactctgtattccacacggtcacccgtgcagcctgccctccgcggagtcccggagccaagaaggctcccaccggcgcctgtgccacaaacctctcaggcctggcagacccccgtgctctcaccagcctttcctattatttttgttgttagagttggctttctgttctcgtggctgtcttctttttggtttgttgaaggtttactctcttgctttttctaggatgtggtttctgtccttctactggtttttttctgtaattatcctttgaagggctggatttgtggaaagataatgtgtgaatttggttttgttgtggaaaactttggtttctgcatctatggcaattgaaagtttggctgggtatagtagcctgggctggcatttgtgttctcttagtgtctgtataacatctgtccaggatctgctggctttcatggtctctggagaaaagtctggtgtaattctaataggcctgcctttatatgttaattgaccttttccccttactgcttttttatattctacctttatttagtgcatttgttgttctgaatattatgtgccaggaggaatttgttttctggtccagtctgtttggagttctgtaggcttcttgtatgttcatgggcatctctttgtaggtttgggaagttttcttctattattttgttgaagatatttgctggccctttaagttgaaaatcttcatcctcatctactcttattatccttaagtttggtcttctcattgtgtcctgtatttcctggatattttgagtttggatcttcttgcatttcgaattttctttgattgttgtacccatgttctcaatggaatcttttgcacctgagattctctcttccatctcttgtattctgttgttgatgctcgcatctgttgttccagatttctttcctagggtttctatctcaagcattgcctcactttgggttttctttattgtgtctacttccctttttaggtctagtttggttttgttcatttccatcacctgtttggatagttttcctgtttttctttaaggacttccacctctttggttgtgttttcctgtttttctttaaggacttgtaactctttagcagtgttctactgtgtttctttaagtgagttattaaagtccttcttgatgtcctctaccatcatcctgagatatgcttttaaatccgggtctaggtttttgggtgtgttggggtacctaggtctggctgaggtgggagtgctgggttctgatgatggttagtggtcttggtttctgttagtaagattcttacgtttgcctttcgccatctggtaatctctggagttacttgttatagttgtctctggttagagcttgttcctctcgtgattctgttatcctctatcagcaaacctggaagactagatatctcctgagtttcagtgcttagaacactctctgtaggtaagctctcctcttgcagggaaggtggacagatatctggcatttggacctgcttcctggccgaagatgaaggcctgaaacagttttgtctcagaaactgtgtagcttctgtagtccacactcttacctgcacagagtagtcttggcgggatccacaaaccaagatgtctcccccagatgctgtggcaaagccctctggggctgggcggacacctctcctcgtgcagggaaggtgcccgggtgtctggagcctgaaacatggtctgccccagaaggtctgtggcttctgcctgtcctagaaccttttagcctctgtagtccacactctcacctgcgcagaccagttttggtggaatccgggaacccaagatggctcctccagatgctgtggtaaagccctcttgggcggggcagacacctctcctctggcagggaaggtgcccggatgtctggagcctgaaaagtggtctgccccagaatgtctgtggcttctgcctgacccagaagctgttagcttctgcagtccacactttcccctgtgcagactagtctaggtggaatcctggaacccccttactgcttttaatagtctttgtttgttttgtgcatttggtgttttgactattatgtgatggaaggaatttcctttctggcccagtccatttggatttctgtaggcttcctgtattcttatgggtatcttttcctttaggttagggaagttttcttcttcttcttcttcttcttcttcttcttcttcttcttcttcttcttcttcttcttcttcctcttcctcttcctcttcctcttcctcttcctcttcctcttcctcttcctcttcctcttcctcttcctcttcctcttcctcttcctcttcctcttcctcttcctcttcctcttcttcttcttcttcttcttcttcttcttcttcttcttcttcttcttcttcttcttcttcttcttcttctcctcctcctcctcctcctcctcctcctcctcctcctcctcctcctccttcttcctttttgaaatcctaaatatttattttatttttttatttaaacaattttttattagatattttcttcatttacaattcaaatactatcccaaagtcccttctatcctcccccgctctgcttcccaacccacccactcctgcttcttggccctggcattcccctgtattggggcatataatctttgcaaaaccaaggaattcttctgtcattaactgccgattaggtcatcttctgctatgttgaagatatttactggccctttaagttaggaatcttcactctcttctatacctattgtccttaggttttgtcttctcattgtgtcctggatttcctggatgttttaggttaggagctttttgcattttgcattttccttttcttttcttttttttttcctttttcttttcttttttctttttcttctcttttcttttctttttctttcttttttttttttttgcattttctttgaccattgtgtcgatgttttctgtggtaccttctgcacgtgagattctctttttaatctcttgtattctgttggtgatgcttgcatctatgactcctgatttacttcccaggctttctaacttcagggttgtccctctttgtgattctttattgtgtctttccatcctagatcctggatggttttgttcaattccttcacctgtttggttgtgttttcctgtaattctttaagggacttttgttgttgttgtttctcctttaagggcttatacctattaacttttgttctcctgtatttctttaaggaatttatttatatcattcttaaagtcctctatcatcatcatgagatgtgattttaaatcagagtcttgtttttctggtgtgttggggtatccagggcttgctgaggtgggagaactgttttctgataatgccaagtagccttggtttccattgcttatgttcttcactttactctcaccatctggttatctgtggtgttagctggtcttgctgtctctgattgtggcttgtccctcctgtaagcctgtgtgtcatcactcctggaagacaaactctctcctggtagaatttggttatggagagctttggcacaggttcagctctgggtgcagatagacactggaaggatcctgttcctgtttttaaaatttggaaatgcaggttccggggtatctaactcacatcttcatgcttgcaattatgttaccaactgagatgtcatcctagccctagttgtggttatctgaggactttctgtcctgaagtggctgtgccagttaatattctggacactgaattacttttaatggaatcctgactctttgttttagatgcttttttcatttattattatgaagataatcacatattttcattttaaagttgttttcttctctgcatagtgccaactgcattcagactgcttttatttttttcttcactgtccctcatcttagacactgttctgaaatgcctattatttgtctgtttggttgtattaaggacaggcatatgaaatctgattgaaagtcttgtgaatttccatgtttatttagtacaggtctcagtcttggattgtttgtctcagattgtttcctttggtgtgctaatgagagattgggggtggggcgtgactttgttaccacattctcttcagttgcttagatctttcagactgctgttcaatacagatataattggctgctattgtgtttaaggaaatgggataaatttctcagagttgttagatgtacacatattcagctcttctccttgctttcagtatgctgatctgatctcagttaaaccttagtcccttagtcccttagtcccttagtccaaaggccctctggcttacttttatcacatcttcttttgatcaggctcatgtgacttggttgtgcttactggagtttttacattgtttattttagattttaatgtccatttagttttggttttggtaatagatttattaagatgcaaataaaatactacaaaattcatccctttaaaagcagtggttctcagtcttcctaatactatgaccctttaatagagttcctcatattgtggtaatctcagccatgaaattattttattgctatttcataacagtaattttttcaactattataaattacattgtaaatatatgtgttttccaatggtcttaggcaactcgtgtaatagtgtcatttggccccaaagtggtcatgacccacgggttaaaaactactactttaaagtatacaattcagtagtttaactatattcatcaggttgtatggttatcaacacaatttaagatcacttttaccattaaaaattcccatcttgaggtcagtcatgatggcacacacttgtcattgtagcactgacaggcctgaggaagacgggtcttgagtttgagtcatgcctgggctacagagtgacatcctgcctttgaaaacaaatacagaaaagcaagcaactaatggaacaagccaaaaataaaaaataaaaaataaaaaagagagatttacaggaccttgtaccttttaatagtcacctcttatgctgatttccccaatacattcaattaacgtttagccagtactctgatttctgtgtttgtagctttgcctattctgagtatttcataaaacaaaaacttaaactatatgatatttttatgtggcttcttttagttaatacagtggttctctgttgtggtaaatctccaactcatataagcccgggcaatgaaaacacgactcaattaatatgattatatgctgtgtgcctagattgggcagatctaccgctacactaccatcttccccatataagagaccccttagaactgtggtcttttcaggccatgtgcttctgttccactttccttcttcctcctcctccatagtcctctctccctctctctttctctccccaaaccttcagctccaccttcccctcattccccacccaatcaccggctctagcctttatttataaattaaagtgggaagcaggtttacagtaaatcacctgagtgctgattcattccttggtgtcagcccctcacagcagaacagaattaacatcaaatatattaaccccagggctatctgcatcagttctcactcttctgaatgctgagaccctttaatacaggtcttcatgttgtggtgatccccagccatacaaatattttattgatactttataactgtcattttgctattgttataaattgtaatgtgtatatatgatatgcaggatatctgatactccgaccccaatagcgtcatgatccataggttgagaactgcttatttaacaatatttttgagcctcatgccattttatgtaacaatactttctttttcctgtttgaatatttttctgagttgatagatcatatttgatgaatatggtcattagttgataggcatttggcttgtttctatcttttgtttaccatagctataacaactcttttagaaatgttatttattattttatagtgtatgtgtttttttcctgcattcatgttcatgtaccatgtggatgtagtatcctcaaaggccagaggatggttttgtatttgttaaaactggaattacaaatggttgtgaaccatcatgtgggatctgggaatctaaccatgatcctctaagagagcagttaatgcttttaaccactgagccatctctaaccctgttataaaaaaaataggcaattttttttttttttgctatatacctaggagtaactatatggtaactagttacctatggtaactgtttaatatttaacaggatctcaccatgtagtcctggctagcctggaatgcaatatatagccttgaattcacagagacacatctgttccttattcctgagtattgggatgaaatgtgtgagccaccatgctcagttaagttaaatggctagccgttggactgttttccatagtgacctcagttttctatcactaccaatagtgtatgagatctgattgctccacatgctcaccaacacttgttcatatctatttcataaacactttgaatttttctcttttagaagtatggggtatctctttgagaaggggaagggggcatcctctaacataaaaaactgatctgttttgtctttttcctctctcaacttacaattagatgtcatgtgtgaatttgactttcagtttttgcattttgaaaatatttcctcccttctcaattttttgtcttgagataaatatatttcatcattctagttgggttttcatgatggagattgaatgcatgtatcggtctgtcatctttaagtgttgattatttactcttatttgatttagattgtatgttatatcttatttacattcagtagaaggccctatatcttattcgggtatagcttcctcccagtcctcctgtgttgtacacactccatatgcacattcatcctaaccacccccatcttttcctaactctggtccctcaactgttcccaggacccaatgtcatgacccctatatttatagtggcagtaagccagttactgaatgaaatacagcaccagctgatgaagtctgtatttttcttgcaatcttaaaaaatactctgttctcatacccagtcagatttatatttagcacaacctatttcttgtctaggctttcgcctatggacctgcttttctattaatgttcttggacagattgaagaacattttaatcattctaacctattgtcatttcctgtgttttcaaattttatgcagtttataccaatgtgaatttatatgtggaaaacttttagactttgaaatgctataatttctacctttgaaatcctttattttttccttccttatttctctccctcccttcattcctctcttcttcattccttcctttgtttcctcttcttcacttctttttctttttgagatagggtctctctattatgtagctctggctggcctggaatttactatggacaccaagctgtctttgaacttatagaaatctaccttcttctttcctcttgagtgctgagatcgtaagcatgtgctctcaaatttttaaaatggtattcagtctttcaggtatattatttgtcatgatttttgtactatatttgaccgtgatttttctgatacatattccttaagatgtataaaagattcatgtctggggtctaatcaaagtgctcttggctcttggcatttccacaggtacatgtctgtttatttttatattaaaattaaaaaaaatttgtatatgagtattttgcacactcatacacacacatgtatgtatgtatgtatgtatgtatgtatgtatgcattgtattccttgcaaccagagatatgaatggttgtgagtcactatgtgggtcttgggaacttaacatctgtaatagcagcaagtcccattacctctgacccatctcttcagctttggtatatgtcttttaaaaataaattactcttaaaattagcttacaaagtaatcccatatggaattttctttttttaaaattaggtattttcctcatttacatttccaatgctatcccaaaagtcccccatgcccccccccacacccctacccacccattcccactttttggccctggcattcccctgtaatggggcatataaagtttgcatgtccaatgggcctctctttccagtgatggccgactaggccatcttttgatacatatgcagctagagtcaagagctccggggtactggttagttcataatgttgttccacctatagggttgcagatccctttagctccttgggtactttctctagctcctccattgggggccgtgtgatccatccaatagctgactgtgagcattcacttatgtgtttgctaggccccagcatagtctcacaagagacaccatatggaattttcataaagattttgtatgattcctgtgccccctctacatttcttaatttaatatttaatgatcattatctcagagagatctgcctacctctgtctccaaactgctaggattaaaggcatgtgccaccgtactcagctgatcattactttttattaattaattaattaactaattaacatcccaaatgctgctgctcctccatcaatgagtccctcccttcattcccttctcctctgagagggaaggaccctccctgagtatttcatcctggcacatcaagtctctgccagattaggtgcatcatctcccactgagattagatagggtagccatgaagactgagctgcctgtttgttgcacatgtgccaggggccttgttccagcctgtatatgttctttggttgggggctcagattctgaggatttctaggggtccaggtttgttgactgttggtcttcctgtggagttctcatctacttcaaggccttcaatccttaccccaactctttcttaagtgtccccaacatccatctatagtttgtctgtcggtatctgcttctgtttcagtcagctgctgggtggagcctcttagaagacatttatgctattctccagtctgcaagcataacagagtatcattaataatgtcaggaactggtacttgcttgtgggatgggtttcgagttggattggttattagttggccttttcttcagtatctgctccatcactgcacttcttttagatggaacaaattttgggtggagagttttgtggggggatttgtgttcctatccttccactgggggttctgctggctacagaaggttgtttctccaggttccatgtcaccactggtaggtatcttggctaaggtctcttacattgactcgtggaagcctcacctaccttacttcctagagattctcctctcactgcacccctgggagctgcagattctcttgaccctctggcactctctgctgtctttccccatacctgatccagcctccatgttcctctctacttacccattttacctagttctctccctccctctgcctcgtatgacaatgttgtttccacttctaattgtgattcaagcatcattgcttgtggctttcttctcatttaacttctttgggtctttggggattatcatgtgtattttgtactttacggctaatatctacctatcagtgagtacttaccatgtctgtacttgtgggcatgggttacctcgctcaggatgatattttctagttttgtccaattacctgtaaaatccactatgtctttgtttttaatagctgagtagtactccattgtgtaaatgtaccacattttctgtatccattcttcagttgagggacatttgggttgtttccagcatttggctattcggaagaaagccactatgaacatagtggagcacgtgtccttggagtatggtggaacaaattttgcgtttaggtagaactattttcaattttctgaaaaacaagcagattgagttccagagtggttgtccactttttcagtcccatcaccaatagaggagtgttctcctttctccacatccttgccagcatatacaatcacttgaattttttatcttagccattctgattggtgtaaggtggaatctcagggtcatttatttacatttctctgatgactaaggatgttgaatatttctttaagggctttttgggtgtttgagattcttctgttgagaattaattgtttagttttgtgtccaattttttaatttggttatttcgtttgtcagatcttaacttcttgagttctttatatattttggatattagccttcaattggatgtagggttagtgaagatcttttcctatctgtagactgccgatttatcctattgacagtattctttgccttacagaaactttgtagtttcatgaggtcccatttatcaattgttgataattgagccttagccactggtgttccatttgagaaattgtctcccataccaatgtgttgaagggtatttcccactttctcttctattaggtttagtgtatctgaatttatgttgaggtccttgatccacttggactttagttttgttcagggtcataaatatcaatctatttgcattctactacatgtagagatccagttagaccagcatcatttgttgaagatactttcttttttttccattgtatggttttggcttctttgtcaaaaatcaagtgtccataggtgtgtgggtttatttctggatcttcaattttattccattgatttacctgtctgtcactgtaccaatactatgccatttgttactattattatcattattgctctatcgtatagctagaggtcagatatggtgattcttctagaggctcttttatgttcaggatagttttggctattctgggatttttgtttttccatatgaagttaagaattgctctttgaaggtctataaaaattgtgttgaaattttgatggggattgcactaaatttgtatatttgaccattatcttttaatgacaggaatgtcaacgaaaattgaaacatcgacttggtctggattcctatttgctcaaacctgttcaacgaatcactaagtatcagttgcttttaaaggtaattacataaagtgtttgtgtggcttattacttaaaaaatattttatgaatatgtatgttttacctgcatgcatgtgtaacttgtgtttgcctcatacctatggaggtcagaagaggacagcagcattatagcctgttctgagtcaccatgtgggtacagagatagaactcaggtcctctaccagagcagccagggctcttaatcaatgaactatctctccagcccctacttgttcattttgttttatttatttattttttgaatcagatctggtagtcatttaaaaggaagtggttgattggaagcacttgcaatacattaaaggagagcaatggtcacatttaactgtatgatttttgcagtgtgctctttcatgttgtacaaatgacacatgcaaggtgattaagctgtgagtatatagagtattagctcttgattatccatataagttctgtatgaatttaagcataatgttttggtaaagaatttttcatgttagggagatctaaatatatacttacttttgatatttatttccttttggtcttttcaatgtaaaatgtaaatgacattcccttgtttcaatggaaaaagattagtagaatctatatcttgtctaaatacaatatcactttttaaaatgtgtttcatgatactataggcattatgattgacaaattactgtatttagaggaggaaaactcgtttaattgctttgaacactaatctctgatgtctctttgtagctgttggtttttagctctaaaaacattgagtgccctgttgcggtaaatctccaacccaaatatgcctcggcaatgaaaacacaattcaatatgaatatatgctgtgtgcctagattgggtagatctaccgctactctaccatcttccacatctttgagacccctttgaacttcggtttctccaggccatgtgcttctgctccacttttcttcttcctcctctgcatcctctccctcttccattttctccttcttctctctccccaccttccactccaccttcccttttatctgtccaatcatcatctctcctttattttacaaaataaggtgggaagcaggtttacaggaaatcacctgagtgctgactcattccttgttcatagcccctcacaggagaacgaaattaacatcaaatataattagggctatctgcaacagtgccctttgttttatgctctttcctcattattctacttcttccccaattttgacattgttattaaatataatgttaatatgacagacaatatgaaagaaattactctacaaatgacagaatctttggatcactgctcaaaagcatattagctttaaagcattcattttccagcagttataaaaatatgtgacataacattaagtttaattcttgacttctaattaaggagcttttaaagtatagcaaagaaggtgaaggaactactaaattaaaggaggcacttgactcaatgctggagctgctgaagtcagtgaatgactccatgcatcagactgccatcaatggctatgttgtaagtaaagtttagagattattggaattttggggggtaaacttgtcaaaatctcttcttttatctactggatttaattgggaaatactacataagaggcaaacaaatgaggataaaatatatgcattattattgataatgctaagtggagaattggctgcagatcagcagccaagtggaattttatgacattttcctggtctgtagcagtctgccatcaaatctggaacttgggaaatttggcttgaatacatgcttatgtcagctaagcaaatacactgtccctgaattgctgcctgccctagtctagaatagatatggataaaggggtcaagtctttagggcttgctacctttccccaaatcggttccatccaatgggaaactcatgtaccaatgaggaatgagaaagagttacaagcattgctcggtacctcattttttaattggcttatttgggttgttggtatccaactttttcagttctttaaaaattttggatattagccctctatcagatgtagattggtgaagattttgtcctattgacagtgtcctttgccttacagaagctttgtagtttcatgaggtcccatttatcaattgttgatattagagcctgagtcactggtgttttgtttgggaaattttgtcctgtacctatgcgttggcaggcatttcccactttctcttctatgagatttagtatatccagttttattgaggtccttgatccctttggacttgacttttgtgcagggtgataggtatggatctatttgcattcttctacatgcagacatttagttagatcagtactatgttgcctcttttttccattgtatggttttccttgtcaaaaatcaagtgtccataagtttgtggatttatttctgggtcttcagttagatttcattgatcaaccggcttattcctataccaatactatgtaaattttattactttctctctgtagtacagcttgacgtctgggtcagtgattcatcttgaagttcttttattgttcaggattgtttttgctgtgctggattttttcttattgtgtatgaagttgagaattgctctgtctatgtctgtaaaaaattgtgttggaatttacaaggtctacatttattctgtagattgcttttggtaaggtgaacattttcattgttaattctaccaatccatgagcatgggagatctttccattttctgacattttcctcagtttctttcttcagggaattgaaattcttgttatataggtctttcatttgcttagttagagttactttgatgtcttcattttcaatttgtatcccctagttctcttttagtcatcttattgctctggctagaacttcaagaactatattgtataaattgggacagagtggacagccttgttttgtccctgattttagtgggattgcttcaagtttctctttatttagcttgatgttagctattagcttgttgtatattgctttgattatgtttaggtatgtgccctgtatatatatgatttttctaatacctttaacatgaaggggtgttggattttgtcaaaggctttctcagcatctaatgagaagatcatgtgattttttttctttcagtttatttatatagtggctgatgggttttcatatatcgaaccatccctgcatccatgggatgaatcctacttgatcaaggtatatgttgtttctgatgtgtttttgaatcaatgttcattaagagaagtctgtctgaaattctttctttttgaatatgtatatggtttaggtttcatggtgactatgtcctcatagaatgtgtttggtagtgttccttcactttctattttgtggagtagggaagaatattggtattagctcttctatgaacatctgataggattctgcaccaaaaccatctggccctggggtttatttttgttgggagacttttgatgacttcttctattttcttagacattatagggtttttaaaaatagtttacctgatcttgatttatctttggaagtggtatctgtttagaaaatcatccatttcattaagattttccaattttgttgactacaagcttttgatgtaagacctaatgattcttttgatttcttcactgtctgttgttaggtctcccttttcatttctgattttgttcatttggatactgtctctgtcttttagttagtttggctaagagtttgtctatcttgtttattttctcaaagaaccagttcttggtattgattctttgtattgtgttctttgtccctagctgattcttttcaggcttgattttgattatttcctggtttctactcctcttcaaggtgttttctatttctttttttcttctagagctttgatatgtacttctaaattgttggcatgagaactttctaattttattatggaggcactttgcactatggattttcctcttagcactgctttcattgtgtcccataaatttgagtatgttgtgccttcatttaacattgaattcttttaagtctttaatttctttctttttttcttccctgactgagagagtagagagtagagaattgttcaattttcatgagtgtgtaggctttctggtatttcttttgtttttgaagtacagcttcaatccatggccatactataagacataaggcattatttcaattttcttctatctgttgaggcttgttttgtgaccaatatatggtcagttttggagaaggatccatgagatgctgagaagaatgtatattcttttgcgtttatatgggtgaaatattgttcagaagtctgttaggtccaattgattcatagtgtcttttagtttcattatttctctgtttagtttttgtgtggatgacctgtcagatggtgaaagttgagtgttgaagtcgcccactattaatgtgtttgatgtgcttttaaaatctctagcaatgtttcttttacaaatgtgggtgcccttgtctttgagaaatagatgttcaaaattgagatatcatttggtagattttttttccctttgagtatgaagtatccttccctgtctattttgatttattttggttgaaattctattttagtagatattattatggcaagtcagcttgcttctttggaacatttgcttggaaaactgtttttttccagcccatttctctgaggtagtgtttttttttatggctgagatgtgtttcttgtattcagcagaatgatggatccaatttttccatccattctattagcctctgtctttttattggggaattgagatcattgatgttgagagatattaatgaccagtgattgtgaattccttttattttgatgttggtggtggtggtgtgtgtgtgcatgcgagcttcccttgtctttgctagtatggagttacttatttcttgtgtttccttggatgaggttatcttccttgggttgaattttccttctagttctttctgtagggcttgatttgtagatagatattgtttgaatgtcttgatatatcttgttttctccatctatggtgaatgagatttttgctgggtgtagtagtccagtttggcatctattgtttttttagaggttacaagatatctgtctaggtccttctagcttaaagtctctgctgagaagttgggtgtttaggtctgcctttgttggttacctgccctgttttctttgctactatttacttgtcatttttaatattctttctttgttctgtacaattatgtttgaattattatgtaggaggaggattttcttttcttgtctattctgattggtgttctatcagtttcttgtatctttatggacatctcctcctttagtttgggaactttttcttctatgattttgttgaaaatatttcctgggccttagagttgggactcttcgccttcttctattcctcttattcttatgttagggctttccatggtatcccagattttctggatgtgttgcatcaggaattttttggacttaacattttcttagactaatgtatcaatttcttctgttacatcttctattcttgagattgtctctctcttccatctcctctattctcttggtgatgcttgcatctggtgtttctattctcttccctaggttttccatctccaggattctctcagtttgtgttttctttattgcttctagttctacttttaagtcttgcagttttatttacttaacctgcttaattgtattttcctatatttttaaaatggatttatttgtttcctctttaaaggcctctacctgtttgattgtatttttctgtatttcttttagaatttatttgtttcctctttagaggcctctatcatctttataagattggatttaaggtcattttcttgtgcttaggttgtgtcaggatatccaagattttctgtggtagggtaggtgtgcttggaaagtatcatagtgccctgattttagttgattgtgttcttttgatgacctttaaccattcggatggctttgtttcctggatattccttttatagtttgtattgggatgggggtaacattgatggtcctggtatgacaggcctctgatgggtatcctttgtctgtatggttctggatcatcaggtctgtatgattcagagtctggaggtcattatggttacatagctgcaggtctgtatggttcaggatccacaggttgtatggtttaggatccacaggtttgatgaagtgtgctgagacaatagcaggagaatggagggcctcgggggatagcagactgctcagggcagcccaggatgccccagaggagtgagcaagcagggaaggtaggttggagaagggaagctagcctgtatggtccaggatctccaggtctgatgaaggtgggtggagaggtgaggggagaattgaggtctcttggcatagcagactactcaaggtacatgggcatgcccctgaggactcagtgaggagggtgcctgcttgtgttttttaggagagacagaaagcttgtgaatctagatggagggaatatagggaggatccatgaggagtttggagagtggtaactataaccagaatgtactatatgaaataaaaaaaaatcttctttttaattaaaaaaacgggggggggtgagcagtaggttatacccataacatttttgctactattatatcaacttggatatgctgacattctgatcattattataggtcacatggttcacagctggttaatgccaattgactatccccatagaagtctgcataggaccttctaggactacgagtgttagcttagaaggagtagtaaagtcttatgtgatgagtttttaaaaaataaagcatacaaaatgtgctttggaatattaatatgtcaagatgttgatgtttgacaaatgaatatggctctctcttctacaaattggctttgtttttttttttattctagggaaatataaatgagctgggcaagatggttcttcaaggttccttcaatgtttggctaggacaccggaaaggtgctacaaaaatgaaggattttgcacgtttcaaacccatgcagagacatcttttcttatatgaaaaagctgttatgttttgtaagaggcgtttcgaatctggagaaggtgctgatagatacccatcatacagttttaagcactgcctaaaagtaagaaagctcacgttgtataacacaatattgtcttgtatgtacttttttattttcttatatgaataagctctatactttagctgcacatcctctgtttaagagaattaaaaaaaaccaacacatgtgtgttcatgtgtggggacaggcacatgtgccctatagcgctacactggagtccataagacacctcaggtcttggttctcaaccttccattttgtttgaagtaaggtgttctattgtttactgctttgcacactagtcttgcttggcccaagagcttctagggattctcctgtctctacctcccttcttgctgtgagcatgtactagcatacgtaatttacatgggttttgggagtctgaaattaggaaaagggattgggcccaggtgctgagtgttaattcaacttccctatcaatgtagtctcagacatttccaaggtactctccagtgaactggagctatgagctcatctaatggtattggataaaattctcagtcttgttatcatgaagctgttgttataaagaaacaaagactaacgtgtttccctcttctcactgcaggttacaaatgaagagtttttgtgcttaatatgttcctactttcctttctttgtccctcctgcgctctatcgccccatgctttctgggtatccaaagctacctacagctggagctctctcatatacattctgggctattcgttaaattgttttattctctctagaatgcaaactaccaccgtgccctgacattagtcttgtgttaaaatcaggacactgttttttgtaaaagtcactaacagctggggagcacttccacttcaaataaggctataattcatactttgttcatagaataattggaagatagagaacttttcccttcagttctttagtcactatcattttactcctttttccttgtagttgttttccatgaatggtttcttccatagttggctttcccagtatagttgataaaattttatctgtgcttttcctgatggccctgtcatgggggaaaggatttagtgtaaggatcccaccttataaacaggccctgctcttaattttcttcatattggtcagctgcctctagctatacatagcaaaattcctaaccggggttatcccattgtctgttctattcaattctgaatccacagtagttccatgtattctttaaaactccaaccatctacattataagtacacagttactcttttaatatagcccacctctaagtctacatatctctgttgtttatgactgcaataaacatcaactgtgtgccaaagctatcaaatctgagaggttttagattttaccatctacatatgtgcttcttaaaaattattttcatcttactaggcatgtttgacataaaccaatttgatgcacattctatttgtggggtgacctagtggctacttcatgcagaatttcttgtttgtattgattttctgttttattttaaattttatacaatgatagacatgccagtggagtgtttctgaacttcattaaagaaaagaagggctaatgaggtaatggggccagaaagattacaattgttaccatgggaacagaaggaggaattgaagcaggaaacatttcaatggaagtcagccataagagctctgtggcttaccagatacagaaaataaatactacttgacatttaaaagaagaaaatctggcttttttttggtactgagatataattggacctttaatagaaaagaattagtcagtgatgcttgcaaattttcgatgaagattcctggggaaatggtgatgctgaagactatttcttaggtctcgcttgcttgtcatgaatgtctatcattagtgctcagtgtgctactaaacagagctgaacaactcttctcccctgaaatggattttttttcttcactttatcgcaccaagctggaattacacaatgttattgtgtctttcgaatgactgtgtactataatataagcgtttaacactcacaggaaaaccatatgtcaggtcacagtaatcagataaagacatttagcttcttcagacccatcagattgtatgcttgcttatcattatcaactgggtcaccttgggcgcggagtcagtggacaccccccaggtccccagaggactctccccttgatcttaggacctctggtgagtggaacacaacttctgttccaatccaatcatgcaggacctgagacagcattaattagggaagtagaaaacccagcctgaccagggtcacaagtcccttccagtcagcaccagcactgggtcaccttgggcacagagtcagaggacaccccctaggtccctagaggactctccacgtgatcttagcacctctggtgagtggaatacaacatttgccaggaggcaggtccgaacaccagatatctgggtacctttcctgcaagagaagagcttgcctgcagagagtgctctgaccagtgaaactcaggagagatctagtctcccaggtctgctgatagaggctaacagaatcacgagaggaacaagctctaaccagagacaactataagaacaaactccagagaataccagatggtgaaaggcaaacttaagaatcttactaacagaaaacaagaccactcctacctcactcagtcctgggcaccccaacacacccgagaagctaaacctggattaaaaagcatatctcatggtgatggtggaggacatcaggaaggactttaataactcacttaaagaaatacaggagaacactgctaaagagttacaagtccttacagaaaaacaggaaaacacatccaaaccagtgatggaaatgaacaaaaccatactagacctaaaaagggaagtagacacaataaagaaaacccaaaatgaggcaatgctggagatagaaaccctaggaaagaaatcaggaaccatagatgtgaacatcagcaacagactacaagagatggaagagagaatctcaggtgcagaagattccatagagaacattggcacaacaatcaaagaaaatgcaaaatgcaaaaagatccgaactcaaaacatccaggaaatccaggacaaaatgagaagactaaacctatggataataggagtagatgagaatgaagattttcaacttaaagggccagcaaatatcttcaacaaaataatagaagaaaacttcccaaacgtaaagagatgtccatgaacatacaagaagcctacagaactccaaatagactggaccagaaaagaaattcctcccgacacataataatcagaacaacaaatgcactaaataaagatagaatattaaaagcagtaagggaaaaaggtcaagtaacatataaaggcaagcctatcagaattacaccagacttttcaccagagactatgaaagacagatccaggacagatgctatacagacactaagagaacacaaatgccagcctgggctactatacccagccaaactctcaattaccatggatggagaaaccaaagtattccatgacaaaatcaaattcacacattatctttccaagaatccaacacttcaaaggatattaaaagaaaaaaaaaaaaacaatgcaaggatggaaacgacaccctagaaaaagcaagaaagcaatccttcaaaaaaccaaaaagaagacagccacatgaacagaatgacaactctagcaacaaaaataataggaagcaacaattacttttccttaatatctcttaatatcaatagactcaattccccaataaaaagacatagactaacagactggcttcacaaaaaggacccaacattttgctgtgtataggaaacccatctcagggaaaaagacagacactacctcagaatgaacggctagaaaactattttccaagcaaatggtctgaagaaacaagctgtagtagttattctattatctaataaaatcaacttccagcccaaagttatcaaaaaagacaaggagggacacttcatactcatcaaaggtaaaatcttccaagaggagctctcaattctgaatatctatactccaaatgcaagggcagccacattcattaaagaaactttagtaaagctcaaagcacacattgcacctcacacaataatagtgggagtcttcaacacaccactctcatcaatggatagagcgtggaaacagaaactaaacagggacacagtgaaactaacagaagttatgaaacaaatggatttaacagatatctacagaacattttatcctaaaacaaaaggatataccttcttctcagcacctcatgataccttctccaaaattgaccatataattgatcacgaaacaggcctcaacagatacaaaaatattgaaattgtcctattgaatacaccctatcagatcaccatggactaagattgatcttcaataataacatgaataatagaaagctaacattcatgtggagactgaacaacactcttctcaatgatatcttagtcaaggaaggaaaaaaagaaagaaattaaggactttttggagtttaatgaaaatgaagccacaacatacccaaactaatgggacacaatgaaagcatttctaggagggaaactaatagctctgagtgcccccaaaaagaaactagagagagcacacactagcagcctgacaacacacctaaaagctctggaacaaaaggaagcaaattcagccaagaggagtagacagcaggaaataattaaactcaggggtgaaatcaaccaagtggaaacaagaagaactattcaaagaatcaaccaaaccagaagttggttcttttgagaaaatcaagatagataaacccttagccagactcactagagggcacagggaaagcatcctaattaacaaaatcagaaatgaaaagggagacataacaacaaattctgaagaaatccaaaacaccatcagatccttctacaaaaggctatactcaacaaaactggaaagcctggacgaaatggacaaatgacagataccaggtaccaaagttaaatcaggatcaggttaatgatctaaacagtcctatatcccctaatgaaatagaagcagtcattaattgtcttccaacgaaaaaaagcccaggaccagatgggtttagtgcagagttctatcagaccttcaaagagtacctaattccagttcttcacaaactagttcacaaaatagaagcagaaggtactctacccaattcattctatgaagccacaattactctgatagctaaacaacagaaagatccagcaaagatagagaacttcagaccaatttcccttatgaatatcgatgcaaaaatactcaataaaattctagctaaccgaatacaagaacacatcaaaacaatcatccatcctgaacaagtaggtttcattccagggatgcagggatggtttaatatatggaaatccatcaatgtaatccattatataaacaaactcaaagacaaaaccacatgatcatctccttagacatagagaaagcatttgacaaaatccaacacccattcatgataaaagttttggaaagatcaggaattcaaggcccatacttaaacatgataaaagcaatctacagcaaaccagtagccaacatcaaagtaaatggtgagaagctggaagcaatccaactaaaatcagggactagaaaaggctgcccactttctccctccctattcaacattgtacttgaagtcctagccagagcagttcgacaacaaaaggaggtcaaggggatacaaattggaaaggaaaaagtcaaaatatcactttatgcagatgatacagtagtatatataagtgaccctaaaaaatccaccagagaattcctaaacctgataaacagcttcggtgaagtaggtggatataaaattaactcgaacaagtcaatgacctttctctacacaaagaatatacaggctgagaaagaaattagggaaacaacacccttctcaatagtcacaaataatataaaataccttgttgtgactctaactaaggaagtgaagtatctgtgtgataagaacttcaagtctctgaggaaaaaaattaaaaagatctcataagatggaaagatctcccatgctcatggatgggcaggatcaatatagtaaatatggctatcttgccaaaagcaatctacagattcaatgcaatccccatcaaaattctaactcaattcttcaatgaattagaaagaacaatctgcaaattcatctggaataatgaaaaacctaggatagcaaaaactcttctcaaggataaaagaacctctgggggaatcaccatgcctgacctaaagctgtaccacagagcaattgtgataaaaactgcatggtactggtatagagacagacaagtagaccaatggaatagaattgaagacccagaaatgaactcacacacctatggtcacttgatctttgacaaggtatctaaaaccatccagtggaaaaaagacagcattttcaaccaatggtgctggcacaactggcagttatcatgtagaagaatgtgaattgttccattcctatctccttgtactaaggtcaaatctaagtggattaaggaactccacagaaaaccagagacagtgaaacttatagaggagaaagtggggaaaagcctcgaagatatgggcataggggaaaaattcctgaatagaacagcaatggcttgtgctgtatgatcaagaatgacaaacgggaactcataaaattgcaaagcttttgtaaggcaaaagacactgtcaataagacaaaaagaccaccaacagattgggaaaggatctttacctatcctaagtcagataggggactaatatccaatatatacaaagatctcaagaaggtggactccagaaaatcaaataaccccatttaaaaacggggctaagatctaaacaaagaattctcacctgaggaataccaaatggctaagaagcacctgaaaaaatgtttagcatccttaatcatcagggaaatgcaaatcaaaacaaccctgcgattctatctcacaccagtcagaatggctaagataaaaaattcatgttacagcagatgctggcgaggatgtggagaaagaggaacagtcctccattgttggtggaattgcaagcttgtacaatcagtctggcagttcctcagaaatttggacatagtactaccggaggattctgcaatacctctcatgggcatatatccagaagatgtcccaactggtaagaaggacacatgctccattatgttcataacagccttatttaaaatagccagaagttggaaataatccaggtgtccctcaacagaggaatggatacagaagatgtggtacatttacacaatggagtactactcagctattaaaaagaatgaatttatggaattactaggcaaatggatggactggagggcatcatcctgagagatgtaacccaatcacaaacgaactcacacaatatgtactcactgataagtggatattagcccagaaacttaggatacccaagatataagatacaatatgctaaacacatgaaactcaagaagattgaagactgaagtgtggacactatgcccctccttagaattgggaacaaaacacccatgaaaggagttacagagacaaagtttgtagctgagacgaaaggatgggccaactagagactgccatacccggggatacatcccataatcagcctccaaatgttgacaccatggcatacaatagcaagattttgctgaaaggacccaaatatagctgtctcttttgaggcagcgctggtccctaggaaacacagaagtggatgctcacagttagctattggatagatcacagggcaccccaatggaggagttagagaaaatacccaaggagctaaaggaatctgcaaccctataggtggaacaacaatatgaaccaaccagtacctcctccccacccatagcttctatctctagctgtatatgcatcagaatctggcctagtcagccatcattggcccatcggccttgcaaactttagatgcttcagtaccagggaatgccagggccaagaattgggagttggtgggtaggggattggggctgagggtatgggggacttttgggatagcattggaaatgtaaatgaggaaagtacctaataaaaaatttttaaaaattattatcaactgatgtttgaatttaacacatatgtacatacatagtgctaacttcgtgtcacataaacagagttggattcccagggaaatgttcaaataaattcaatcaataatgatgtactgtatatattagtaatggaaaagagtaaaacagtagcaatttaaatacaggaaggaatgggaagcaaagccataacttcaaagctcattttttggattggagagaagggccaaagagcttgtcattgaagtgtaaggtttggagttcagatcactagcacccatgtaaagtgctatgtgagtgtgtttgcccttcataatctcagctctgggggatcccaacagtatgttgtctagttagactagctggatcttctgatctctgggatcaccagaaataacttggagaggtattgtgaaagatatctgatatcaacctctggcttccacacaggtacatatacacatgtacccatatacatgtgatcacacatacaggcatgcattcaaccccacaaaatatatatgacctgagtatgttgtttaataattcatatctttatatcaactctctgaaatacatgcattcccaattttataggtgaaaaaatgggaatttcagaatacttcaggaccttacactaagacacatggctgatgaatcctagtgacgtagggagctctagtctggtcttctctgattctgaattctatgccagctacatatcatcctatttagacagtcatatgatgaaacgtaactcatttttaaaagattgaatataagtattcttatatcttaatatttgagcagaggtagagtggtacaggaaggatatatttgggaacatttgaaagtaactttggagtgcattcaaggggatgtcagaggcttcataatcagtagagttagttgcatttctctgtataactggtttcctttatgttaatgaaggaatcttgtcagtactacccttactgtttgttagttttcattagggtcattttgggggtttatacatggagcagtatgatctttctttaaacaatgaggagggaatggaaagaaaagaggaaaggcacagaagaacttaatgatgttacacaagggagtgaagttgtaccacatggaattagatggacttagccaacgttgtacaatacacaagttttactagtggtcagaaggttatcactatttctacttatgtattttgtttgctttagaggccgagggattggtgaaaatagaaaacctttgtgaacttggctggctcttttctgatccataaatttgctatttatatctcatagagaatcaatttgtaagatcaaatttatgtgtcaataattactttagaaatcaatgaaattaatcaattacaggcaactttccccattgacatttaattacttttacttctgacaattgttttttgtattatatagttcatttccagcagaattcacccttagataggctgcctgggtattcagtctgatgacacttataccggtcggtgggatggagcatcgtgtctcaactctcagtgtatacctaggactatactcttcatttttatttccttattgaaagtaaaatgtgtattttgcttaagcaagacattcttttccctttagattatgatagaatatagtgattgatatcccgcatttgtaatgaaatgctcattttatttatttatttatttatttatttatttatttatttatttatttaatagatggaagatgttggcatcacagaacatgtgaaaggtgataaccgcaaatttgaaatacggtatagtgagaaggaagaaatttacattgttcaggttggttattcttctggaaaccatagttggcattaaattttaaatttatttatttatttaaatttcatagcccatcaatttcaatttgtattcctgtgtgtgagggtatccattggagaacctaccaagagcctcattttaaaaaaatattttatgttaatttatgtgctttggtgtgagagggtcaggagctggagttacagacaggtgtgagctgccatgtgggtgctgggaattgaacctgggtcctttggaagaacaaccagtagctcttaacgactgaaccatctcttcagcccaagagcctcattcttaaggaaaactgtctgtctttactccagaagagaattcagtaaccatctattggttaggaattcatagctcttcccactccatgttggaacattggctggcttggtcttatgaggacttgtggaggcagccacagctgctatgagttcttgagtacaggagtctgtaatatccagaagacagctttgctttggtcttctctaacccccagatcttatggtttttctgctccctcttctgtgatggtttctgagccatgaggaaggagtgtgataatgatgatcatttaagtctgagcatcctacagccacttaattgaccctggaagcagtttcgaacttctttgttaatcttcagacactgcacaaataaacatctctgatgagttctgagagatgcactaaggtagggagatatcaatttagatggcagtttgatattctgtccacttaacaaaataaaactagtagattcacccctaaccctaaccccaaccttgggttcttgaccagctttgcaataccaggcctgtcatttttctagtggagcagaccttaaatctaatcagaaaacagttggttactcccactgaattcatgctaagggtttaggtgtgtgtatgtgtgtgtatgtgtggggttgttcatttgtgcagtgcttttgaaagccagcagaggacaatagattccctggagctggagttacaggccattgtgagctatcaaagtctggtcctctgcaatatatatatatatatatatatatatatatatatatatatatatatatatatatatactgtgctttgatatatatatatatgtgtgtgtgtgtgtatcacagtgattattctgttcctcaaggcaatccccctctgcgggaatattttatctgctaaagtgagttttttattagatattttctttatttacatttcaaatgttatcccctttcctggtttcccctccaaaacctccctatcagatcccccatcccgctgcttaccaacccacccacttctgcttccctttcctggcactccccttcatttggggcattgagccttctcaggaccaagggcctctcctcccattgatgaccaataaggccattctctgctacatatgcagctggagccatgggtggttggttggtggtttagtccctgggagctctgggggtactggttggttcatattgttgttcttcctatggggctgcaagctctttaagctacttcagtcctttttctagctcctccattggagaccttgtgctctgtccaatggttcgctgagagcaaccacctttatatttgtcaggcactggcagagcctctcaggagacagctatatcaggctcctgtcagcaagcacttgttggcatccacaatagtgtctgggtttggtgactgtatatgggatggatccccaggtgggacagtctctggatggcctttcccccagtctctgcttcacagtttgtctctgtatctcctcccatgggtattctgttccccattctaagaaggactgaagcattcacactttggtcttccttccttttgagcttcatgtggtccatgagttgtatcgtgggtattccacgttctttgcctaatattcacttatcaaggagtacataccatgtgtgttcttttgtgactgagttacctcactcaggatattttctagttctatccacttgcctgagaatttcatgaaggcattgttttttaatagctgagtagtattccattgtgtaaatgtaccacattttctgtatccattcctctgttgaggggcacctgggttctttcaagtttctggctattataattaaggctgctatgaacatagtggagcatgtatccttattacgtgttggaacatcttctgggtatatgcccaggagtggtatagctgggtcctctggtagtactatgtccaattttctgagcaactgccagaaagtataatattttagactataatgtctcatctaatctgataactaatgatcagcatccaaaatgatttaagaagcaaaagggtataatttgaatctggtgttttataaaatgactcatgtttaattgcatttgttttattataaaagcattctttttaaaaagaaacatacttttctgttctgttttaatttttaggctccaaatgttgatgtgaagatgttatggctaaaagaaataagaaaaattttggtgcagcagaaggaacttatgactggtagtttcgttttttttttttttaatagaaaatcgatcttttcatgtaacatgtcctgattacagtttcctttccttctactcctcccagtttctctctatctcccttcccttctggacccaccccctttctttgactggtaatttcaagtatgtatgttttatatgaagaaacacaatgacaacttattagcttggattttgtgaaatgtctcctggagaatggggctgataatctaataatgatgcaaggatttgttaaacttaaaaaagtaacactgcgattcagagaccttaaaaaaatcccaactagtttgaattccaaggtgaaccctggtgctttagaaccagttgagaatgtcaatttccagacattcttgggaggagactgtgagaagaacctcacagaactagtatccagtaaggatagggtggagaatttcttgtcttttgaacttatgcttaagaaaataagactctctctctttctctctctctaatgtatgtatacatgcttgtgaatgtgactatagatgtgtgtgtatggtatatatgcatataattggatatgttactatagatatatatgtatgctatatatgtatatacttgtgtatgtcactatagatgtatatgtgtatgatgtatatgtaagagcttgtgaatgtgaacatagatgtatgtgtatggtgtatggtgtatatatgaatgcttgtgaatgtgaacatatgtgtcaattatatatatatatatatgtgtgtgtatgtgtgtatacatatgtgtatgtatatatatatatatatatatatatatatatatatatatgcttgtgtatgagactgtaggtgtgtgtgtgtgcacgcgcacactccacagtgagcatttggagatccaaggaccaattcattacattctaccttgtttgagggaggatctcttttcattgttctgctgctgcagaagacaggattgctagcgctggagcttccaggaattctcctgcctctgccctctatcttactgtataagtgctgggatcacagacaggtgcttattaacccatgtgtgtgtgtgtgtgtgtgtgtgtgtgtgtgtgtgtgtgtgtgtgtgtgagtgagttttggagatccaaacacaggtccttatgcttgtgcagaaactgctttgcctactgagctgacaccccagcccccagactgtacattttaactaaagtaatacatggtttggactttccagactctgagttcaaactggtcttcctgtttgttggtcagttcaaattcctgaaaggcgtgtgtgtttccatgttcatttggttctacctctgtctccccccaggtccccctttctcttccccccttacctttgtggtgtgtgtgaaagtcattggccttctaaagagtaagaggcatgagttctgaatgttttattctacagctaaaacccagcaggatcaggcactagaccaggaccaacttttcccccagcagcagaatgccgagtaagtgatcatttcattcagaaataaaattctttaaatttctttagatttatttatttccttttatgtgtatgaatattttgcctacatgtacatatgtgtaccacatgcacgccttgtgttcagggaggccagaagaaggtgttggcttccctacaacttaaactatagacaggtcatagccatcgagagtgtgctgggaactgactctggttcctctgcgagagcaacaatcactcctaaccaccgagccatctcttcagcggccccctccgaaatattattcttgctagcttctgtttgctgcacatagcacccaacaatgaaattccagtatcttagacaaccatcagccttctgtaatagcagtaactcattagataccatatttcttaggtctaagccatatgttagacttaaaatctgagacagtatgtaattttcattgggattttaaggagaaccagaccactttaaaagtctttctggcaaggttcatgttgttcaaacagaagtgaagactttatgtttgttgtatgtagtagttggtgaaacagaagctgtacaaacacagcagtgtgattaggttaaaattttacctacatatttatacacaccttacctgatgtattaagagagaagtcttcagaacaacacagattgtacacattcatgcctcgagtctagaaggaagcaggtgtatctttgcataaaggtagcatgctggcttaaatcctaagactgaagctcttcatattatcaactattatacaaacttaaataagggcacatcagctgttggaatagtttctcagcttatttttaacacatagtattaagataggctattttaatttctcacttttcttaggctatgcaaaagctcacctttttgtgtgtgtgaggaaactcttttcaacgccacagaagcaggagcagaagtggagcaagctggtgccctgataaaggtcagggaggcagctgtgctagctcaagcagaggcaagttcagcaggtatgtatccatcttggttagttcctcaggtatgtatccatcttggttagctgaaggcgtgattcataattatgtgagtttttaactcctattgttaatttggacaaaaaaattctagccatgtgttatttttgtataaagaaaagaaaggacctgttttagaaggcttttatttcttgcacactaaagagcactatttttcaaaatgtgggtcccggatccatgaaattggtaattacctggggatttgaagacaaattcgttggctttctctgcctcagatctttgaatggcaggcccagctatgtgaattgactaactttgtatatagggctgatctgtgctcaagtcactggcatgactgcagcccttgcttcagcttcaatggatagttcatctcctggctcttgagcccagagctggggtacttgttttcatatgaaaattgtgccatttgaagtgatttgacacaatccatttgattcaccaaatgttagtatgatcagtgcattgggaattttgtagagtttcatctatagtctaattaaatacacacagttgccatctgtacagtgctaggaaggtagataattcagcaagcaattaaagtggaatgtggttaagtatcatattatggtggtacaaggtgctatacaagcatacaagatctcctaaataacgttggcaacaatagcatagactcccagggaaataccacatacttagtacttcattaagtccttaaccctactagttgaggagaaacaagtaatgatgaccttattctgtgttcgttattcatttcgaggttagttctctcagatcagtgtgttgtgactcccaatcccagcaacaatgtgagaccctagtattaatgccttcatttgacaggtagggaaaccatgtcagagaaggttgatataattatttccaaggtgacatgaatagtttactatggccaagatggaattctgaaagtttgtgacttaaattttgacctagtttcttttctgttattaagatgaaataccctggcaaagacaatttagacaggaaagttttttttttaattacagtttatgattccaggttacagtttataatagcagggaagtcagagttgcagaagccagaagcagctagtcacatccacagtcaggaaccagagagaaagaaatgcattcacgctactgtgctttcataaagagcttgcttgaatagcttttttttatgtttatgaagcccaggattccaaaccaagaaacgatgctgcacactttcaggctaggtcttactacatcaattaaggtaatcaatatagtcccccacagacttgctcacaggccaacatggtctcatcaaaccctcactgagactgtcttcccatctgattctaggttgtgtcaagttgaccattaaaactaaccatcacagattactttatctaaataagtttgtgtgtgtgtgtgtgtgtgtgtgtgtatgacatatatatcttataccttctacctataagctcatttttctctgtctgtgttgggggcggggataccgagtctcactatgtagcattagctggcctagaacctgctatgtagacaatgctagacttggacttgtagagctctgcctgcctctgtcttccacatgctgggatcaaagttatacactaccatacctggctataagcaggatcttataagtcatgaaatgtgtaatgcatgctttctgcctactataagagacaatctaagccgaaataatagcaacaccagatggaatctaacaagtactatttgaatgcaatcaataaatttattataaaatgaagattcagaaccattgttttgtttgtgagggttatttgtaagaaatataaaatattacttttaataatgcccataaatcctaacttccaaccatcctgaaatttaaagaagtacattgtaggcccagtcctttctgaaatgtcaaattcaaaaatagtgaaacctaagtgcaattttattatgtacagcaaggcaaaaatgaaggtcaaagctttgactgtagcagtgagctcacttctcctgtggtggagaaccagatcctttaattaactgctactcttgttgtttgtcttctagcttggaatgggatgttaccatctgcagaaggcgctgctgcaattgctgaacattcatacaattatttctcctctaacaatgaccatggagaagataggacacaaatggttagtatggcatactacatcaatatttcagaggtgcttttactgattcataggcagggcacataatgaacaatattttgtcaggattcttgaggtttattgagtatgtttcatagtgaaaagaatctaagtgagtcttgtcagcattcgctaatcagttatacacagaacactactgaagttacttaaataaccaatttctaaatgtctataaacatatcactttgattgttagttatttttccagcctgactctctctatggtagcacaggctgatcctgttcctgccttaggctgtcaagtgctagaattatcaatgtgtgatttcatgaccctgtcaattttagtgtttttttttaagtaaagtgtttatttcattacatctctttgtgtatatgtaaattttctttaagcttaatttttgcaattataaggttaggaagttaacaaaaatactactgaaatgtcttgtggtcctttcatctagttaccacagtagtaacatcttctataattatgggacacaccaaatcttggaaattgcttcagtgctaaccacaggttttacacagatgtttgctatgtgctttttgtatatgtgtatatggagttctgtatcattttgtccagagctgtggtttccacttatgtataaggggtaggctcagatgtaaagctacaaatgtactttagaaattacttttcacaattatttctttgttttttttacacgactagttttttgtttaaagatttatttattttatgtatatgaatacactgtagctgtcttcagacacaccagaagagggcatcagatatcattacagatggttgtgagtcaccacggggttgctgggatttgaactcaggacctttggaagagcagttagtgcttttaactgttgagccatctctccagtcctcacaactagtttttaattaatatcaaccatattagtgtgagaagggttacatttgttagctataatttacaacagattggtcttaattgtttgtattagcagttctcatattttgagtgacagaatgctaagccatctctccagccacttatagatgtaaatatatagcaactgagagtactggcttgcaaccatctgtgactccagttttagggaatcctgtgtccttttctggccttcaagggccatgggcatatataatatgcaacaattctcaaacagaaattttattcttgatgtaatttataactcctgaaaatatactttattatatattaaaattagaaataacaaagatttagattaggagaccttcgttcttcttgcatttcatgtgtttcgcaaaaagtgtggacactttgccccttcttagaattgggaacaaaacacccatggaaggagttacagagacaaagtttggagctgagacaaaaggatggaccatctagagattgccatatccagggatccattccataatcagcctccaaacactgacaccattgcacacactagcaagattttgctgaaaggacccatatatagctgtctcttgtgagactatgccggggcctagcaaacacaaaagtgaatgctcacagtcagctattggatggatcacaggacccccaatggaggagctagagaaagtacccaaggagctaaagagaactgcaaccctataggtggaataacaatatgaactaaccagtacccctggagctaaaagtgggagtgggtgggtaggggagtggggggagcagtatgggggacttttgggatagcattggaaatgtaaatgaggaaaatacctaataaaatattaaaaaagaaaaaaaagatcaggagacctactataattttgagtaagtaaatgatttttattacaaagtgaccgttttttaaaattaaaaaactagtgggaaataaaacagtcttgcaaatgtctttaaaaactggcttatttaaatatatcctgagccagggctgatagcacatacatttaattccagcatttgggaggtagaagcaggtagctctctgaattggagaccagcctggtctacgaagcaagttctaggacagccatggagggctatatagagaaaccctgttctagagaaacaacaacaacaaaagacattctggttttcatgtggttttgaatgtaatctgttctactattatacctcagatagactctataaaactccctgaatatgtgtaagaatgagagtaaaacaggcgaatgctattctaatgtaagcctgaccctccagacagattgaatggatttcagaaagaaatgttctactttgtatatttggcaacccactggtttagaccaattatagtaagtgatgtttctttaagttattggtagatgaattaaattggcgtagttggtccgatatgagcacgaaagtcagaggaaagcagttggtatttgaactctgcctgttgatggtctggaagggcttgtcagaactgggtctttgcacatttatccagttatggagtcagaaaataaagtgactaatgttttaatcacaggcattgggaatgtaggaaaacctattcctgggtcttgctacccaggaaataggaaaacatacacaatacagtgttgtacagcacacaactcctttaccttaaagttttaaagaagttatgagagatcatgtctcaaagggtgtggaagacgcgcgcgcacacacacacagacacacacacacagatacacgcacacacgttcacctacatacacatgcctgcaacccatacatatggatatatactcaatttgaatatacacacacaaacacacacatgtttacctacatacctgcagcccacatatacagatatatacacaatatgagtacacatatacatgctttaaaagaggatgttgagatgagtcattcatttgactttacaaagacaggagctgagaagcaagccagttgtggtggtgtgtgctgtaacaccagcgctgggaaggctgaagcaagagaatagagagtttgaggccactgggctgtagagctagttccaggccatacatatatatgtacatacatatatgcatacacacacacacacacacatacacacacacacaccccaaactgaccatagaaataatggattacatttctattgcagagacacatgtcggaggtgacattctagttgtaaagaagccacagtgtcatctggcaagttgctctgcctgcctgcttctcagcccatgtggaaaaaaaaaaacacccctcaaaggaatttcagcccaaatgatgggatttccgcgccccccccccaggttaatatatttaaacatgcacaaaaccaacggcatatacttctttctttcactttttattccttaaattgcatacgtgtgtaagtcattgtgccggataaaatcaatctcatctcagaatatttttgacttgaaaattgtttcttctctgtctactttgcaaccaaatgcaatcagtgtgccttgaattatttagcttattattaattaagttaaactagggctgtagaatagttaaggccaagtgaagcacaacgctatgatttaaagcgctttttagacccagcgctcctttaacccatgcaagacaatggtggagttcagaagtcctgggggtgggggtccttagtaaattctattcagggctattgccttttctatgtgccaagatgaacttttcctgagagtagtttacaaattgcatttaaaatgtaatattttcatgcttgtttctttttctggatttatgcttataattcatgtagcaaattagttgtgctctattatcttctgtacatttcatgctgtaatcattttttttccaaataaaaatgaaaacttcaggttccacaaattgata

SEQ ID NO: 621 - DNA, 11662 bp, mus musculus
ggctgtgagccgactaggttcggtagtgcgctgctgggctcggctgtgttcggctaggttcggctgtgcacctctgggttctgctacgttcggctggaagcctctgggctcgattgtgtttggctgtgcaccgctgggttcggctaagttcggctgtgcattgctgggcttggctgaacgctactgggctccgctaagtttagcaggagcctctgggctccattgggctcggcttcattcggctaggtttggttgtgtgcctactaggttcggctgggcgcctctgagcgccattgtattccgctgtgcgttgccgggctctgctgtgtccggctaggttcggctgtgcacctctgggctctgctaggtttggctgggagcctctggactcgattgtgtttggctgtgtaccgctaggttccgctaagttcggctaagttcagctaggttcggctgaatgccacttggctcggctaagtttggctggggcctctgggctcgattgggttcggctgagcatcacggggctcgattgggttcagctgagcatcactgggctccattgggttcggctgggagtttgctggagcctggggcaccgctgggcgagccggcgcttctagcctgcactctcagtgggcgtggaaggcggagcgccccctagcgaaactgcgtccccaaacagtgagcaaataggctcgcgctcgagcctcggaggctaccggagcaccggaactcggctgggcgccgcagcagccagcctcaggcgccggcggtgacgccgtcttaacgcgaccgcgcgctgaccagccccggtctccacgtctcaggtttcgcagagacgcatgggaggggagcagttggaggtttatcaagatggcggaagcggaggactctccgggagaacaggaggcagcggcatccaagcccctggtgagttaagaggacagtggcagaagggactgagggcgaggcagagctcccgggaagcgagtcgggaaggcttcgggatcagagagccagagcttcttggctttgcaggcccttggcgtctacaaccagctgacactacacctggtctttgagttagctgcatctcccttccattcgctggccttctgtgcctttctgagactctccgctgtctgtccacactctaggggttctttgacagtgagttaaatgccgagcttggagtggtttctgaagtatcctctatcgctgtcatttatcacgacttgtcaccagtcattgtgaagtactacacaagtaatgaaactgcttctcacaggacgttgtcgttttattggttgtaaccggaacctttacttgcccggtgggtgactcaaagcagctaattattatttgcaggtgcttgctatccccttcatgacacatatgtcactaagagccaccaatactgctttaagaacactggcttcacagttaaccccatgtgagctagagtgcattcgcactgaagcttttgtgagtttgagcatttcgtttcagtgaagggtgtttttgactcttaaactgaaaagaaggtacctgcctttaaaatggcataacttctatgaagtgcctaatacagtcatgagtggaggagtataaggaagtcgttgttacgccctgtcgttcttcttcccaaacagtatttgcttatatactgtttgctcagtaactgctttcatttcttttgttttaaattggcagcgtaacagagaactgaactgagaggcaagggaacttggttcaagtcccagctcttctgcttactagctctatttgttcatctcttcagcaaaaatatttctcgagcatctagagtgttccaggcagtcttttaggcaccaggaatgaaactgtaaaggaggatattgaatctggggctggagctcagcgggaaagagagtgcattacatacgtaagaccctttcggtccaatctccagcactgaagggataaggtcatttgggccatcttatggatcagttgtgaccctgagtaaagtctctctaaacccaagtttagacgttcggaaaatgatgaagctcaccacagaatagtgaaaatatgtaaactaatgcaaacattatgcctcctgccacatagttacaggttacctagctgttcttagtttccctttactccagactgttccccgttctgtaatgcctgtgatgtgtttaagtacgtgtgcaagtttgtacgcatgcacgcatgcatgtgtagacagggcttactgtgttaactaggagtgtttaggaattagttgtattgcccaatgtctgttgagctacttttagttactacgcaaaaccttaaatagccaggcccaactctagaaaatggtgatgtttctgagacattttgcagttgtaagcttaattttctttcccccaatcttttctcagtttgcagggttgtctgatgtgtcaatttctcaggacattcccatagaaggggagattaccatcccctccagagctcgtgctcaagaacatgacagctccacactgaatgaatccattcgtcggaccattgtaagttagacgagttgagagaccacttcagtgttatgggagcgaataggcactaatactttgaaatacttttgtttggttctttgatttttttttaaatatatttcttctactgaaatgtaagagtccccctatgactgagttgttagtgttcttggcaaacaggggccttcatggtgctttgatcagcacaggacatggagttatttttgtttttcagatgcgagatctaaaagctgtgggaaggaaatttatgcatgttttatatccaaggaagagtaatgcactgttaagagactgtgagtatatgaggtttttgaggatttctttcaaaccattgatagtttattggttctgctttataaagcaaaggaaaaagtaataaggcggatgctgctgttttgcaggactaaacagttctgtaaatgaaattgttggcagaagtttagaacagaatttcagaagttgagaggcctggctcatcatattaagttcaccaataaacatgaacgtagaacctgctcacagttgaatttgctaatgtgatttggctgtcgttaggaatccaaggtgattgagattctctctaggccctgacatcacaggcagaatatcttacttgaatattgtgtccatgtggagaacagattgtccatagctcttaatgtgctagaatggggattaggaaatgaagaaagggtaatttatgacacgtgaaaataacaaaccttaaaggatatatgaagtaagggagggaaacagaaaggttgggaaggcttaggtaaaccttgctgctaggattctgagtggaaggtaagtaattaggtaaagatagaaaatatggcatattggtttcttagcatcttgtctttcctctcattgtaggggacctgtggggcccattgatactttgtgtgacacttgcattgtaagtatttatacttcttcctcactggagcctgtttttgtttagttttgttttaatgggctttccagaattaaggaaaaaattgactaggcctttagggcgtcttctattttttttaatttatttattaagaaagaaaagataagagttgtagtatgtagcccacactatcctggaactttctgtgtagcccaggctggcctcaaacttgtgcttctcctgctccaacttctgagtcctagtatttcaagtatgcaccaccacaccataacttaaaatttatatttattgtatactcatttagattataatgtagtttcactttcttgttcttttaataatcacatcaaggaaactggttctgtgccttgaaaggatatgtgttaagagctcttgaaaaaatatatatattgctgagttttaaaagattaaccttagagcatatgtagtttcactacacttattttcagagacaactgtaggcctaaaatgaactcacgtgacatgtctagtgatagtactagcatcagtattgggtcccttgcctcccagcttagttcatattcttgccacctgaccatactcaagtgataggggttccagagaacagattccagcacattctctgtacccagtgctccggacttggaatagaacacacacagccgtagaatacaaacgcctgcacatactatcaggcagtgtaaccgggtaagacttaatatataacatctttatcctatgtaatatgaggttatggacttttttattatttttcaggaaaaacatactgagtctaagtattctaagttcagaattcaaaacattttacatctattaaatttttagatgcagaatatttaagtgacagttcagtatttactcagcttcaaggcaaaggtttttagaaattttatatgtgtttatgtgtgtatgtgtgtattatatatgtatgtgcgtgtgtgtgtatatatatatatatatatatatatatatatatatatatactgatttttaaaaatcagcaacgaaataagtttaaagagtatttctgctattaagcattcgctctaaaaccttagtgcacgaattagaaattcatagctgagcatgctgcctgtaaccctggcacttaagaagctgaggcaagaagatgacaggttagaggcttagcctaggccacacaactagaccttgtttaaaaaaaaaaaaaagaagcaagcaaacagaccatcattcagatttgctaacagctagaaagtaacctaagccctgagaatactgatctgataactggaaaacccttactgtcctgccagctacacctgacggtattgttggaatggaggtcaggtgtgaaaaaatgtcacttttcacataactacagctccctctttgttttgcttgggaatgtaacctcgtgcctcgtacatgctaggtagacactaccactgagataatcctcagcacacaagtacattcttttcttctgactcgagttttctgactccatcatcccagggttgggattatcacccaagccatcttcataaatgcagagtcctaggtgaagccctccaacttagaagtactgtcaagctagatgtaaagctagtctccatgtattatgaacaacaataaagtctcatgcttgggagctatgttcggcccttaagttcaataacttccgcttggacagagagcttttagtaagccagttaaacactctagaaaggtcaaagtgcaacactccttatagtcttcaggcatttgggtttttaaataaggaaccttgccagttctgttagtgttttccttatacaaagtacacattacagaacagattatgtactgatttcagacgagatacgttaccgcagtatgatgagaatgcatgcctttctcgctttgtgtaaaaggttatgtagttttcatactgttttcttaggatgttacagaaaagttccattgatgggaagaatgatggcggaggcccagaattcgcagaagtatttgttatcatctggtttggagcagttaccatcacgctgaattccaaacttcttggcggaaacatgtgggtattcatatgtacctttttcctgcttgctaggtagcacgtgggagatgttaggaaaacagtgctattttgctttttttttttttttaagaaaaattgacttaaggaccaaataaaaagtttctttaaaactcaattgaaatgaattttaaagttcactgataagcttcagcttttctctttaaattttgaacttataggcaaaattattctgaggcatacatttggggcatatggtacaacacattctcagattggtctcttaactagaatagactaagagctatattatagggtcagtgggatacctcgaagaattagagtagattgtttgatattagaaaattgacatttatggggactaacgaagggaacaggaagagaatagagaaaatgaaagtatgcgataacaggagactagacccatgaaattaccattaggataaaggtatagataggctagcaggaaggaggcagtagtgtatagaatgtctataagacatctgtgcaatgagctatgtcttatactactcagtgacacttctgatctgtggatgtgtgtttgcagttctttttttcagagtctctgtgtattagggtactgcattcttcctttgaacatcgcaatgctgatctgccgcttgctgcttttggctggacagggaccaataaacttcatgattcggctttttgtagtgttgttgatgttcgcttggtccgtggtgggtgagtaacagaacataaaacaaccaagataaaacaaagacacgagttaaagataaagagctgatttggaacaaggaaattctgctgtcaaatgaaagtagtatgcatagactcttctgtcctacataagtattaaaggtaatcatatccacattttgtgagctgcctatctgaactctgaagatgtgcagagtcaccaggtatggtgttgtatacttataatcccagctactttggagacttgaggcaagaagtttgcaagttcaaggccagcctggacaactagatcctatctcagaatgaaaactttataacaaggctgggaatatagtactcctcatagtagagtgcttacttagttagcatttatggaccctgggctcaagcctctgcaccacagaacaaaagaaaataaacaaaaagatgtatataaccacattttttgagacagaatctctgtgtcactcagattagccttgaacccatgatcctcctgcctttgcctcttaaattgttgggctactggcctgcaccactctgtccagcatataggagttttcttaatgagtaagatgagtaggcttttattgggtggatagaatgatagcacgttaaagagaactgataggttgcaggcctatagtccccatagtcccaggggacaggtagcagcaggagtattatgagttcaaagtcaactttggctacatggtagggtcaaggccagtggttcaagcatcaagaccttgtttggaaaaagaatgccaataacagcagtaacaaacagacccctttcccccattaactcataaaaatgaagcagtatgagacatttagcataggagcagataaacttactcacatttaaacctgctaagcataactctgtctttctagaatagattaagacacttgcttaagaaggatttgtaccaaattagccaaaaccttttgaagctttagtatatgaaagaagctacccctgggctgttgtaagtttataagtttaccctgcttatgtgtgttggaacctaggaccttgtccatgcttagcaagtactgagatacacacttctgccctataactgaacttgtattattctctgaggagccactaataaaacggaacttttagtgtacttctataatctagattatgccaatgacattggaatttagtaaatattgtagttctgataataggaccatactaaatactcctttttgttttctttagcatctacagcattccttgctgacagccagcctccaaacagaaaagccctggcagtgtatcctgtctttttattctactttgtcatcagttggatgatactcacgttcacgccatgagtcaggatacacacattcaacaccaatgaactgaaggctcacctgaaagataatggttatcaacaacaacaacttctcccactcttgtacaattgttggggtattaaaagggggccacatgccactgttgtcatttatataagaaactgatatttgcaaggctgtccttttcctcttaatgttattcttttcaaatacttgtacatcccatagatagtaacatgcctccttaaggcatgatgaagctattcgtgtgacccagtgactcgagcaagtggatccactctacagattacagagttggtgaccatcttcagcttggagaagatttgttcaggtgcagctcttaaacacattgccttatgactattagaatatgcctcttttcataaataacagtctgtatccattgattttcttttctcccccaaactcgagaaggcaacagcaagaggttaggaacgaggtttgtagatgtgggaagagaaaacgtgttaactagtttcagattttgatcagaggtaccgctgtacttggtttgtcgtttgtttttaagcaaataacatctaaggaatccgcttttaaaatatttttgtatacttacttttctgtcacgtgtaacagaggctccgcttacattctagtttttaacctttcatacagtgacagcagtcaaacatgcaactctaactgaagtgcttgatggtttaatgcttgagctttcctaagtagtagaggatcagaaatcgaggtttatggtttgtagtgcatattgtcatgtgggtaccttcctttaaggtatagcttggctattgcgtatttaaaagaatctattttgtacaacccagcctcagattagaaagaaaggctacatcagaagcgtgcatttaaccaaatggacatagagatctagtgttctgaagactggataatggaagaatgcgtacatacatgatgaagggttagttgagtttatagctgctgcctttccatagtgggctcagcagggtttttttgtttttgtttgtttgttttgattatatatggaggaatttttttttttggagttgggggctagggaataacaatttttttgtgtgttttagactttatttgtaaagctaattagcttccctttagatatgtacattttgcacatgtgcatctacctgtcctctcagatatttacgcacaagagtgaaggcttttcagggaacagaacatctagggcaggctgattttcagctaaacaggactcctgtaagatagtaagcaccgatgccttctgtatgtgtcatattgaactctaatagatgaagattaggagtcagagaacattcattgtaaatatgcacttacttgtaaagatagaaatgtcttattccatgtgttttatcatagaattgaaatatttattgatttttgtatttaaagactaccttcatataaatatataactctaaaaacataatttttctcattctcaaagtaaccaaatgagcaacactaggccaaatgggttcatgggatgagttacaaagcattgctgagtttatcctctctgtcccaaccttacttacctaatggtttggagatatagatttgaattcattgtaatttatgttttaaattataaaccttgtaaggataaatctggtatttcaatcttgaaaactttaaaactaaccctaatatttgaaatttgtcataaaatatcatttctttcctgtatcgaaaattttaaactttcccttcaaatatcttccctaagttgtttcataatatgcccaagtaattataataacaaagtaaccatacttctcaaatttagtctttactggattttactcaggtgaaacatttcctctgaaattcctaaggccacaagccgtaagggttttggagggttaaacacgttggatataaggcagcttgatcctgtgtgtgttaatctgttgcccttgggtgatttgctgaatggtttttatatggcttaaaaggggaatttaggactgaggctgtagttcagtgatagagcattagccaggcatgcacagcactctaggttcaatcctgggcattgccaaaaaaaaaaggtggataaactggaggcctaatttctttttttctggaattaaatgatcagaggatataaatattttaatatatgcaaaaaatctgttgctttctatgacaaatgaagtcctgactctggaagttgtaatctagcttttcctggttcgctacaaaggcacatggttgactgtagaaatgaggcctggaagggcagaagcgcccagggaaggacctcctgttctaagatggtgcagtttcatgctgctggtgagtttgaagcttttttgcagactgcgcatggctattgtagccgactccgacgatcacctgctgcttccacatctcagaccatgacactgttttacatggcttagcaataggaagagtagagacttgatttaattgggcttcagattacaaaatctctagtgatgacaatgtctttgaatgttttatatgtttataatcagatattgaggtgtgtgtgtgtgtgtgtgtgtgtgtgtgtgtgtgtgtgtgtgtgtttggtttggcttcaaagttatgtaagttgaatttgatcttttcattgtgggatctttcttttcgttgggcaaagttacgtggcatgagactaatgataagctgttgactctcttttataaatagtaccctcaaaaatgtgattagaagactactaagcctatacttggagatataatctgctgacttactgcattttagctgcctgcttattcctggagatgaaaatgaaattttgttggttgatatttttgggtaccatcaagtcgtgttagtatggtttgaacactgaagtgatctttaactagactgttggtttctatgatggttggatggaagtaaataaatgtatgaatgttgatggatccatgtatgtaaattagaggtcctcctctagattctgtgtgcttttgttataaatatagaactgacagggacaataatttatgattattaataactaacagttattgggcatttactgtataccaatttactattctaattttaaaagaacttttgtaatgctttattaaagtccactttaccatgaaaattcatcctttcaaggtgtacaattcagcagtccttactatctttacggaattacgcaagcagcaccactatttaatttgagaatgtctgtatcactgtgcagagaaacaagccactcctgttctctctgcacctccagtccctgtggactaccagtctgctttctatccatcttggccaggtactattctcaatgcctggttcctccactcttcaacagaaagtgctacaattctcattttacagtagaaaatttaggcacagaaatgtaattgcccaagatcatgtattgatgcatgcaagtgaattgatggtaagaacacattagatgaaatgcagtttgtattacactcttaggcacatagaatgagcacattccttcccagagtatgccccctcttactcacctttgcatcctggaactgattggacgtagatatgtcttttttttttttccagagtaatgacctctggcatctgagcacacaaagcaggcagacttaaaaagacaggtttacggcccttactcctcattgacccccccccccgtttcctctcttcacacacacacaatcaatttttccttaagcttgaagagtcaaactactacttaaaaatcttccatttcacgtttaccacttagggtactgggtctatttctaagacttaagattaaagtcattcaagtactgaatgcctttctattcggatagatgtgatgagaataaagactttgccttaataaagcttgttcctttctggtctttggtactctactctagtcctggtctttcctatgagcaataaacctgtgcaaagaaacctggaaaatggtttgtggatgttatatgtgccaataaatccattagaaagaga

SEQ ID NO: 622 - DNA, 11869 bp, mus musculus
ggttcggcggtgcccgctgggctcggctacgttcggctacactcggctgtgatccgactaggttcggtggtgcacggctgggctcggctgcgttcggctttgcaccgactagcttcggctgttcgcctctgggctcggctgcgttcggctgtgtcaggctgtgatcagactaggttcggtggtgagcggctgggctcggctgcgttcggctgtgagccgactaggttcggtagtgcgctgctgggctcggctgtgttcggctaggttcggctgtgcacctctgggttctgctacgttcggctggaagcctctgggctcgattgtgtttggctgtgcaccgctgggttcggctaagttcggctgtgcattgctgggcttggctgaacgctactgggctccgctaagtttagcaggagcctctgggctccattgggctcggcttcattcggctaggtttggttgtgtgcctactaggttcggctgggcgcctctgagcgccattgtattccgctgtgcgttgccgggctctgctgtgtccggctaggttcggctgtgcacctctgggctctgctaggtttggctgggagcctctggactcgattgtgtttggctgtgtaccgctaggttccgctaagttcggctaagttcagctaggttcggctgaatgccacttggctcggctaagtttggctggggcctctgggctcgattgggttcggctgagcatcacggggctcgattgggttcagctgagcatcactgggctccattgggttcggctgggagtttgctggagcctggggcaccgctgggcgagccggcgcttctagcctgcactctcagtgggcgtggaaggcggagcgccccctagcgaaactgcgtccccaaacagtgagcaaataggctcgcgctcgagcctcggaggctaccggagcaccggaactcggctgggcgccgcagcagccagcctcaggcgccggcggtgacgccgtcttaacgcgaccgcgcgctgaccagccccggtctccacgtctcaggtttcgcagagacgcatgggaggggagcagttggaggtttatcaagatggcggaagcggaggactctccgggagaacaggaggcagcggcatccaagcccctggtgagttaagaggacagtggcagaagggactgagggcgaggcagagctcccgggaagcgagtcgggaaggcttcgggatcagagagccagagcttcttggctttgcaggcccttggcgtctacaaccagctgacactacacctggtctttgagttagctgcatctcccttccattcgctggccttctgtgcctttctgagactctccgctgtctgtccacactctaggggttctttgacagtgagttaaatgccgagcttggagtggtttctgaagtatcctctatcgctgtcatttatcacgacttgtcaccagtcattgtgaagtactacacaagtaatgaaactgcttctcacaggacgttgtcgttttattggttgtaaccggaacctttacttgcccggtgggtgactcaaagcagctaattattatttgcaggtgcttgctatccccttcatgacacatatgtcactaagagccaccaatactgctttaagaacactggcttcacagttaaccccatgtgagctagagtgcattcgcactgaagcttttgtgagtttgagcatttcgtttcagtgaagggtgtttttgactcttaaactgaaaagaaggtacctgcctttaaaatggcataacttctatgaagtgcctaatacagtcatgagtggaggagtataaggaagtcgttgttacgccctgtcgttcttcttcccaaacagtatttgcttatatactgtttgctcagtaactgctttcatttcttttgttttaaattggcagcgtaacagagaactgaactgagaggcaagggaacttggttcaagtcccagctcttctgcttactagctctatttgttcatctcttcagcaaaaatatttctcgagcatctagagtgttccaggcagtcttttaggcaccaggaatgaaactgtaaaggaggatattgaatctggggctggagctcagcgggaaagagagtgcattacatacgtaagaccctttcggtccaatctccagcactgaagggataaggtcatttgggccatcttatggatcagttgtgaccctgagtaaagtctctctaaacccaagtttagacgttcggaaaatgatgaagctcaccacagaatagtgaaaatatgtaaactaatgcaaacattatgcctcctgccacatagttacaggttacctagctgttcttagtttccctttactccagactgttccccgttctgtaatgcctgtgatgtgtttaagtacgtgtgcaagtttgtacgcatgcacgcatgcatgtgtagacagggcttactgtgttaactaggagtgtttaggaattagttgtattgcccaatgtctgttgagctacttttagttactacgcaaaaccttaaatagccaggcccaactctagaaaatggtgatgtttctgagacattttgcagttgtaagcttaattttctttcccccaatcttttctcagtttgcagggttgtctgatgtgtcaatttctcaggacattcccatagaaggggagattaccatcccctccagagctcgtgctcaagaacatgacagctccacactgaatgaatccattcgtcggaccattgtaagttagacgagttgagagaccacttcagtgttatgggagcgaataggcactaatactttgaaatacttttgtttggttctttgatttttttttaaatatatttcttctactgaaatgtaagagtccccctatgactgagttgttagtgttcttggcaaacaggggccttcatggtgctttgatcagcacaggacatggagttatttttgtttttcagatgcgagatctaaaagctgtgggaaggaaatttatgcatgttttatatccaaggaagagtaatgcactgttaagagactgtgagtatatgaggtttttgaggatttctttcaaaccattgatagtttattggttctgctttataaagcaaaggaaaaagtaataaggcggatgctgctgttttgcaggactaaacagttctgtaaatgaaattgttggcagaagtttagaacagaatttcagaagttgagaggcctggctcatcatattaagttcaccaataaacatgaacgtagaacctgctcacagttgaatttgctaatgtgatttggctgtcgttaggaatccaaggtgattgagattctctctaggccctgacatcacaggcagaatatcttacttgaatattgtgtccatgtggagaacagattgtccatagctcttaatgtgctagaatggggattaggaaatgaagaaagggtaatttatgacacgtgaaaataacaaaccttaaaggatatatgaagtaagggagggaaacagaaaggttgggaaggcttaggtaaaccttgctgctaggattctgagtggaaggtaagtaattaggtaaagatagaaaatatggcatattggtttcttagcatcttgtctttcctctcattgtaggggacctgtggggcccattgatactttgtgtgacacttgcattgtaagtatttatacttcttcctcactggagcctgtttttgtttagttttgttttaatgggctttccagaattaaggaaaaaattgactaggcctttagggcgtcttctattttttttaatttatttattaagaaagaaaagataagagttgtagtatgtagcccacactatcctggaactttctgtgtagcccaggctggcctcaaacttgtgcttctcctgctccaacttctgagtcctagtatttcaagtatgcaccaccacaccataacttaaaatttatatttattgtatactcatttagattataatgtagtttcactttcttgttcttttaataatcacatcaaggaaactggttctgtgccttgaaaggatatgtgttaagagctcttgaaaaaatatatatattgctgagttttaaaagattaaccttagagcatatgtagtttcactacacttattttcagagacaactgtaggcctaaaatgaactcacgtgacatgtctagtgatagtactagcatcagtattgggtcccttgcctcccagcttagttcatattcttgccacctgaccatactcaagtgataggggttccagagaacagattccagcacattctctgtacccagtgctccggacttggaatagaacacacacagccgtagaatacaaacgcctgcacatactatcaggcagtgtaaccgggtaagacttaatatataacatctttatcctatgtaatatgaggttatggacttttttattatttttcaggaaaaacatactgagtctaagtattctaagttcagaattcaaaacattttacatctattaaatttttagatgcagaatatttaagtgacagttcagtatttactcagcttcaaggcaaaggtttttagaaattttatatgtgtttatgtgtgtatgtgtgtattatatatgtatgtgcgtgtgtgtgtatatatatatatatatatatatatatatatatatatatactgatttttaaaaatcagcaacgaaataagtttaaagagtatttctgctattaagcattcgctctaaaaccttagtgcacgaattagaaattcatagctgagcatgctgcctgtaaccctggcacttaagaagctgaggcaagaagatgacaggttagaggcttagcctaggccacacaactagaccttgtttaaaaaaaaaaaaaagaagcaagcaaacagaccatcattcagatttgctaacagctagaaagtaacctaagccctgagaatactgatctgataactggaaaacccttactgtcctgccagctacacctgacggtattgttggaatggaggtcaggtgtgaaaaaatgtcacttttcacataactacagctccctctttgttttgcttgggaatgtaacctcgtgcctcgtacatgctaggtagacactaccactgagataatcctcagcacacaagtacattcttttcttctgactcgagttttctgactccatcatcccagggttgggattatcacccaagccatcttcataaatgcagagtcctaggtgaagccctccaacttagaagtactgtcaagctagatgtaaagctagtctccatgtattatgaacaacaataaagtctcatgcttgggagctatgttcggcccttaagttcaataacttccgcttggacagagagcttttagtaagccagttaaacactctagaaaggtcaaagtgcaacactccttatagtcttcaggcatttgggtttttaaataaggaaccttgccagttctgttagtgttttccttatacaaagtacacattacagaacagattatgtactgatttcagacgagatacgttaccgcagtatgatgagaatgcatgcctttctcgctttgtgtaaaaggttatgtagttttcatactgttttcttaggatgttacagaaaagttccattgatgggaagaatgatggcggaggcccagaattcgcagaagtatttgttatcatctggtttggagcagttaccatcacgctgaattccaaacttcttggcggaaacatgtgggtattcatatgtacctttttcctgcttgctaggtagcacgtgggagatgttaggaaaacagtgctattttgctttttttttttttttaagaaaaattgacttaaggaccaaataaaaagtttctttaaaactcaattgaaatgaattttaaagttcactgataagcttcagcttttctctttaaattttgaacttataggcaaaattattctgaggcatacatttggggcatatggtacaacacattctcagattggtctcttaactagaatagactaagagctatattatagggtcagtgggatacctcgaagaattagagtagattgtttgatattagaaaattgacatttatggggactaacgaagggaacaggaagagaatagagaaaatgaaagtatgcgataacaggagactagacccatgaaattaccattaggataaaggtatagataggctagcaggaaggaggcagtagtgtatagaatgtctataagacatctgtgcaatgagctatgtcttatactactcagtgacacttctgatctgtggatgtgtgtttgcagttctttttttcagagtctctgtgtattagggtactgcattcttcctttgaacatcgcaatgctgatctgccgcttgctgcttttggctggacagggaccaataaacttcatgattcggctttttgtagtgttgttgatgttcgcttggtccgtggtgggtgagtaacagaacataaaacaaccaagataaaacaaagacacgagttaaagataaagagctgatttggaacaaggaaattctgctgtcaaatgaaagtagtatgcatagactcttctgtcctacataagtattaaaggtaatcatatccacattttgtgagctgcctatctgaactctgaagatgtgcagagtcaccaggtatggtgttgtatacttataatcccagctactttggagacttgaggcaagaagtttgcaagttcaaggccagcctggacaactagatcctatctcagaatgaaaactttataacaaggctgggaatatagtactcctcatagtagagtgcttacttagttagcatttatggaccctgggctcaagcctctgcaccacagaacaaaagaaaataaacaaaaagatgtatataaccacattttttgagacagaatctctgtgtcactcagattagccttgaacccatgatcctcctgcctttgcctcttaaattgttgggctactggcctgcaccactctgtccagcatataggagttttcttaatgagtaagatgagtaggcttttattgggtggatagaatgatagcacgttaaagagaactgataggttgcaggcctatagtccccatagtcccaggggacaggtagcagcaggagtattatgagttcaaagtcaactttggctacatggtagggtcaaggccagtggttcaagcatcaagaccttgtttggaaaaagaatgccaataacagcagtaacaaacagacccctttcccccattaactcataaaaatgaagcagtatgagacatttagcataggagcagataaacttactcacatttaaacctgctaagcataactctgtctttctagaatagattaagacacttgcttaagaaggatttgtaccaaattagccaaaaccttttgaagctttagtatatgaaagaagctacccctgggctgttgtaagtttataagtttaccctgcttatgtgtgttggaacctaggaccttgtccatgcttagcaagtactgagatacacacttctgccctataactgaacttgtattattctctgaggagccactaataaaacggaacttttagtgtacttctataatctagattatgccaatgacattggaatttagtaaatattgtagttctgataataggaccatactaaatactcctttttgttttctttagcatctacagcattccttgctgacagccagcctccaaacagaaaagccctggcagtgtatcctgtctttttattctactttgtcatcagttggatgatactcacgttcacgccatgagtcaggatacacacattcaacaccaatgaactgaaggctcacctgaaagataatggttatcaacaacaacaacttctcccactcttgtacaattgttggggtattaaaagggggccacatgccactgttgtcatttatataagaaactgatatttgcaaggctgtccttttcctcttaatgttattcttttcaaatacttgtacatcccatagatagtaacatgcctccttaaggcatgatgaagctattcgtgtgacccagtgactcgagcaagtggatccactctacagattacagagttggtgaccatcttcagcttggagaagatttgttcaggtgcagctcttaaacacattgccttatgactattagaatatgcctcttttcataaataacagtctgtatccattgattttcttttctcccccaaactcgagaaggcaacagcaagaggttaggaacgaggtttgtagatgtgggaagagaaaacgtgttaactagtttcagattttgatcagaggtaccgctgtacttggtttgtcgtttgtttttaagcaaataacatctaaggaatccgcttttaaaatatttttgtatacttacttttctgtcacgtgtaacagaggctccgcttacattctagtttttaacctttcatacagtgacagcagtcaaacatgcaactctaactgaagtgcttgatggtttaatgcttgagctttcctaagtagtagaggatcagaaatcgaggtttatggtttgtagtgcatattgtcatgtgggtaccttcctttaaggtatagcttggctattgcgtatttaaaagaatctattttgtacaacccagcctcagattagaaagaaaggctacatcagaagcgtgcatttaaccaaatggacatagagatctagtgttctgaagactggataatggaagaatgcgtacatacatgatgaagggttagttgagtttatagctgctgcctttccatagtgggctcagcagggtttttttgtttttgtttgtttgttttgattatatatggaggaatttttttttttggagttgggggctagggaataacaatttttttgtgtgttttagactttatttgtaaagctaattagcttccctttagatatgtacattttgcacatgtgcatctacctgtcctctcagatatttacgcacaagagtgaaggcttttcagggaacagaacatctagggcaggctgattttcagctaaacaggactcctgtaagatagtaagcaccgatgccttctgtatgtgtcatattgaactctaatagatgaagattaggagtcagagaacattcattgtaaatatgcacttacttgtaaagatagaaatgtcttattccatgtgttttatcatagaattgaaatatttattgatttttgtatttaaagactaccttcatataaatatataactctaaaaacataatttttctcattctcaaagtaaccaaatgagcaacactaggccaaatgggttcatgggatgagttacaaagcattgctgagtttatcctctctgtcccaaccttacttacctaatggtttggagatatagatttgaattcattgtaatttatgttttaaattataaaccttgtaaggataaatctggtatttcaatcttgaaaactttaaaactaaccctaatatttgaaatttgtcataaaatatcatttctttcctgtatcgaaaattttaaactttcccttcaaatatcttccctaagttgtttcataatatgcccaagtaattataataacaaagtaaccatacttctcaaatttagtctttactggattttactcaggtgaaacatttcctctgaaattcctaaggccacaagccgtaagggttttggagggttaaacacgttggatataaggcagcttgatcctgtgtgtgttaatctgttgcccttgggtgatttgctgaatggtttttatatggcttaaaaggggaatttaggactgaggctgtagttcagtgatagagcattagccaggcatgcacagcactctaggttcaatcctgggcattgccaaaaaaaaaaggtggataaactggaggcctaatttctttttttctggaattaaatgatcagaggatataaatattttaatatatgcaaaaaatctgttgctttctatgacaaatgaagtcctgactctggaagttgtaatctagcttttcctggttcgctacaaaggcacatggttgactgtagaaatgaggcctggaagggcagaagcgcccagggaaggacctcctgttctaagatggtgcagtttcatgctgctggtgagtttgaagcttttttgcagactgcgcatggctattgtagccgactccgacgatcacctgctgcttccacatctcagaccatgacactgttttacatggcttagcaataggaagagtagagacttgatttaattgggcttcagattacaaaatctctagtgatgacaatgtctttgaatgttttatatgtttataatcagatattgaggtgtgtgtgtgtgtgtgtgtgtgtgtgtgtgtgtgtgtgtgtgtgtttggtttggcttcaaagttatgtaagttgaatttgatcttttcattgtgggatctttcttttcgttgggcaaagttacgtggcatgagactaatgataagctgttgactctcttttataaatagtaccctcaaaaatgtgattagaagactactaagcctatacttggagatataatctgctgacttactgcattttagctgcctgcttattcctggagatgaaaatgaaattttgttggttgatatttttgggtaccatcaagtcgtgttagtatggtttgaacactgaagtgatctttaactagactgttggtttctatgatggttggatggaagtaaataaatgtatgaatgttgatggatccatgtatgtaaattagaggtcctcctctagattctgtgtgcttttgttataaatatagaactgacagggacaataatttatgattattaataactaacagttattgggcatttactgtataccaatttactattctaattttaaaagaacttttgtaatgctttattaaagtccactttaccatgaaaattcatcctttcaaggtgtacaattcagcagtccttactatctttacggaattacgcaagcagcaccactatttaatttgagaatgtctgtatcactgtgcagagaaacaagccactcctgttctctctgcacctccagtccctgtggactaccagtctgctttctatccatcttggccaggtactattctcaatgcctggttcctccactcttcaacagaaagtgctacaattctcattttacagtagaaaatttaggcacagaaatgtaattgcccaagatcatgtattgatgcatgcaagtgaattgatggtaagaacacattagatgaaatgcagtttgtattacactcttaggcacatagaatgagcacattccttcccagagtatgccccctcttactcacctttgcatcctggaactgattggacgtagatatgtcttttttttttttccagagtaatgacctctggcatctgagcacacaaagcaggcagacttaaaaagacaggtttacggcccttactcctcattgacccccccccccgtttcctctcttcacacacacacaatcaatttttccttaagcttgaagagtcaaactactacttaaaaatcttccatttcacgtttaccacttagggtactgggtctatttctaagacttaagattaaagtcattcaagtactgaatgcctttctattcggatagatgtgatgagaataaagactttgccttaataaagcttgttcctttctggtctttggtactctactctagtcctggtctttcctatgagcaataaacctgtgcaaagaaacctggaaaatggtttgtggatgttatatgtgccaataaatccattagaaagaga
